United States Patent 7,745,391 (HUMAN THROMBOSPONDIN POLYPEPTIDE) - sequence listing, part 11

SEQ ID NO: 25995 - DNA, 470 bp, Homo sapiens
tgaacagaggagcaacatgatctgacttacatttctaaaaggattccttcgcctgctgtattgagagtagactattggaagaggaggagcaggggaggatggtcaacaagggcagaaaagtgggggtagttaagaggccagtgtaataatccggtattactatgtccatcttaatgggctaatcatgtgttctgccactgaaatgagggaggtttttctgtgcccctgctgtgtttatacacactgggaggcatgaaagtcatatcattgtggaagtcatccatgctggtgttttactgtcatctagtagattgtgagacctaacagtcacatttgcatataactttatctgtgccctgcttgtctgggaaattttcttgtaagagaaaggagcactttacaaaatggactctctttgtcagttgtcatgctggagtgatctgtggtgattgtccctacggggaagtgct

SEQ ID NO: 25996 - DNA, 1185 bp, Homo sapiens
tgatgggtagaaacgaagtaagtttcctttatttctgggattacaaaaattactttcctacgacagtaactacttttagtcactggaaagcttctttctctgaagattatcataagtctctcaggaataaacacatattgtccagagcttggagaggatccttaaaaacattttttatttcattttttagagacaggatctctttctgtcacccaggctggagtgtggtggcatgattaggattcactgcatgctccaccttctgggctcaagcaatcctcccatctcagcctcccaagtagctgggactataggcttgtaccgtcactctgggctaatttttttttttttttttggtagagatgaggtctcaaaatatggccccatctcaaactctgggctcaagcagtcctccagcctcagcctcccaaaatggtgagatttaaagacctattgaatttaatttaacaaagaaagtttgcttctatccatatctagatatataatgcaaaatttatctgcaacctttcaatctgataaagaaatgacactttatgaaagaacatttagcattgtttagatcaaagtcagtgaataagtctttttcctgacacaaaagaggctttggttctttataaatttacaatgactcattaaacatcaatttgacattaaaacaaagtaagtaaattgaaagctagtttaagaagaaaataagaaacctggatgcatgcatcagccttgtattgctataggagctcccacacataatcttatctcacgtcactcgtgcttacctgacgaatgcagctttagctctcagttcaatgaacagataaatttgctataaacagtgtttataatcaacactgtttataatctataataagagcagcacagacttcttaactgagctttctgtaaacaggaacattttaataagcgataaatttttcttccctcccttcgtctgtatgtatgtatgtatgtatgtatgtatgtatctatctatctatatagatagatagatagatagatagaattttattaaattaatacttaacaattgaaaagttgtcagatctggtgcccagagaagaaaaattgagtttgtagttattattgctgcttggtgttaggtgaagatgaataagagcgacctaatgaaagaatgagtttaaaaaa

SEQ ID NO: 25997 - DNA, 1173 bp, Homo sapiens
accaaaacgttgaagaaaaatacggaatataaaatacagtgtgaaagtttgccttgacaactttactcttaacagtttggtgtgtacctcttcagatctttactagtgactatatagtgtagatgtgattcattgtctttgtctctaacaaatgtgtatttttctgcattgtacttaatggagctatttccgtttcccattctttcctctgccctcttccccagaagtaatcaatagttttaattttgtgtttcattctttatatttttataacttattacatatatgtttttcagtatattgaggtacatcttttttatgtattgtgtggcaattttttggaaagtggtgccccatattttattattttgagtaggaaaaatcataatttccagcccacttaagaccctaaacaatttcctagatatagctaaagtactcaacacctacttgataattcaccaaggatttctgcataatacagagtatttaaaatacaaactacttaatataaacagaaacaaatgaatcactaagtatatttccatttagtatgtactgtattcagataatactttttcttttatactgcaataaaattgtaattgtaaataaacagttaagtgtatttcctttcttttattgttaagtggcacattattgaacatgtttctctctctgaagtcaggatgcatcttacagctgatggtgacttcaagtcatagttgtgacaaacagtaccagcaccaaagcatcttagaatctatgatatatagtatgttaaagatatataatgaatataaagaacacttaataaaataaaatcatagctgagtgtagtgctgtgcacctgtagtcctagctactggagaggctgaggcgggagattagcttgagccccagagtttgaggctgcagtgagctatcatcacaccactgcactccagcctgtgtgacagagcaagaccctcagtcagtcgattgatagatagatagatagatagatagatagatagatagatagatagaattttattaaattaatacttaacaattgaaaagttgtcagatctggtgcccagagaagaaaaattgagtttgtagttattattgctgcttggtgttaggtgaagatgaataagagcgacctaatgaaagaatgagtttaaaaaa

SEQ ID NO: 25998 - DNA, 784 bp, Homo sapiens
tcgggaataggggcggagcctggcttaggaaggggagctgaggtccggggcccagttttccggagttgcgggttctccaaaaaatgtggaatcctttgcatctatgctgagacattctcctcttacacagatgggacctgcaaaggataaactggtcattggacggatctttcatattgtggagaatgatctgtacatagattttggtggaaagtttcattgtgtatgtagaagaccagaagtggatggagagaaataccagaaaggaaccagggtccggttgcggctattagatcttgaacttacgtctaggttcctgggagcaacaacagatacaactgtactagaggctaatgcagttctcttgggaatccaggagagtaaagactcaagatcgaaagaagaacatcatgaaaaataaatgaactttgcttagtggattgactcctttgctgaagtcagttattcatcaagaatgcaattagactaattgtgaataaatgattgaatgaagatataataaataaaagctataattaccaaagagagaaagaaatcacagaagaaacaaaacttggttgggccgcgccgaggcccctgagaaaaactttataaccccatctgtgggggcggggggcccagtagataggacactggccagaggggtccgcaaaggaacccgggcagagcaagtgctgggtccccccaaaaaacgccggggacacggggttgacaaccagtggctctggcaacgcggcttcaccggcaggaccgcatcccacgg

SEQ ID NO: 25999 - DNA, 336 bp, Homo sapiens
tgggattagtgaactggctagttagttaatctatgaaccagaaccaggtcttcatgacactaaatatgcttgtgccttgatcctggacttccagcctctagaactatgagaaagaagtttctgctgtttataagataccctcatttatggtgttttgttattcagatcgaacagactaggaaatagtatggtaagttggaatagtgtaacccccaataagctaataactatcaggtctaggctttgttttgtaatggatctgtatcataattgtggtaagacctctagtcacaggacctggttaatatcagtatgcctcatgttatttgggaatga

SEQ ID NO: 26000 - DNA, 1153 bp, Homo sapiens
gcgcgcttgcggaggggaggtcaaaggtcagaggtaaagaagtcatggcggcgctgtgtcggacccgtgctgtggctgccgagagccattttctgcgagtgtttctcttcttcaggccctttcggggtgtaggcactgagagtggatccgaaagtggtagttccaatgccaaggagcctaagacgcgcgcaggcggtttcgcgagcgcgttggagcggcactcggagcttctacagaaggtggagcccctacagaagggttctccaaaaaatgtggaatcctttgcatctatgctgagacattctcctcttacacagatgggacctgcaaaggataaactggtcattggacggatctttcatattgtggagaatgatctgtacatagattttggtggaaagtttcattgtgtatgtagaagaccagaagtggatggagagaaataccagaaaggaaccagggtccggttgcggctattagatcttgaacttacgtctaggttcctgggagcaacaacagatacaactgtactagaggctaatgcagttctcttgggaatccaggagagtaaagactcaagatcgaaagaagaacatcatgaaaaataaatgaactttgcttagtggattgactcctttgctgaagtcagttattcatcaagaatgcaattagactaattgtgaataaatgattgaatgaagatataataaataaaagctataattatagataactcttattagaattttctttagcaatattcccaccccccaccccttgttttgctcttaatgtttttttcctttggtggggatagtatacactgtactaagaaattgtcattcaataaatacgttttgagtgctgtctaaaaaaaaaaacctcaaaaaaaaaataacaaataaaaaaaaaaaaaatactcacttcataatcttaactatattcatccattataaaaaactcttccaatttccatacctccactcaacactttataatcccattacacctcctttaacttcaagacccattcaatttgcgagtaaccccctttaccaatttgctataaaggggtccgtttaaacacaaatggccgccttataaaagggactctttgggtcaatatgcttattcctccactccctggctttct

SEQ ID NO: 26001 - DNA, 811 bp, Homo sapiens
gcgcgcttgcggaggggaggtcaaaggtcagaggtaaagaagtcatggcggcgctgtgtcggacccgtgctgtggctgccgagagccattttctgcgagtgtttctcttcttcaggccctttcggggtgtaggcactgagagtggatccgaaagtggtagttccaatgccaaggagcctaagacgcgcgcaggcggtttcgcgagcgcgttggagcggcactcggagcttctacagaaggtggagcccctacagaagatgggacctgcaaaggataaactggtcattggacggatctttcatattgtggagaatgatctgtacatagattttggtggaaagtttcattgtgtatgtagaagaccagaagtggatggagagaaataccagaaaggaaccagggtccggttgcggctattagatcttgaacttacgtctaggttcctgggagcaacaacagatacaactgtactagaggctaatgcagttctcttgggaatccaggagagtaaagactcaagatcgaaagaagaacatcatgaaaaataaatgaactttgcttagtggattgactcctttgctgaagtcagttattcatcaagaatgcaattagactaattgtgaataaatgattgaatgaagatataataaataaaagctataattatagataactcttattagaattttctttagcaatattcccaccccccaccccttgttttgctcttaatgtttttttcctttggtggggatagtatacactgtactaagaaattgtcattcaataaatacgttttgagtgctgtcta

SEQ ID NO: 26002 - DNA, 726 bp, Homo sapiens
tcgggaataggggcggagcctggcttaggaaggggagctgaggtccggggcccagttttccggagttgcgagatggggttttgccatgttgcccaggctggtcttgaactcctgggttcaagtgatcctcctgcgttggcctcccaaagtgctgggattacagatgacagatatgggacctgcaaaggataaactggtcattggacggatctttcatattgtggagaatgatctgtacatagattttggtggaaagtttcattgtgtatgtagaagaccagaagtggatggagagaaataccagaaaggaaccagggtccggttgcggctattagatcttgaacttacgtctaggttcctgggagcaacaacagatacaactgtactagaggctaatgcagttctcttgggaatccaggagagtaaagactcaagatcgaaagaagaacatcatgaaaaataaatgaactttgcttagtggattgactcctttgctgaagtcagttattcatcaagaatgcaattagactaattgtgaataaatgattgaatgaagatataataaataaaagctataattatagataactcttattagaattttctttagcaatattcccaccccccaccccttgttttgctcttaatgtttttttcctttggtggggatagtatacactgtactaagaaattgtcattcaataaatacgttttgagtgctgtcta

SEQ ID NO: 26003 - DNA, 1050 bp, Homo sapiens
gcgcgcttgcggaggggaggtcaaaggtcagaggtaaagaagtcatggcggcgctgtgtcggacccgtgctgtggctgccgagagccattttctgcgagtgtttctcttcttcaggccctttcggggtgtaggcactgagagtggatccgaaagtggtagttccaatgccaaggagcctaagacgcgcgcaggcggtttcgcgagcgcgttggagcggcactcggagcttctacagaaggtggagcccctacagaagggttctccaaaaaatgtggaatcctttgcatctatgctgagacattctcctcttacacagatgggacctgcaaaggataaactggtcattggacggatctttcatattgtggagaatgatctgtacatagattttggtggaaagtttcattgtgtatgtagaagaccagaagtggatggagagagtcccatttcgtggtatgctgtttggaggagattttcacaagtgatgataacctgtttttcttccaactctgactttggaaaacatcgtaaaagataaagaagttgtaatacaacatggatgaaccctgaaaacattatgccaaatgaaagaagccattcacaaaagatcatatattgaaataccagaaaggaaccagggtccggttgcggctattagatcttgaacttacgtctaggttcctgggagcaacaacagatacaactgtactagaggctaatgcagttctcttgggaatccaggagagtaaagactcaagatcgaaagaagaacatcatgaaaaataaatgaactttgcttagtggattgactcctttgctgaagtcagttattcatcaagaatgcaattagactaattgtgaataaatgattgaatgaagatataataaataaaagctataattatagataactcttattagaattttctttagcaatattcccaccccccaccccttgttttgctcttaatgtttttttcctttggtggggatagtatacactgtactaagaaattgtcattcaataaatacgttttgagtgctgtcta

SEQ ID NO: 26004 - DNA, 1152 bp, Homo sapiens
gcgcgcttgcggaggggaggtcaaaggtcagaggtaaagaagtcatggcggcgctgtgtcggacccgtgctgtggctgccgagagccattttctgcgagtgtttctcttcttcaggccctttcggggtgtaggcactgagagtggatccgaaagtggtagttccaatgccaaggagcctaagacgcgcgcaggcggtttcgcgagcgcgttggagcggcactcggagcttctacagaaggtggagcccctacagaagagatggggttttgccatgttgcccaggctggtcttgaactcctgggttcaagtgatcctcctgcgttggcctcccaaagtgctgggattacagatgacagatggttctccaaaaaatgtggaatcctttgcatctatgctgagacattctcctcttacacagatgggacctgcaaaggataaactggtcattggacggatctttcatattgtggagaatgatctgtacatagattttggtggaaagtttcattgtgtatgtagaagaccagaagtggatggagagagtcccatttcgtggtatgctgtttggaggagattttcacaagtgatgataacctgtttttcttccaactctgactttggaaaacatcgtaaaagataaagaagttgtaatacaacatggatgaaccctgaaaacattatgccaaatgaaagaagccattcacaaaagatcatatattgaaataccagaaaggaaccagggtccggttgcggctattagatcttgaacttacgtctaggttcctgggagcaacaacagatacaactgtactagaggctaatgcagttctcttgggaatccaggagagtaaagactcaagatcgaaagaagaacatcatgaaaaataaatgaactttgcttagtggattgactcctttgctgaagtcagttattcatcaagaatgcaattagactaattgtgaataaatgattgaatgaagatataataaataaaagctataattatagataactcttattagaattttctttagcaatattcccaccccccaccccttgttttgctcttaatgtttttttcctttggtggggatagtatacactgtactaagaaattgtcattcaataaatacgttttgagtgctgtcta

SEQ ID NO: 26005 - DNA, 801 bp, Homo sapiens
tgggattagtgaactggctagttagttaatctatgaaccagaaccaggtcttcatgacactaaatatgcttgtgccttgatcctggacttccagcctctagaactatgagaaagaagtttctgctgtttataagataccctcatttatggtgttttgttattcagatcgaacagactaggaaatagtatggagtcccatttcgtggtatgctgtttggaggagattttcacaagtgatgataacctgtttttcttccaactctgactttggaaaacatcgtaaaagataaagaagttgtaatacaacatggatgaaccctgaaaacattatgccaaatgaaagaagccattcacaaaagatcatatattgaaataccagaaaggaaccagggtccggttgcggctattagatcttgaacttacgtctaggttcctgggagcaacaacagatacaactgtactagaggctaatgcagttctcttgggaatccaggagagtaaagactcaagatcgaaagaagaacatcatgaaaaataaatgaactttgcttagtggattgactcctttgctgaagtcagttattcatcaagaatgcaattagactaattgtgaataaatgattgaatgaagatataataaataaaagctataattatagataactcttattagaattttctttagcaatattcccaccccccaccccttgttttgctcttaatgtttttttcctttggtggggatagtatacactgtactaagaaattgtcattcaataaatacgttttgagtgctgtcta

SEQ ID NO: 26006 - DNA, 622 bp, Homo sapiens
tgggattagtgaactggctagttagttaatctatgaaccagaaccaggtcttcatgacactaaatatgcttgtgccttgatcctggacttccagcctctagaactatgagaaagaagtttctgctgtttataagataccctcatttatggtgttttgttattcagatcgaacagactaggaaatagtatggaaataccagaaaggaaccagggtccggttgcggctattagatcttgaacttacgtctaggttcctgggagcaacaacagatacaactgtactagaggctaatgcagttctcttgggaatccaggagagtaaagactcaagatcgaaagaagaacatcatgaaaaataaatgaactttgcttagtggattgactcctttgctgaagtcagttattcatcaagaatgcaattagactaattgtgaataaatgattgaatgaagatataataaataaaagctataattatagataactcttattagaattttctttagcaatattcccaccccccaccccttgttttgctcttaatgtttttttcctttggtggggatagtatacactgtactaagaaattgtcattcaataaatacgttttgagtgctgtcta

SEQ ID NO: 26007 - DNA, 477 bp, Homo sapiens
  misc_feature (38)..(38): n is a, c, g, or t
gggggacccgttctggccagcgggtttggttttttccngatgctgggtgaatcagctacgttacagggtccggttgcggctattagatcttgaacttacgtctaggttcctgggagcaacaacagatacaactgtactagaggctaatgcagttctcttgggaatccaggagagtaaagactcaagatcgaaagaagaacatcatgaaaaataaatgaactttgcttagtggattgactcctttgctgaagtcagttattcatcaagaatgcaattagactaattgtgaataaatgattgaatgaagatataataaataaaagctataattatagataactcttattagaattttctttagcaatattcccaccccccaccccttgttttgctcttaatgtttttttcctttggtggggatagtatacactgtactaagaaattgtcattcaataaatacgttttgagtgctgtcta

SEQ ID NO: 26008 - DNA, 470 bp, Homo sapiens
tggttcccgtacgccactttagcaggcccccgaacccttagagtacacaaggaccttagggtccggttgcggctattagatcttgaacttacgtctaggttcctgggagcaacaacagatacaactgtactagaggctaatgcagttctcttgggaatccaggagagtaaagactcaagatcgaaagaagaacatcatgaaaaataaatgaactttgcttagtggattgactcctttgctgaagtcagttattcatcaagaatgcaattagactaattgtgaataaatgattgaatgaagatataataaataaaagctataattatagataactcttattagaattttctttagcaatattcccaccccccaccccttgttttgctcttaatgtttttttcctttggtggggatagtatacactgtactaagaaattgtcattcaataaatacgttttgagtgctgtcta

SEQ ID NO: 26009 - DNA, 896 bp, Homo sapiens
gcgcgcttgcggaggggaggtcaaaggtcagaggtaaagaagtcatggcggcgctgtgtcggacccgtgctgtggctgccgagagccattttctgcgagtgtttctcttcttcaggccctttcggggtgtaggcactgagagtggatccgaaagtggtagttccaatgccaaggagcctaagacgcgcgcaggcggtttcgcgagcgcgttggagcggcactcggagcttctacagaaggtggagcccctacagaagggttctccaaaaaatgtggaatcctttgcatctatgctgagacattctcctcttacacagatgggacctgcaaaggataaactggtcattggacggatctttcatattgtggagaatgatctgtacatagattttggtggaaagtttcattgtgtatgtagaagaccagaagtggatggagagagtcccatttcgtggtatgctgtttggaggagattttcacaagtgatgataacctgtttttcttccaactctgactttggaaaacatcgtaaaagataaagaagttgtaatacaacatggatgaaccctgaaaacattatgccaaatgaaagaagccattcacaaaagatcatatattgtatgattccatttatatgaaatgttcagaatagacaaatccacagagacagaaagtagattagtcatccccagagtctagaataggggagggggagagattgctaatgagtacagggtttcttttttggggtgatgaaaatgttctaaaattaggttatggtaaaagctgtacagctctgagaatatattcaaagtcactgaattatacactttgggtagattttatgatatgtgaattatatctcaataaagctgttaaagttttagtataccact

SEQ ID NO: 26010 - DNA, 871 bp, Homo sapiens
gcgcgcttgcggaggggaggtcaaaggtcagaggtaaagaagtcatggcggcgctgtgtcggacccgtgctgtggctgccgagagccattttctgcgagtgtttctcttcttcaggccctttcggggtgtaggcactgagagtggatccgaaagtggtagttccaatgccaaggagcctaagacgcgcgcaggcggtttcgcgagcgcgttggagcggcactcggagcttctacagaaggtggagcccctacagaagggttctccaaaaaatgtggaatcctttgcatctatgctgagacattctcctcttacacagatgggacctgcaaaggataaactggtcattggacggatctttcatattgtggagaatgatctgtacatagattttggtggaaagtttcattgtgtatgtagaagaccagaagtggatggagagaaataccagaaaggaaccagggtccggttgcggctattagatcttgaacttacgtctaggttcctgggagcaacaacagatacaactgtactagaggctaatgcagttctcttgggaatccaggagagtaaagactcaagatcgaaagaagaacatcatgaaaaataaatgaactttgcttagtggattgactcctttgctgaagtcagttattcatcaagaatgcaattagactaattgtgaataaatgattgaatgaagatataataaataaaagctataattatagataactcttattagaattttctttagcaatattcccaccccccaccccttgttttgctcttaatgtttttttcctttggtggggatagtatacactgtactaagaaattgtcattcaataaatacgttttgagtgctgtcta

SEQ ID NO: 26011 - DNA, 1277 bp, Homo sapiens
  misc_feature (939)..(939): n is a, c, g, or t
  misc_feature (1053)..(1053): n is a, c, g, or t
  misc_feature (1084)..(1084): n is a, c, g, or t
  misc_feature (1168)..(1168): n is a, c, g, or t
gcgcgcttgcggaggggaggtcaaaggtcagaggtaaagaagtcatggcggcgctgtgtcggacccgtgctgtggctgccgagagccattttctgcgagtgtttctcttcttcaggccctttcggggtgtaggcactgagagtggatccgaaagtggtagttccaatgccaaggagcctaagacgcgcgcaggcggtttcgcgagcgcgttggagcggcactcggagcttctacagaaggtggagcccctacagaagggttctccaaaaaatgtggaatcctttgcatctatgctgagacattctcctcttacacagatgggacctgcaaaggataaactggtcattggacggatctttcatattgtggagaatgatctgtacatagattttggtggaaagtttcattgtgtatgtagaagaccagaagtggatggagagaaataccagaaaggaaccagggtccggttgcggctattagatcttgaacttacgtctaggttcctgggagcaacaacagatacaactgtactagaggctaatgcagttctcttgggaatccaggagagtaaagactcaagatcgaaagaagaacatcatgaaaaataaatgaactttgcttagtggattgactcctttgctgaagtcagttattcatcaagaatgcaattagactaattgtgaataaatgattgaatgaagatataataaataaaagctataattatagataactcttattagaattttctttagcaatattcccaccccccaccccttgttttgctcttaatgtttttttcctttggtggggatagtatacactgtactaagaaattgtcattcaataaatacgttttgagtgctgtctaaaaaaaaagcaaaaatattataactgactttagcgatcaaggatatacacgtacaaacgtcaacgggntatggccgatctgtggccgcgccctcttgcgcccccgtcgctgggtggggggttgttggctggctcgcccctgcctgacggaccccacgtcgcttccacacgctcggaacgtcntgtggccgcgacgtttccactagtgtgatcnctcggcgggccacacgccctgaagggagtccggggaatctctggaactagtagtactcagagggcccagtcctcgagagtggcntcaaggtggggtgggcggataccgtctcgttggccccctctaatgttttaaggacccacacgccacggcccggggaccctcgagtgagggggttaagggcggatacttg

SEQ ID NO: 26012 - DNA, 870 bp, Homo sapiens
tcgggaataggggcggagcctggcttaggaaggggagctgaggtccggggcccagttttccggagttgcggtgcgttgtggctcagccctcggcccctagaatctgtgcttggtgtttttcttcctttcgttgtccttttgtgtggcatttgcgtactgggccgggtctgtccacactgcgcttgttttcctgggattgaatgctggtgggaagagatggggttttgccatgttgcccaggctggtcttgaactcctgggttcaagtgatcctcctgcgttggcctcccaaagtgctgggattacagatgacagatatgggacctgcaaaggataaactggtcattggacggatctttcatattgtggagaatgatctgtacatagattttggtggaaagtttcattgtgtatgtagaagaccagaagtggatggagagaaataccagaaaggaaccagggtccggttgcggctattagatcttgaacttacgtctaggttcctgggagcaacaacagatacaactgtactagaggctaatgcagttctcttgggaatccaggagagtaaagactcaagatcgaaagaagaacatcatgaaaaataaatgaactttgcttagtggattgactcctttgctgaagtcagttattcatcaagaatgcaattagactaattgtgaataaatgattgaatgaagatataataaataaaagctataattatagataactcttattagaattttctttagcaatattcccaccccccaccccttgttttgctcttaatgtttttttcctttggtggggatagtatacactgtactaagaaattgtcattcaataaatacgttttgagtgctgtcta

SEQ ID NO: 26013 - DNA, 689 bp, Homo sapiens
gcgcgcttgcggaggggaggtcaaaggtcagaggtaaagaagtcatggcggcgctgtgtcggacccgtgctgtggctgccgagagccattttctgcgagtgtttctcttcttcaggccctttcggggtgtaggcactgagagtggatccgaaagtggtagttccaatgccaaggagcctaagacgcgcgcaggcggtttcgcgagcgcgttggagcggcactcggagcttctacagaaggtggagcccctacagaaggaaataccagaaaggaaccagggtccggttgcggctattagatcttgaacttacgtctaggttcctgggagcaacaacagatacaactgtactagaggctaatgcagttctcttgggaatccaggagagtaaagactcaagatcgaaagaagaacatcatgaaaaataaatgaactttgcttagtggattgactcctttgctgaagtcagttattcatcaagaatgcaattagactaattgtgaataaatgattgaatgaagatataataaataaaagctataattatagataactcttattagaattttctttagcaatattcccaccccccaccccttgttttgctcttaatgtttttttcctttggtggggatagtatacactgtactaagaaattgtcattcaataaatacgttttgagtgctgtcta

SEQ ID NO: 26014 - DNA, 1222 bp, Homo sapiens
  misc_feature (884)..(884): n is a, c, g, or t
  misc_feature (998)..(998): n is a, c, g, or t
  misc_feature (1029)..(1029): n is a, c, g, or t
  misc_feature (1113)..(1113): n is a, c, g, or t
gcgcgcttgcggaggggaggtcaaaggtcagaggtaaagaagtcatggcggcgctgtgtcggacccgtgctgtggctgccgagagccattttctgcgagtgtttctcttcttcaggccctttcggggtgtaggcactgagagtggatccgaaagtggtagttccaatgccaaggagcctaagacgcgcgcaggcggtttcgcgagcgcgttggagcggcactcggagcttctacagaaggtggagcccctacagaagggttctccaaaaaatgtggaatcctttgcatctatgctgagacattctcctcttacacagatgggacctgcaaaggataaactggtcattggacggatctttcatattgtggagaatgatctgtacatagattttggtggaaagtttcattgtgtatgtagaagaccagaagtggatggagagaaataccagaaaggaaccagggtccggttgcggctattagatcttgaacttacgtctaggttcctgggagcaacaacagatacaactgtactagaggctaatgcagttctcttgggaatccaggagagtaaagactcaagatcgaaagaagaacatcatgaaaaataaatgaactttgcttagtggattgactcctttgctgaagtcagttattcatcaagaatgcaattagactaattgtgaataaatgattgaatgaagatataataaatcccccaccccttgttttgctcttaatgtttttttcctttggtggggatagtatacactgtactaagaaattgtcattcaataaatacgttttgagtgctgtctaaaaaaaaagcaaaaatattataactgactttagcgatcaaggatatacacgtacaaacgtcaacgggntatggccgatctgtggccgcgccctcttgcgcccccgtcgctgggtggggggttgttggctggctcgcccctgcctgacggaccccacgtcgcttccacacgctcggaacgtcntgtggccgcgacgtttccactagtgtgatcnctcggcgggccacacgccctgaagggagtccggggaatctctggaactagtagtactcagagggcccagtcctcgagagtggcntcaaggtggggtgggcggataccgtctcgttggccccctctaatgttttaaggacccacacgccacggcccggggaccctcgagtgagggggttaagggcggatacttg

SEQ ID NO: 26015 - DNA, 542 bp, Homo sapiens
agatttaaaattctggctcataatgtccttgattcaatgttaaaccattttgcctaaatggcagcatgttctaaatgtgagcgcgctcagcttttcaagctgctcccgagtgacagaaattgacaagctgtcattcaagacctttcggtggctgcctggggctctgtttgaattgtatctgtctgatactttaccatggagagtgaaaaatttgatcacatgccatgcttttaattttctaaagcaaatatgttggaaggagccaattaatgcaaagatggactgctggtctcatgcaactgatttaggggaagggtttgcctaaattaataaaagatctgaattatagatcttaacaaatacatagaatgtaaaggcttaaaaggaaactgagcagcagcaggcctggggttggcttttaagtatctatatttaactaatagacatgaatgttttgatttgatattagaaatgctagtgctggagtctctgagcctactctggctcgagaggatgccctatctaaaaaacaaaaaacaaaa

SEQ ID NO: 26016 - DNA, 317 bp, Homo sapiens
tactctaaagaacgtttatagtcatcaacttgttccccctttcccttgcaattccaattttttaaaaaatcctcatatataggggtgattttcagaatgatagagaacagagccaaaatgatttggccacgtaaggagtgggtttcctacttaatgtccaagggacagacctaagcctgcgaaactcagcgtggtgatagagacctgtgaggcaggtaactcgggacccttagagataaagaagaatctggataaaagggctatgagacttattttagaaattgcctaatgacagattcagggttttgaataggaaa

SEQ ID NO: 26017 - DNA, 414 bp, Homo sapiens
ctgggtatgttctgggacccaagtccattctccctgtagcccctgctccccagtcctgaagaccctctcaggctcttcccactttgcactgccagaagcccctgtgggctcacagctcttgccctcttctctcttaagtgcaccagcattcaagctcctccctgggctgctgggaggacagattgcttcataaattcttaagaacgtatttggaactaacagcttaatcattataatgcattattcaatcaaccaacagtgttttttggagggaaaaaaatacaccatgaaatatatcttcattttaagtacatctgttgtttcttgaaagccatcagctgtcagtgaatcatcaattttgtttcgttgtgtggctaagactatttgttctaattaaagaccatgcacgaatct

SEQ ID NO: 26018 - DNA, 480 bp, Homo sapiens
acacacctgtaaccccagctacttgggaggttgaggcagaaggattacttgaaccaggagcttgacagttcaaaagtttgagtccagcctgggcaacatagtaagactgaatctctgaaggaaaaaaaaagaaagatgtggacatataccattttacgatctcttagcctccatttcccttcttttgggactggtactctgtgtttcctttgaagatcaaataacccttgcttcagcaacattgattcgatcagcgtgaacacataacacttgactctttgagaatcaagcttggaactttcgtgtaggcttttgttcaaactgttgagagagagaagctctcttaagcccatgggtgtgagtctgaagttaagggctaccaccataaggaaaaaaattatgtataaattttaaaccagcagaagataattcagcctattcaatggaaagcagaaatggagattaaaaataaaaaaagaa

SEQ ID NO: 26019 - DNA, 267 bp, Homo sapiens
gtttaaagggggtagattaagaaggtatttgtactatgtacgttgaataaacagagtgtacaaaggcagagaaaagaaaaatgtgaagtatggagttgtacaaatggcaagtcgactctttcggatagagcggattataggaacgagagatgggaggacagggtagggcagctggggctttgaaagcagtccgagggctcaggacttggacatctacaatagcatcgaggcagccaccagcgctgggcatgagcataaatgccccct

SEQ ID NO: 26020 - DNA, 475 bp, Homo sapiens
aaactgatttctagttgactttggctattactaaattgtgacatgcatgcacttctttttaatttaacagttgttttctgctgttttctcagtttgaaagtagtaattatgaataagaattcctagaaatattcttcttccataatgatatgtcacagatgtttgagtgctacacacacactcctctccatttttaagtcaatttagtggagataaaatgtagataatagctgtgtgttgtaatgactctgggcccactccccagaggctctgtatttccataagttatgggacccctctgatctttctgaaatggccaccatcagatcattgagacttgacatgcagtttaaaatgtgtgtttctgagatttctatatatgatttggacacagaataacttgtgctgtttccaaaaccacattctttgtcctcttatagaacccaatgaaaggaggaagctgtgccttaaatgt

SEQ ID NO: 26021 - DNA, 570 bp, Homo sapiens
gtctcaggaatggagagtccaaattagcctgaaaaacataatctcttccgcttcctaaggtttcaggtgcaaattcgttgtgtttgagcagccttatgtgcagggcgaaagtgcccatccctctatcaagagtggagactgcattcctgtcctctgagcttacggagcatgacattttctgtctggaagcctgtacaggttgctcgccagcctgcttttacaatggaagtgcttttacaataagtttacttccttgggtcatcatgattctaaattccaggtagagagagttgcttaactattcctctgcttgatacatttgctggaggaggaaatcgctattttgtgattcagaaatcagctcaggaattttagccctgatagtgatacataatttcgggaaaagatttgtgaatcccttagtcagaaatcagtctccaaagtccggctcagtggctcacacttgtaatcccagcgcttgggaggccaaggtgggaggatcacttgagactaggggtttaagaccagtctgggcaatatagggagaccctgtctgtacacaaaaaaaaa

SEQ ID NO: 26022 - DNA, 430 bp, Homo sapiens
gctgcctttgtacacagcccttaacccctggccttctgtttccttacctgttgacttggggatattaattcccgacttgcatgttccacagggtcgttacatgaactgactcatgcaaaaagcacacccatactgtaagcagtacaaatgaaatgtgctgttatgattatggttattcctgaagcgttcctgggatgaaagattcagcattagggcactaaaggtctaagtcaattaactaactggtaataccagtttgttccagaaataattggaggtatctatcgaagaagcagacatcaaggttaaagaaaactaaactgagaaaagtgatgctgtacaataatatgcatatagttaacaataatgtactctccacttcaaaatgtgttaagagggtagattttacgttatgtgttttttaccacag

SEQ ID NO: 26023 - DNA, 354 bp, Homo sapiens
cgcggccgcgtcgacggacattttacaggttaatgactgtgggagaggagaataaaatcaaaactgcaagaacccatttttgtcttcataagcattgcattttaaaatacgagggcttgaagacttctcagaagagacactcactactggagttaaagttatatgaagtccctgagcccttaatcatccaagactggacctaagcagtcctcttcgtttgtagtctctttcaatatctgcttatcaaggacaacgagaatatcttagtctactaattaatcttttttatcaccatagtctaccaagaaagaaagctgataagataataaagatgattcattcctcagagtagga

SEQ ID NO: 26024 - DNA, 1121 bp, Homo sapiens
  misc_feature (1081)..(1081): n is a, c, g, or t
  misc_feature (1117)..(1117): n is a, c, g, or t
ggcaactaaagtctaggaaagaagcaaaatagcttgcctaaagtcacacataagtaaatggtggctcacgcctgtaaacccagcactttgggaggctgaggcaagtggatcatttgaggtcaggagttcaagaccagcctggccaacatggtgaaagcccacctctactaaaaatacaaaaattagctgggcatggtggcatgtgcctgtaatcccagctactcgggaggctgagacaggagaattgcttgaaccagggaggtggaggttgcagtgagccaagatcgctctactgcattccagcgtgggcaacagagcaagactccatcttaaaaaaaaaaaaaaaaaaaagctaaagctgggatttaaacctgattatgttggctccagagcctatgctctagaccagtggttctaaactttaatggtcaataggaaccgcttgaggatcttgttaaaacgcaaatattggtagtatagatatcaggtaaggcctggatcctatagtcttaacaggcccccaggtgatgttgatggtgctggtcattacatactacagttcacatcttcccttttctcctaaccgtatttattttgcagtcagaaactacctttcccatgctgcctgtgactgctttatagtctcaaatgttcccaacatgctcttccttaaggattagactcaaactttttcctcaaaaagcttatcctgcccctgtctttccctctaggataagacagacatccctgcctctgctcccctaccacttagtgtacaccttgttacagagctcagaacactgaattatggccatttatttgaaaatcttcctgggccgggcatggtggctcatgcctgtattcccagtactttgggaggccgaggtgggctgatcacttgaggtcaggagttcaagaccagcttggccaacatggtgaaatcccgtctatactaaagatagaaaaattagccggtcatggtgttgtgcatctgtagtcctaggtactctactcgagaggctgaggcaggagaatctcttgaacccaggaggtggaggttgcagtgagctgagattgcgcnactgcacttcagcctgggcgacagagcaagactctntctc

SEQ ID NO: 26025 - DNA, 350 bp, Homo sapiens
ctagctgatggaacaggggatatatggagtccagactccaaaagattaaaatatattaagaaactatgcattatcaaagaaaggaaactgtgcattgtggtgaatcttaagtgaaaaggtgggtttaataaagcatgtgggtattcgttttcaaacaacagggtatttaacattttatttgaggctgggtgcagtggctcatgcctgtaattccagcactttgggaggccaaggtgggaggatcacttgaggccaggaatttgagaccagtctgggcaaaataaggaggccctgtttctaaaacaaacaaaaattagccgggtatggtggtgcatgcctgtggttccagc

SEQ ID NO: 26026 - DNA, 359 bp, Homo sapiens
gaggccgacttgaggagcttctgggcccggagaggccgccggaagggaaaaactgggccgggaaaggccgttgtgaggaatgagccccatgggcctgaggaggccactggcaggcgggagctgggcctgccgaagcggcggagaggccggagctttggactcgggaggccgcaggcgagagcgagctgggcgtggagagtccgctgtgaggcagaggctgggcctgtgcaagctttcgggaggcaggaggccaggcctgcagaggccgactggaggtcaagttcggggcctgcagaggccgcggaaagtcagaagcggggcctgggaaggccgccgggaggcatgagctgggctgggct

SEQ ID NO: 26027 - DNA, 511 bp, Homo sapiens
aggaataagaaaaataggaagatgagaattgagctcaggcacataacctaggcagagaaatgtcaccaaactataaaatatataccctgcaatccagctggcagactacataagtctccttgctcaagtactgaaacacagaggcccatgtgctgtctaacacagtgtcaccaaacctttttgatcatgcactctatcagtgaaccaattttaagctctcccccaccatatatgtttattcatttataagttgcaaacatgcactaatgtactattgtgtatattataaaatatctaaaatataaatttttaaaagctgagagaccaataaatatcaaggggtcctccaatagttcctccttttttttttttttgagacttctttgctggtctgtctgtgggactgggtttgaaagaggccattctgaaccaaaagaccatatagacaaggtaatcctaagcaaaacagaacaaagttggaggcatcatgctacctgacttcaaactatac

SEQ ID NO: 26028 - DNA, 315 bp, Homo sapiens
gaaaaatgaactaaagaacttcagaacatagagtccctgaacagtttggttatgctaccatgattcagctttaaaagagcgtccaaaacagaatcctacctgtaactgaaattttttactgttatttaacaaaatatgaaacattgttcatgtacgttatttaatgtgaaaaaaataaaaataaatggaaaatgtcctttctgttattgaccttaataaatttatgtagttttaaaaacgaagaggtttaggagaaaatatcaatgccagttttgaagactcacaatgagtctagttagaatcaaaagtttcaaa

SEQ ID NO: 26029 - DNA, 464 bp, Homo sapiens
aacattttaaaaaataaaattatagcactgtctacctgagtaaaactacaggatatgctttttatactttagaatttcttttttattatatatatcaagaaatatatatcaatatcttcattctctactaggcatattttaaagaaataaaaacagctgtatttatttaatagaccagtcatatttacttagacaatttcttctcgattgttattctttgttgtcaagctgtgtagctaattttaaaaacatgtctgagcacaaataaaaaattttgtatatgtagatttgtaacatgtagattaacaagttaatcatttagtaatgattaaacgttaccaaacattaacaattgttttttaaaacaaggataaaaacaaatgtcaatcttagtattcattgggaaagctagttaaaatggtttcccaaaaataaagataaatattgcttttactggacttttt

SEQ ID NO: 26030 - DNA, 476 bp, Homo sapiens
cagacactgaatctgctggtgtcctgatcttgaatataccagcctccagaactagtcttgctcttgtcatccaggctggagtgcaatggtgccatttcagctcgctgcaacctccacctcctgggttcaagtgattctcctgcatcagcctcccgagtagctgggattacaggcgcccaccaccatgcccagctaatttttgtatttttagcagagacagggtttcaccatgttgtccaggctggtctcaaactcctgacctgaggtgatccacccgcttcagtctcccaaagtactgggattacaggcgtaagccaccacgcccggccgaaatttatgttttattgtacataatatttattttttggatgattggagaacaatgatgccagtttgatggactcttcatatgaaatgccccaaaacacagtatcattaccttaaaggttagtagagatatgcatgcatttacattg

SEQ ID NO: 26031 - DNA, 193 bp, Homo sapiens
cttacttgtaaccagaagaaaactaaagtttaatggcaagttttcaattgcatttaaaatacccccaggccaggcttagtggctcacgcctgtaattctaacactttgggaggctgaagtgggagaatcacttgagcccaggagttcaagaccagcctgggcaacttagtgagacgctgtctctattttatta

SEQ ID NO: 26032 - DNA, 506 bp, Homo sapiens
tgtcatctccttgtaccctccccagctgtttccagtggcagtcagcctcatccttctagaagggtacccaaagaagtgatatgatttgcctcttactagcatggacatttggctcactttccccatctgtaatttggggatgacaatagtgttcacctgacatagaggtgttatgagcaccaagtggcctaaatgccaatgacagtctcctctgatactaggggtagtactgtcacaaggccctggggtaacccggtccctgtgagcctccgccaaccctccctggttctctgagtcatggcgcactgtccttcagtaccatggctcctggctccagggttgggggttggttctgaaatccagtttgcccacattttccctcatctgactccaactcatccttcagttcttggctcagccttagttccttgggaaagcccccggagcacctggcttggtccattcccacacgtgcccagtacctgtcctgtccttcgaggctatct

SEQ ID NO: 26033 - DNA, 555 bp, Homo sapiens
tctcaagtaagactagtaaatgagccactatgtcaaattgacagacattgctcaaggaaaatatgctttctaaacaaaagctgaagaaagaaatgacacgaaccctgagcagagcccagccggcagccccgtgaccttctatatcaatgaggtggccacaggactgaactggctcctgggaaagcaggagacagacacctcaacaggcaccagaaccaggggatggacaagtctcaggtttactgatgactcttgactctcccagtgatcaacagccaccaagagcagtcacttctgatctgaagtgtaagaatcccctgatcacctcctgaagcaaataggacaatagacatgatgtcttaagtcctcaaataggatataaacacttacctgtcctgtcctgagcaaaggagagttttagatttaggaaaaccaacactggagacacatttctcacaatcaactcagaggcagacagtaacaaccatccctactgctgggcactaacctggcatatctccctcagcccaacgcagtcatgcaggagaagccacg

SEQ ID NO: 26034 - DNA, 247 bp, Homo sapiens
ctcatgccatgatatttttcttccataagaatgttttcatttatttcgtttcctttttccattttgtatacgttttcctttttttttttcagggcccttttgtcaaattctctcaacctcagaagggatcacatgatcccatttcctcattttttaattctaaaaatatcgtgtttcctactttgatttattttgctttttaaactgtgacttttatttatatgtgcacattctttgggagggtgtt

SEQ ID NO: 26035 - DNA, 190 bp, Homo sapiens
tttaatcaattaaactaccactgtgtttaccaacaatcctcaaactttaatgtgcatagaagttatgtgcagaacttcattttaaaatgcagatatctaactcctgcacacatagattctaattcagtaggctatgcagtctgtgactgtgcatctaacaaggacaccagtgtttctcatttggagcaaa

SEQ ID NO: 26036 - DNA, 595 bp, Homo sapiens
aaccctaaatagaggaaaacataatcatgccattatgcccgctgctggagaggaatgtccctatgttaagataggaaaggagaagaaaacgagctaagataggaagaaaaggactttttaattcggtgccggtataaattgtttctcttttatctcaaggcaccacagacccaaggctgaataaggcctgaattttgatgcctttctctttcatgtagctgtaaatccttttatcttactaccaggagcattttctaagctggctggccaaattaagtgtgtattctaaggcgaagaaatggaaaggtaactaacccctcacccacccagcactatgcccaggatcgtcctaacccccactctatcagtccttaactcagtaatttatagacccaacaaagctaagacccacttccttcttttgccaaatctcagtttacacgctgtcccaaaggagacattttagaaccatatcggcaaaagtcagtgttttctactaatgtgtttcatgaccccatgctttacaattgattattgatttaaaaaatctttaagtttggttaaattagcaacaataaaccttgtaaattccctg

SEQ ID NO: 26037 - DNA, 2406 bp, Homo sapiens
attgcaaccggaaccattttttttcctgttaccatctaagaactctgtggtttattattaatattataattattatttggcaataatgggggtgggaaccaagaaaaatatttattttgtggatctttgaaaaggtaatacaagacttcttttgatagtatagaatgaaggggaaataacacataccctaacttagctgtgtggacatggtacacatccagaaggtaaagaaatacattttctttttctcaaatatgccatcatatgggatgggtaggttccagttgaaagagggtggtagaaatctattcacaattcagcttctatgaccaaaatgagttgtaaattctctggtgcaagataaaaggtcttgggaaaacaaaacaaaacaaaacaaacctcccttccccagcagggctgctagcttgctttctgcattttcaaaatgataatttacaatggaaggacaagaatgtcatattctcaaggaaaaaaggtatatcacatgtctcattctcctcaaatattccatttgcagacagaccgtcatattctaatagctcatgaaatttgggcagcagggaggaaagtccccagaaattaaaaaatttaaaactcttatgtcaagatgttgatttgaagctgttataagaattaggattccagattgtaaaaagatccccaaatgattctggacactagatttttttgtttggggaggttggcttgaacataaatgaaaatatcctgttattttcttagggatacttggttagtaaattataatagtaaaaataatacatgaatcccattcacaggttctcagcccaagcaacaaggtaattgcgtgccattcagcactgcaccagagcagacaacctatttgaggaaaaacagtgaaatccaccttcctcttcacactgagccctctctgattcctccgtgttgtgatgtgatgctggccacgtttccaaacggcagctccactgggtcccctttggttgtaggacaggaaatgaaacattaggagctctgcttggaaaacagttcactacttagggatttttgtttcctaaaacttttattttgaggagcagtagttttctatgttttaatgacagaacttggctaatggaattcacagaggtgttgcagcgtatcactgttatgatcctgtgtttagattatccactcatgcttctcctattgtactgcaggtgtaccttaaaactgttcccagtgtacttgaacagttgcatttataaggggggaaatgtggtttaatggtgcctgatatctcaaagtcttttgtacataacatatatatatatatacatatatataaatataaatataaatatatctcattgcagccagtgatttagatttacagtttactctggggttatttctctgtctagagcattgttgtccttcactgcagtccagttgggattattccaaaagttttttgagtcttgagcttgggctgtggccctgctgtgatcataccttgagcacgacgaagcaaccttgtttctgaggaagcttgagttctgactcactgaaatgcgtgttgggttgaagatatcttttttcttttctgcctcacccctttgtctccaacctccatttctgttcactttgtggagagggcattacttgttcgttatagacatggacgttaagagatattcaaaactcagaagcatcagcaatgtttctcttttcttagttcattctgcagaatggaaacccatgcctattagaaatgacagtacttattaattgagtccctaaggaatattcagcccactacatagatagctttttttttttttttttaataaggacacctctttccaaacagtgccatcaaatatgttcttatctcagacttacgttgttttaaaagtttggaaagatacacatctttcataccccccttaggcaggttggctttcatatcacctcagccaactgtggctcttaatttattgcataatgatattcacatcccctcagttgcagtgaattgtgagcaaaagatcttgaaagcaaaaagcactaattagtttaaaatgtcacttttttggtttttattatacaaaaaccatgaagtactttttttatttgctaaatcagattgttcctttttagtgactcatgtttatgaagagagttgagtttaacaatcctagcttttaaaagaaactatttaatgtaaaatattctacatgtcattcagatattatgtatatcttctagcctttattctgtacttttaatgtacatatttctgtcttgcgtgatttgtatatttcactggtttaaaaaacaaacatcgaaaggcttatgccaaatggaagatagaatataaaataaaacgttacttgtatattggta

SEQ ID NO: 26038 - DNA, 4098 bp, Homo sapiens
attgcaaccggaaccattttttttcctgttaccatctaagaactctgtggtttattattaatattataattattatttggcaataatgggggtgggaaccaagaaaaatatttattttgtggatctttgaaaaggtaatacaagacttcttttgatagtatagaatgaaggggaaataacacataccctaacttagctgtgtggacatggtacacatccagaaggtaaagaaatacattttctttttctcaaatatgccatcatatgggatgggtaggttccagttgaaagagggtggtagaaatctattcacaattcagcttctatgaccaaaatgagttgtaaattctctggtgcaagataaaaggtcttgggaaaacaaaacaaaacaaaacaaacctcccttccccagcagggctgctagcttgctttctgcattttcaaaatgataatttacaatggaaggacaagaatgtcatattctcaaggaaaaaaggtatatcacatgtctcattctcctcaaatattccatttgcagacagaccgtcatattctaatagctcatgaaatttgggcagcagggaggaaagtccccagaaattaaaaaatttaaaactcttatgtcaagatgttgatttgaagctgttataagaattaggattccagattgtaaaaagatccccaaatgattctggacactagatttttttgtttggggaggttggcttgaacataaatgaaaatatcctgttattttcttagggatacttggttagtaaattataatagtaaaaataatacatgaatcccattcacaggttctcagcccaagcaacaaggtaattgcgtgccattcagcactgcaccagagcagacaacctatttgaggaaaaacagtgaaatccaccttcctcttcacactgagccctctctgattcctccgtgttgtgatgtgatgctggccacgtttccaaacggcagctccactgggtcccctttggttgtaggacaggaaatgaaacattaggagctctgcttggaaaacagttcactacttagggatttttgtttcctaaaacttttattttgaggagcagtagttttctatgttttaatgacagaacttggctaatggaattcacagaggtgttgcagcgtatcactgttatgatcctgtgtttagattatccactcatgcttctcctattgtactgcaggtgtaccttaaaactgttcccagtgtacttgaacagttgcatttataaggggggaaatgtggtttaatggtgcctgatatctcaaagtcttttgtacataacatatatatatatatacatatatataaatataaatataaatatatctcattgcagccagtgatttagatttacagtttactctggggttatttctctgtctagagcattgttgtccttcactgcagtccagttgggattattccaaaagttttttgagtcttgagcttgggctgtggccctgctgtgatcataccttgagcacgacgaagcaaccttgtttctgaggaagcttgagttctgactcactgaaatgcgtgttgggttgaagatatcttttttcttttctgcctcacccctttgtctccaacctccatttctgttcactttgtggagagggcattacttgttcgttatagacatggacgttaagagatattcaaaactcagaagcatcagcaatgtttctcttttcttagttcattctgcagaatggaaacccatgcctattagaaatgacagtacttattaattgagtccctaaggaatattcagcccactacatagatagctttttttttttttttttaataaggacacctctttccaaacagtgccatcaaatatgttcttatctcagacttacgttgttttaaaagtttggaaagatacacatctttcataccccccttaggcaggttggctttcatatcacctcagccaactgtggctcttaatttattgcataatgatattcacatcccctcagttgcagtgaattgtgagcaaaagatcttgaaagcaaaaagcactaattagtttaaaatgtcacttttttggtttttattatacaaaaaccatgaagtactttttttatttgctaaatcagattgttcctttttagtgactcatgtttatgaagagagttgagtttaacaatcctagcttttaaaagaaactatttaatgtaaaatattctacatgtcattcagatattatgtatatcttctagcctttattctgtacttttaatgtacatatttctgtcttgcgtgatttgtatatttcactggtttaaaaaacaaacatcgaaaggcttatgccaaatggaagatagaatataaaataaaacgttacttgtatattggtaagtggtttcaattgtccttcagataattcatgtggagatttttggagaaaccatgacggatagtttaggatgactacatgtcaaagtaataaaagagtggtgaattttaccaaaaccaagctatttggaagcttcaaaaggtttctatatgtaatggaacaaaaggggaattctcttttcctatatatgttccttacaaaaaaaaaaaaaaagaaatcaagcagatggcttaaagctggttataggattgctcacattcttttagcattatgcatgtaacttaattgttttagagcgtgttgctgttgtaacatcccagagaagaatgaaaactggttggaaactaaaggttcattgtgttaagtgcaattaatacaagttattgtgcttttcaaaaatgtacacggaaatctggacagtgctgcacagattgatacattagcctttgctttttctctttccggataaccttgtaacatattgaaaccttttaaggatgccaagaatgcattattccacaaaaaaacagcagaccaacatatagagtgtttaaaatagcatttctgggcaaattcaaactcttgtggttctaggactcacatctgtttcagtttttcctcagttgtatattgaccagtgttctttattgcaaaaacatatacccgatttagcagtgtcagcgtattttttcttctcatcctggagcgtattcaagatcttcccaatacaagaaaattaataaaaaatttatatataggcagcagcaaaagagccatgttcaaaatagtcattatgggctcaaatagaaagaagacttttaagttttaatccagtttatctgttgagttctgtgagctactgacctcctgagactggcactgtgtaagttttagttgcctaccctagctcttttctcgtacaattttgccaataccaagtttcaatttgtttttacaaaacattattcaagccactagaattatcaaatatgacgctatagcagagtaaatactctgattaagagaccggtactagctaactccaagagatcgttagcagcatcagtccacaaacacttagtggcccacaatatatagagagatagaaaaggtagttataacttgaagcatgtatttaatgcaaataggcacgaaggcacaggtctaaaatactacattgtcactgtaagctatacttttaaaatatttattttttttaaagtattttctagtcttttctctctctgtggaatggtgaaagagagatgccgtgttttgaaagtaagatgatgaaatgaatttttaattcaagaaacattcagaaacataggaattaaaacttagagaaatgatctaatttccctgttcacacaaactttacactttaatctgatgattggatattttattttagtgaaacatcatcttgttagctaactttaaaaaatggatgtagaatgattaaaggttggtatgatttttttttaatgtatcagtttgaacctagaatattgaattaaaatgctgtctcagtattttaaaagcaaaaaaggaatggaggaaaattgcatcttagaccatttttatatgcagtgtacaatttgctgggctagaaatgagataaagattatttatttttgttcatatcttgtacttttctattaaaatcattttatgaaatccaaaaaaaagt

SEQ ID NO: 26039 - DNA, 506 bp, Homo sapiens
aggcagccgcgagacggccttcacatacgcggtgagcgcagcaggggtggtgaacgccatgagccgggcgtgccgcgagggcgagctgtccacctgcggctgcagccgcgccgcgcgccccaaggacctgccgcgggactggctctggggcggctgcggcgacaacatcgactatggctaccgctttgccaaggagttcgtggacgcccgcgagcgggagcgcatccacgccaagggctcctacgagagtgctcgcatcctcatgaacctgcacaacaacgaggccggccgcaggacggtgtacaacctggctgatgtggcctgcaagtgccatggggtgtccggctcatgtagcctgaagacatgctggctgcagctggcagacttccgcaaggtgggtgatgccctgaaggagaagtacgacactggtttaaaaaacaaacatcgaaaggcttatgccaaatggaagatagaatataaaataaaacgttacttgtatattggta

SEQ ID NO: 26040 - DNA, 4277 bp, Homo sapiens
attgcaaccggaaccattttttttcctgttaccatctaagaactctgtggtttattattaatattataattattatttggcaataatgggggtgggaaccaagaaaaatatttattttgtggatctttgaaaaggtaatacaagacttcttttgatagtatagaatgaaggggaaataacacataccctaacttagctgtgtggacatggtacacatccagaaggtaaagaaatacattttctttttctcaaatatgccatcatatgggatgggtaggttccagttgaaagagggtggtagaaatctattcacaattcagcttctatgaccaaaatgagttgtaaattctctggtgcaagataaaaggtcttgggaaaacaaaacaaaacaaaacaaacctcccttccccagcagggctgctagcttgctttctgcattttcaaaatgataatttacaatggaaggacaagaatgtcatattctcaaggaaaaaaggtatatcacatgtctcattctcctcaaatattccatttgcagacagaccgtcatattctaatagctcatgaaatttgggcagcagggaggaaagtccccagaaattaaaaaatttaaaactcttatgtcaagatgttgatttgaagctgttataagaattaggattccagattgtaaaaagatccccaaatgattctggacactagatttttttgtttggggaggttggcttgaacataaatgaaaatatcctgttattttcttagggatacttggttagtaaattataatagtaaaaataatacatgaatcccattcacaggttctcagcccaagcaacaaggtaattgcgtgccattcagcactgcaccagagcagacaacctatttgaggaaaaacagtgaaatccaccttcctcttcacactgagccctctctgattcctccgtgttgtgatgtgatgctggccacgtttccaaacggcagctccactgggtcccctttggttgtaggacaggaaatgaaacattaggagctctgcttggaaaacagttcactacttagggatttttgtttcctaaaacttttattttgaggagcagtagttttctatgttttaatgacagaacttggctaatggaattcacagaggtgttgcagcgtatcactgttatgatcctgtgtttagattatccactcatgcttctcctattgtactgcaggtgtaccttaaaactgttcccagtgtacttgaacagttgcatttataaggggggaaatgtggtttaatggtgcctgatatctcaaagtcttttgtacataacatatatatatatatacatatatataaatataaatataaatatatctcattgcagccagtgatttagatttacagtttactctggggttatttctctgtctagagcattgttgtccttcactgcagtccagttgggattattccaaaagttttttgagtcttgagcttgggctgtggccctgctgtgatcataccttgagcacgacgaagcaaccttgtttctgaggaagcttgagttctgactcactgaaatgcgtgttgggttgaagatatcttttttcttttctgcctcacccctttgtctccaacctccatttctgttcactttgtggagagggcattacttgttcgttatagacatggacgttaagagatattcaaaactcagaagcatcagcaatgtttctcttttcttagttcattctgcagaatggaaacccatgcctattagaaatgacagtacttattaattgagtccctaaggaatattcagcccactacatagatagctttttttttttttttttaataaggacacctctttccaaacagtgccatcaaatatgttcttatctcagacttacgttgttttaaaagtttggaaagatacacatctttcataccccccttaggcaggttggctttcatatcacctcagccaactgtggctcttaatttattgcataatgatattcacatcccctcagttgcagtgaattgtgagcaaaagatcttgaaagcaaaaagcactaattagtttaaaatgtcacttttttggtttttattatacaaaaaccatgaagtactttttttatttgctaaatcagattgttcctttttagtgactcatgtttatgaagagagttgagtttaacaatcctagcttttaaaagaaactatttaatgtaaaatattctacatgtcattcagatattatgtatatcttctagcctttattctgtacttttaatgtacatatttctgtcttgcgtgatttgtatatttcactggtttaaaaaacaaacatcgaaaggcttatgccaaatggaagatagaatataaaataaaacgttacttgtatattggtaagtggtttcaattgtccttcagataattcatgtggagatttttggagaaaccatgacggatagtttaggatgactacatgtcaaagtaataaaagagtggtgaattttaccaaaaccaagctatttggaagcttcaaaaggtttctatatgtaatggaacaaaaggggaattctcttttcctatatatgttccttacaaaaaaaaaaaaaaagaaatcaagcagatggcttaaagctggttataggattgctcacattcttttagcattatgcatgtaacttaattgttttagagcgtgttgctgttgtaacatcccagagaagaatgaaaaggcacatgcttttatccgtgaccagatttttagtccaaaaaaatgtatttttttgtgtgtttaccactgcaactattgcacctctctatttgaatttactgtggaccatgtgtggtgtctctatgccctttgaaagcagtttttataaaaagaaagcccgggtctgcagagaatgaaaactggttggaaactaaaggttcattgtgttaagtgcaattaatacaagttattgtgcttttcaaaaatgtacacggaaatctggacagtgctgcacagattgatacattagcctttgctttttctctttccggataaccttgtaacatattgaaaccttttaaggatgccaagaatgcattattccacaaaaaaacagcagaccaacatatagagtgtttaaaatagcatttctgggcaaattcaaactcttgtggttctaggactcacatctgtttcagtttttcctcagttgtatattgaccagtgttctttattgcaaaaacatatacccgatttagcagtgtcagcgtattttttcttctcatcctggagcgtattcaagatcttcccaatacaagaaaattaataaaaaatttatatataggcagcagcaaaagagccatgttcaaaatagtcattatgggctcaaatagaaagaagacttttaagttttaatccagtttatctgttgagttctgtgagctactgacctcctgagactggcactgtgtaagttttagttgcctaccctagctcttttctcgtacaattttgccaataccaagtttcaatttgtttttacaaaacattattcaagccactagaattatcaaatatgacgctatagcagagtaaatactctgattaagagaccggtactagctaactccaagagatcgttagcagcatcagtccacaaacacttagtggcccacaatatatagagagatagaaaaggtagttataacttgaagcatgtatttaatgcaaataggcacgaaggcacaggtctaaaatactacattgtcactgtaagctatacttttaaaatatttattttttttaaagtattttctagtcttttctctctctgtggaatggtgaaagagagatgccgtgttttgaaagtaagatgatgaaatgaatttttaattcaagaaacattcagaaacataggaattaaaacttagagaaatgatctaatttccctgttcacacaaactttacactttaatctgatgattggatattttattttagtgaaacatcatcttgttagctaactttaaaaaatggatgtagaatgattaaaggttggtatgatttttttttaatgtatcagtttgaacctagaatattgaattaaaatgctgtctcagtattttaaaagcaaaaaaggaatggaggaaaattgcatcttagaccatttttatatgcagtgtacaatttgctgggctagaaatgagataaagattatttatttttgttcatatcttgtacttttctattaaaatcattttatgaaatccaaaaaaaagt

SEQ ID NO: 26041 - DNA, 3807 bp, Homo sapiens
attgcaaccggaaccattttttttcctgttaccatctaagaactctgtggtttattattaatattataattattatttggcaataatgggggtgggaaccaagaaaaatatttattttgtggatctttgaaaaggtaatacaagacttcttttgatagtatagaatgaaggggaaataacacataccctaacttagctgtgtggacatggtacacatccagaaggtaaagaaatacattttctttttctcaaatatgccatcatatgggatgggtaggttccagttgaaagagggtggtagaaatctattcacaattcagcttctatgaccaaaatgagttgtaaattctctggtgcaagataaaaggtcttgggaaaacaaaacaaaacaaaacaaacctcccttccccagcagggctgctagcttgctttctgcattttcaaaatgataatttacaatggaaggacaagaatgtcatattctcaaggaaaaaaggtatatcacatgtctcattctcctcaaatattccatttgcagacagaccgtcatattctaatagctcatgaaatttgggcagcagggaggaaagtccccagaaattaaaaaatttaaaactcttatgtcaagatgttgatttgaagctgttataagaattaggattccagattgtaaaaagatccccaaatgattctggacactagatttttttgtttggggaggttggcttgaacataaatgaaaatatcctgttattttcttagggatacttggttagtaaattataatagtaaaaataatacatgaatcccattcacaggttctcagcccaagcaacaaggtaattgcgtgccattcagcactgcaccagagcagacaacctatttgaggaaaaacagtgaaatccaccttcctcttcacactgagccctctctgattcctccgtgttgtgatgtgatgctggccacgtttccaaacggcagctccactgggtcccctttggttgtaggacaggaaatgaaacattaggagctctgcttggaaaacagttcactacttagggatttttgtttcctaaaacttttattttgaggagcagtagttttctatgttttaatgacagaacttggctaatggaattcacagaggtgttgcagcgtatcactgttatgatcctgtgtttagattatccactcatgcttctcctattgtactgcaggtgtaccttaaaactgttcccagtgtacttgaacagttgcatttataaggggggaaatgtggtttaatggtgcctgatatctcaaagtcttttgtacataacatatatatatatatacatatatataaatataaatataaatatatctcattgcagccagtgatttagatttacagtttactctggggttatttctctgtctagagcattgttgtccttcactgcagtccagttgggattattccaaaagttttttgagtcttgagcttgggctgtggccctgctgtgatcataccttgagcacgacgaagcaaccttgtttctgaggaagcttgagttctgactcactgaaatgcgtgttgggttgaagatatcttttttcttttctgcctcacccctttgtctccaacctccatttctgttcactttgtggagagggcattacttgttcgttatagacatggacgttaagagatattcaaaactcagaagcatcagcaatgtttctcttttcttagttcattctgcagaatggaaacccatgcctattagaaatgacagtacttattaattgagtccctaaggaatattcagcccactacatagatagctttttttttttttttttaataaggacacctctttccaaacagtgccatcaaatatgttcttatctcagacttacgttgttttaaaagtttggaaagatacacatctttcataccccccttaggcaggttggctttcatatcacctcagccaactgtggctcttaatttattgcataatgatattcacatcccctcagttgcagtgaattgtgagcaaaagatcttgaaagcaaaaagcactaattagtttaaaatgtcacttttttggtttttattatacaaaaaccatgaagtactttttttatttgctaaatcagattgttcctttttagtgactcatgtttatgaagagagttgagtttaacaatcctagcttttaaaagaaactatttaatgtaaaatattctacatgtcattcagatattatgtatatcttctagcctttattctgtacttttaatgtacatatttctgtcttgcgtgatttgtatatttcactggtttaaaaaacaaacatcgaaaggcttatgccaaatggaagatagaatataaaataaaacgttacttgtatattggtaagtggtttcaattgtccttcagataattcatgtggagatttttggagaaaccatgacggatagtttaggatgactacatgtcaaagtaataaaagagtggtgaattttaccaaaaccaagctatttggaagcttcaaaaggtttctatatgtaatggaacaaaaggggaattctcttttcctatatatgttccttacaaaaaaaaaaaaaaagaaatcaagcagatggcttaaagctggttataggattgctcacattcttttagcattatgcatgtaacttaattgttttagagcgtgttgctgttgtaacatcccagagaagaatgaaaaggcacatgcttttatccgtgaccagatttttagtccaaaaaaatgtatttttttgtgtgtttaccactgcaactattgcacctctctatttgaatttactgtggaccatgtgtggtgtctctatgccctttgaaagcagtttttataaaaagaaagcccgggtctgcagagaatgaaaactggttggaaactaaaggttcattgtgttaagtgcaattaatacaagttattgtgcttttcaaaaatgtacacggaaatctggacagtgctgcacagattgatacattagcctttgctttttctctttccggataaccttgtaacatattgaaaccttttaaggatgccaagaatgcattattccacaaaaaaacagcagaccaacatatagagtgtttaaaatagcatttctgggcaaattcaaactcttgtggttctaggactcacatctgtttcagtttttcctcagttgtatattgaccagtgttctttattgcaaaaacatatacccgatttagcagtgtcagcgtattttttcttctcatcctggagcgtattcaagatcttcccaatacaagaaaattaataaaaaatttatatataggcagcagcaaaagagccatgttcaaaatagtcattatgggctcaaatagaaagaagacttttaagttttaatccagtttatctgttgagttctgtgagctactgacctcctgagactggcactgtgtaagttttagttgcctaccctagctcttttctcgtacaattttgccaataccaagtttcaatttgtttttacaaaacattattcaagccactagaattatcaaatatgacgctatagcagagtaaatactctgattaagagaccggtactagctaactccaagagatcgttagcagcatcagtccacaaacacttagtggcccacaatatatagagagatagaaaaggtagttataacttacagtgacaatgtagtattttagacctgtgccttcgtgcctatttgcattaaatacatgcttcaagttatagtcgacgcggccgttaatttagtagtag

SEQ ID NO: 26042 - DNA, 1281 bp, Homo sapiens
  misc_feature (248)..(248): n is a, c, g, or t
tacacatgcgataagctgggcgcatactagaaggctttgtgaggatgcccatagcttgtttcttccgcgatccatggtgatgacctagtgtatggagttgtcaccaaattagcataacgcggccgcgcagagtacacacagcatcctgtgtcgtgatctagagtacctaccgatgtcctggttctcgagggtcatccatctggtatgctatactaagacggccagtgcactcgattgcgatatcatanttacggattgacctgtgtcagcgtattttttcttctcatcctggagcgtattcaagatcttcccaatacaagaaaattaataaaaaatttatatataggcagcagcaaaagagccatgttcaaaatagtcattatgggctcaaatagaaagaagacttttaagttttaatccagtttatctgttgagttctgtgagctactgacctcctgagactggcactgtgtaagttttagttgcctaccctagctcttttctcgtacaattttgccaataccaagtttcaatttgtttttacaaaacattattcaagccactagaattatcaaatatgacgctatagcagagtaaatactctgattaagagaccggtactagctaactccaagagatcgttagcagcatcagtccacaaacacttagtggcccacaatatatagagagatagaaaaggtagttataacttgaagcatgtatttaatgcaaataggcacgaaggcacaggtctaaaatactacattgtcactgtaagctatacttttaaaatatttattttttttaaagtattttctagtcttttctctctctgtggaatggtgaaagagagatgccgtgttttgaaagtaagatgatgaaatgaatttttaattcaagaaacattcagaaacataggaattaaaacttagagaaatgatctaatttccctgttcacacaaactttacactttaatctgatgattggatattttattttagtgaaacatcatcttgttagctaactttaaaaaatggatgtagaatgattaaaggttggtatgatttttttttaatgtatcagtttgaacctagaatattgaattaaaatgctgtctcagtattttaaaagcaaaaaaggaatggaggaaaattgcatcttagaccatttttatatgcagtgtacaatttgctgggctagaaatgagataaagattatttatttttgttcatatcttgtacttttctattaaaatcattttatgaaatccaaaaaaaagt

SEQ ID NO: 26043 - DNA, 2377 bp, Homo sapiens
aggcagccgcgagacggccttcacatacgcggtgagcgcagcaggggtggtgaacgccatgagccgggcgtgccgcgagggcgagctgtccacctgcggctgcagccgcgccgcgcgccccaaggacctgccgcgggactggctctggggcggctgcggcgacaacatcgactatggctaccgctttgccaaggagttcgtggacgcccgcgagcgggagcgcatccacgccaagggctcctacgagagtgctcgcatcctcatgaacctgcacaacaacgaggccggccgcaggacggtgtacaacctggctgatgtggcctgcaagtgccatggggtgtccggctcatgtagcctgaagacatgctggctgcagctggcagacttccgcaaggtgggtgatgccctgaaggagaagtacgacactggtttaaaaaacaaacatcgaaaggcttatgccaaatggaagatagaatataaaataaaacgttacttgtatattggtaagtggtttcaattgtccttcagataattcatgtggagatttttggagaaaccatgacggatagtttaggatgactacatgtcaaagtaataaaagagtggtgaattttaccaaaaccaagctatttggaagcttcaaaaggtttctatatgtaatggaacaaaaggggaattctcttttcctatatatgttccttacaaaaaaaaaaaaaaagaaatcaagcagatggcttaaagctggttataggattgctcacattcttttagcattatgcatgtaacttaattgttttagagcgtgttgctgttgtaacatcccagagaagaatgaaaaggcacatgcttttatccgtgaccagatttttagtccaaaaaaatgtatttttttgtgtgtttaccactgcaactattgcacctctctatttgaatttactgtggaccatgtgtggtgtctctatgccctttgaaagcagtttttataaaaagaaagcccgggtctgcagagaatgaaaactggttggaaactaaaggttcattgtgttaagtgcaattaatacaagttattgtgcttttcaaaaatgtacacggaaatctggacagtgctgcacagattgatacattagcctttgctttttctctttccggataaccttgtaacatattgaaaccttttaaggatgccaagaatgcattattccacaaaaaaacagcagaccaacatatagagtgtttaaaatagcatttctgggcaaattcaaactcttgtggttctaggactcacatctgtttcagtttttcctcagttgtatattgaccagtgttctttattgcaaaaacatatacccgatttagcagtgtcagcgtattttttcttctcatcctggagcgtattcaagatcttcccaatacaagaaaattaataaaaaatttatatataggcagcagcaaaagagccatgttcaaaatagtcattatgggctcaaatagaaagaagacttttaagttttaatccagtttatctgttgagttctgtgagctactgacctcctgagactggcactgtgtaagttttagttgcctaccctagctcttttctcgtacaattttgccaataccaagtttcaatttgtttttacaaaacattattcaagccactagaattatcaaatatgacgctatagcagagtaaatactctgattaagagaccggtactagctaactccaagagatcgttagcagcatcagtccacaaacacttagtggcccacaatatatagagagatagaaaaggtagttataacttgaagcatgtatttaatgcaaataggcacgaaggcacaggtctaaaatactacattgtcactgtaagctatacttttaaaatatttattttttttaaagtattttctagtcttttctctctctgtggaatggtgaaagagagatgccgtgttttgaaagtaagatgatgaaatgaatttttaattcaagaaacattcagaaacataggaattaaaacttagagaaatgatctaatttccctgttcacacaaactttacactttaatctgatgattggatattttattttagtgaaacatcatcttgttagctaactttaaaaaatggatgtagaatgattaaaggttggtatgatttttttttaatgtatcagtttgaacctagaatattgaattaaaatgctgtctcagtattttaaaagcaaaaaaggaatggaggaaaattgcatcttagaccatttttatatgcagtgtacaatttgctgggctagaaatgagataaagattatttatttttgttcatatcttgtacttttctattaaaatcattttatgaaatccaaaaaaaagt

SEQ ID NO: 26044 - DNA, 302 bp, Homo sapiens
ccccgttctgggcccccaagtaagcattctccccagcatagcacctggcaaggaagactcacagaaaccactggctgaatggagtcaagtccactcctgggcctgaagtgacaccaccgaggacagcaaaaggatgactcaccctttcactaaaggcccccaactgccaggtagtggtagcttcccctcctttttgtgcacttcggcccatcccctgctgcactgatctgacggaactaaggaaggcccgagacagctctgccgctccgagaagttcagctttcttacagctacagacagca

SEQ ID NO: 26045 - DNA, 273 bp, Homo sapiens
agtaaattaaagcaatatagtaaaacaatgcacatcttgatggaatctcaggatcacaaggttgtggtgaaggaaatttgaagatgtccaggaaagaaagacaaatgagatgaatcttgcagctgcccttcaagggggcatgggccgggtggccatgattctccgtgatgttgcaggaattctggctgggtcctcaggagcctttttttcttgtccacattcaccttcggtgggtggtccctggtggtcatgaccgcactcagggcccggggc

SEQ ID NO: 26046 - DNA, 282 bp, Homo sapiens
ccaagctcctctcaagtgataggcatgagccactgcatctggccaaaaggcactttttatacttaattcatcctttcagcatcctatgaaaagagtctgggctgggtgcagtggctcacgcctgtaatcccagcactctgggaggctgaggcgggcggatcacttgaagtcaggcgttcgagaccagactggccaacatgatgaaaccccatctctactaaaaatacaaaaatcagccaggcgtggtggtgggcacctgtagtcccaggtactcaggaggcc

SEQ ID NO: 26047 - DNA, 416 bp, Homo sapiens
ttttctcagggatcactgtccttcgttgcccaattcccagcgtctggtaaactgttgtttcatgtccattgttttttgggtttgtggttgctgctgcttcgggtgggaggggatagattcaatccctgtgactctatcttggccagaagccacactctctaatctcatgctgatgttttctgtgttgacctgtcctgctgccacctgtcctgtgagctccttcaaggcagggctgtgctgatgccaagggatttagcaccatttttgtgctattcataaagtccacaaatgtttgttgaataaagtaagtgttagactccaaaacatacaaagatgaataagacaatatctacaatatctctgtcttgaaaaaacttagaaaccactgggaagacaaatctcatgaagaagcattc

SEQ ID NO: 26048 - DNA, 1676 bp, Homo sapiens
ctccatcttgtaaggatgcaaagaagccatgaaaataagtaatatcaactcctgaggataaaacgttacttgactagagttagctttttaattgtaatcatttataaacttctttgttccttacatataagcatagtcataaccatggtacccaaaattttctataagttattgtaactccttaaaggtcttgctacagttcttttatccagtacaaataattgggaaaatgtaaagctgaatgaaatctagtgagcctcatatcctcccttttagatattgattttaagtttgcttttcacagctgctaaaaagtaacaactgatttttagttccacaacctctctttcttcaatttagatggatcatacaataaagcaaaatctggctggttacagtggctcacacctataatcccagcactttgggaggctgaggtggagggtctcatgagcccaggagttcaagaccaacctgggcaatatagtgagactctttctatttaaacaaaaacaaaaacaaacaaacaaacaaacaaaaagctgggcatgatgcacacctttagtttcagctactaaggaggctgaggttggaggatcacttgagcctaggaggtcaacactgcagtgagctatgatcatgctactgccctccagcctgggcaacagagcaagaccctgtctccaaaaacataaataattaaatataaataaaaataaagcaaaatctgttgggaaacgagaaaaaggagaggaatttttcaggaataatcataaaaagaaatgatcatcagactgaaagtccagagcctgagaaatgaaaacatatttttaagcattggtgttgaccatgcagacaaacttttgttaattcagagcgatacaaaaggcactttgaatctataaaacttgaaaaagttaaaaattgtatgtcggataaagctttaagtcatctgtcactattaacctcagtgcagcaattctgactcctgtgcctggattccttttatgataattttgccacctacaggacagattaggtgctggtcgcctgaattattttgtgttctgaattattttgagctctaaaatggtaaagtacaaatactcattgttttactgtgcctttggccttttataaaaaggtatttataattcgttgataaaaaccaatatttgaagctgttgattaccaacaaaaaagtttcactctctttatagtgcttcaggatacaactttttcagggccttattagagaaaaactgattcacatgttattcttctaaagctaaattattaaaatgtaggttgaaagattggattgattgtgaatctacactaaagatatggttccaggcagacctccttagagacctccaggcagacctccttactgtcttcagtgatgtttaatttcattactgttactgggtgccaagtgtctttcatttggaagtgaacttactccagttattgaatgtttatcatatcataatttgcatttttccaacattgaaggtattttaaaaagtcactaagagattcattcttttattattcaactacaaaaaaatagtgtaatgatcagaatttaaaatgtgtgattctttttcttctgtaagtatgtattgctatgataaataaaaaatggcaggaccattgtttttattaaaata

SEQ ID NO: 26049 - DNA, 1652 bp, Homo sapiens
ctccatcttgtaaggatgcaaagaagccatgaaaataagtaatatcaactcctgaggataaaacgttacttgactagagttagctttttaattgtaatcatttataaacttctttgttccttacatataagcatagtcataaccatggtacccaaaattttctataagttattgtaactccttaaaggtcttgctacagttcttttatccagtacaaataattgggaaaatgtaaagctgaatgaaatctagtgagcctcatatcctcccttttagatattgattttaagtttgcttttcacagctgctaaaaagtaacaactgatttttagttccacaacctctctttcttcaatttagatggatcatacaataaagcaaaatctggctggttacagtggctcacacctataatcccagcactttgggaggctgaggtggagggtctcatgagcccaggagttcaagaccaacctgggcaatatagtgagactctttctatttaaacaaaaacaaaaacaaacaaacaaacaaacaaaaagctgggcatgatgcacacctttagtttcagctactaaggaggctgaggttggaggatcacttgagcctaggaggtcaacactgcagtgagctatgatcatgctactgccctccagcctgggcaacagagcaagaccctgtctccaaaaacataaataattaaatataaataaaaataaagcaaaatctgttgggaaacgagaaaaaggagaggaatttttcaggaataatcataaaaagaaatgatcatcagactgaaagtccagagcctgagaaatgaaaacatatttttaagcattggtgttgaccatgcagacaaacttttgttaattcagagcgatacaaaaggcactttgaatctataaaacttgaaaaagttaaaaattgtatgtcggataaagctttaagtcatctgtcactattaacctcagtgcagcaattctgactcctgtgcctggattccttttatgataattttgccacctacaggacagattaggtgctggtcgcctgaattattttgtgttctgaattattttgagctctaaaatggtaaagtacaaatactcattgttttactgtgcctttggccttttataaaaaggtatttataattcgttgataaaaaccaatatttgaagctgttgattaccaacaaaaaagtttcactctctttatagtgcttcaggatacaactttttcagggccttattagagaaaaactgattcacatgttattcttctaaagctaaattattaaaatgtaggttgaaagattggattgattgtgaatctacactaaagatatggttccaggcagacctccttactgtcttcagtgatgtttaatttcattactgttactgggtgccaagtgtctttcatttggaagtgaacttactccagttattgaatgtttatcatatcataatttgcatttttccaacattgaaggtattttaaaaagtcactaagagattcattcttttattattcaactacaaaaaaatagtgtaatgatcagaatttaaaatgtgtgattctttttcttctgtaagtatgtattgctatgataaataaaaaatggcaggaccattgtttttattaaaata

SEQ ID NO: 26050 - DNA, 764 bp, Homo sapiens
cccctgcaggacgattgcctgcaagacagggcctggagaaggccagggcacccaaggccacagaaatgcccagggatgagtcccggctggagatgccttggctgaactcactgtgtacttccagggcgcacagggcagtgctcgagctggtactacacatgaagatgtcccgctctccactgctcaaggagagagtgcctgacctgagctgggcccatcagatccagtacttacctggaataggaaaaagatggggagagtgaccaaagattacaaaaatctctgaagcttatccacttgagagagagtccctgaagatactggcctctcattcctgctatgtatgtccaatgtgactgaactctgaataaaatatacaagttataacaatgtagcaattgacccagcaaacgaggacacaaacgtgttggagggatttgagtttgatgtcatgcatataatgtgatcccactgtatgactacacaaatgttggcaaaagtgagctcagaggaaatggtaggcaagtacttcccagttttgaccagaagatggagaaaaaaagaattctcaaaaaatgtgtctacggagaaatagacaagcgatgcacgacagatacatgtgtcagtctggtccctgcagttatatttgtaataatacacattggagcaatttcatggccatcggttagagaatgtttgaggaatgatccattcatatcaagaagcacatttcaaagatcagcctgatggaaatgctggagacc

SEQ ID NO: 26051 - DNA, 724 bp, Homo sapiens
cccctgcaggacgattgcctgcaagacagggcctggagaaggccagggcacccaaggccacagaaatgcccagggatgagtcccggctggagatgccttggctgaactcactgtgtacttccagggcgcacagggcagtgctcgagctggtactacacatgaagatgtcccgctctccactgctcaaggagagagtgcctgacctgagctgggcccatcagatccagtacttacctggaataggaaaaagatggggagagtgaccaaagattacaaaaatctctgaagcttatccacttgagagagagtccctgaagatactggcctctcattcctgctatgtatgtccaatgtgactgaactctgaataaaatatacaagttataacaatgtagcaattgacccagcaaacgaggacacaaacgtgttggagggatttgagtttgatgtcatgcatataatgtgatcccactgtatgactacacaaatgttggcaaaagtgagctcagaggaaatggtaggcaagtacttcccagttttgaccagaagatggagaaaaaaagaattctcaaaaaatatgtgtcagtctggtccctgcagttatatttgtaataatacacattggagcaatttcatggccatcggttagagaatgtttgaggaatgatccattcatatcaagaagcacatttcaaagatcagcctgatggaaatgctggagacc

SEQ ID NO: 26052 - DNA, 760 bp, Homo sapiens
ccggctgcaggacacagcccagcaggagaagcttttccctccattctttcaaggaatctcgctctgtcacccaggctggagtgaagtggcccaatctcggcttaccacaacctctgcctcccaggttcaagcgattctcctgcctcagcctcccaagtagctgagattacagagagatatatgcccaggatggggctgaataaaaagctaataataatagccaccacctgtggagagcttctcttggaccacgcattctgctaagtccttctcttgtatgaggaccagttgtgcccagagaaccttctctgtctcctctaaccatgggataaaaggagatttccacaagagcggctcagggacgcagcccatctcttaagaaggaggctctgagagggacaagaccatggatgcagcacatggccacaaggcagtttcaagatgcccatgtcaggcagaggatggctcagtggtctctaacccacctaacatttcatgaactttactcctggtcccgctcccaaattagacactggagataatggatcactatactgcactgaagactcggaggggttgagccgctggagccacgcaaattcagacacctcttccgccccaggtcactctactcgcccacgctgcctgccacacccatccggttgtgcgggacactccccgcgtttcttcagcgattcttatcgggctccctccttgttcaataaaggtgaagggtgtggggttttctgtgcatacgctc

SEQ ID NO: 26053 - DNA, 475 bp, Homo sapiens
ctatctggtgtgtaacatgaggcaaacacacagtagtgtcagtgatgaagagcccctttaactgaggtaacccgagcattttctctgagaagctgctggtcatgattcaaagtgccacctcgggaggcagcctgcctgggtttattcagttcctctgtcctcaaatttccaccactccctcgctgctgctcactctttgaggagaaccttgcttcttatttcactgagaagaaggaattatcagaagagaactttcacatgctctcaccaccaaagccccttcccttcctacacctctacccacctcccttccctaagacactgtgtgaataagctgtccatgactatcctaccaccacgtacccaatcccgctcacctttaaagaactcagcaactacaacctccccctctagtagaccaatttttctctttctaatggatcattcctgtcagcatttaaacatgttattgata

SEQ ID NO: 26054 - DNA, 221 bp, Homo sapiens
gcagtggatgactgaaaatggtagagcttataaagcttatgaagtgcatattttttattaaagtaaacatatgggctgtgtgtggtggctacttgggaggctgaggcaggaggattgcttgagccaaggagttcgaagttaaggtgagctataattgtgccactgcattccagcctgggtaacagagtgaaaccttgtctctcaaaaaaaaaaaaaaaaaa

SEQ ID NO: 26055 - DNA, 363 bp, Homo sapiens
tctcaagagaatctatccatgtgtcttgcttttgttccttctctgcagaaagaaagaagctaagcagtaaagttgggttgcacaggaaatgatgatgcttcaatttcttaatagttaaaaagtgctaaatactacttgaaattattgtttacagattagtgacaagagctggggttaggatccggttggactctgacatcggatgccctcaaacatacagaacttccaaactcaagtccagccataagctattttgccaacatgtcagagtaatctgtatttttgtatgtgatttctacttttatagacttgttttaaaacaataaaacacatttttataaaaatgagtgcttaaactaagtt

SEQ ID NO: 26056 - DNA, 266 bp, Homo sapiens
ggccgccgttaacgaatccatatagtattgccttccgcttatttcctttattatagtgacagtaacaagagctggggttaggatccggttggactctgacatcggatgccctcaaacatacagaacttccaaactcaagtccagccataagctattttgccaacatgtcagagtaatctgtatttttgtatgtgatttctacttttatagacttgttttaaaacaataaaacacatttttataaaaatgagtgcttaaactaagtt

SEQ ID NO: 26057 - DNA, 265 bp, Homo sapiens
acaacacataaaagaaatgaataattttaaaagatcaaaatataatttcagatatcgacagcaacaagagctggggttaggatccggttggactctgacatcggatgccctcaaacatacagaacttccaaactcaagtccagccataagctattttgccaacatgtcagagtaatctgtatttttgtatgtgatttctacttttatagacttgttttaaaacaataaaacacatttttataaaaatgagtgcttaaactaagtt

SEQ ID NO: 26058 - DNA, 3473 bp, Homo sapiens
gaattccgggctgtagagcttgcccgcgcagtggggatggaacgttgctaggcttagcgggtctggctgctgggggcccgagcagcacgctcggagccgccgcgcgccaaagcgggaatctgggaggcgagcagctctgcagttaatgcacgtattttaaactcccgggcctgcggacgctatgcacaggaagcacctccaggagattccagacctgagtagcaacgttgccaccagcttcacgtggggatgggattccagcaagacttctgaactgctgtcaggcatgggggtctccgccctggagaaagaggagcccgacagtgagaacatcccccaggaactgctctcaaacctgggccacccggagagccccccacggaaacggctgaagagcaaagggagtgacaaagactttgtgattgtccgcaggcctaagctaaatcgagagaactttccaggtgtttcatgggactcccttccggatgagctgctcttgggaatcttttcctgtctgtgcctccctgagctgctaaaggtctctggtgtttgtaagaggtggtatcgcctagcgtctgatgagtctctatggcagaccttagacctcacaggtaaaaatctgcacccggatgtgactggtcggttgctgtctcaaggggtgattgccttccgctgcccacgatcatttatggaccaaccattggctgaacatttcagcccttttcgtgtacagcacatggacctatcgaactcagttatagaagtgtccaccctccacggcatactgtctcagtgttccaagttgcagaatctaagcctggaaggcctgcggctttcggatcccattgtcaatactctcgcaaaaaactcaaatttagtgcgacttaacctttctgggtgttctggattctctgaatttgccctgcagactttgctaagcagctgttccagactggatgagctgaacctctcctggtgttttgatttcactgaaaagcatgtacaggtggctgttgcgcatgtgtcagagaccatcacccagctgaatcttagcggctacagaaagaatctccagaaatcagatctctctactttagttagaagatgccccaatcttgtccatctagacttaagtgatagtgtcatgctaaagaatgactgctttcaggaatttttccagctcaactacctccaacacctatcactcagtcggtgctatgatataatacctgaaactttacttgaacttggagaaattcccacactaaaaacactacaagtttttggaatcgtgccagatggtacccttcaactgttaaaggaagcccttcctcatctacagattaattgctcccatttcaccaccattgccaggccaactattggcaacaaaaagaaccaggagatatggggcatcaaatgccgactgacactgcaaaagcccagttgtctatgaagtatttattgcaggatggtgtctcttctttagaacagggaaaataggcaggaagcccaattgctggagtacttagctagttttattcttggttttccctttgccttcattctgcaagtatactagggagccatttgagagggaaaactatgaaatcttgctttttgaaatgattctaaaagcttctatcactgctttgctcttaagagccaaagttgtaggccttttgaaattttaggagagtgagcctataatttcaagataccttaaagagcaaaatttgagccacctcttccaagtgcccttcttactaagtctattcagaatcaagcttaaaaattaccaccagcaaacaatcttcatagcccatataacttttatctatttaattttatagtattgctttataagacagcttagaagaacaataagctattgtattatgagctgaacaaaaagagaatcataggatagtagcgtctgaggccatcttttctaggaataggaaagagaaaaatgtatttgaattttgcctttagatttgaaattaggttaatagaaataagtaaccccatgtaattcaccttaaaacttaacaaaagaccaaacattacaaaacccagaggtatagaatcaatataggatttgaaggcccagcagacagttttctatgacaggttaatctgaagtatcctgtaatgttcattaagttactgtgtttccagaatctaaattagatgagaaatataattgtggttttctaacttgataatcaaattatgttaacatgggtcctttagcttttaaaatgacttgctttgttttagaaaggtggtattaatccactctctattcttgaaaatttggatgggagaattctgaagttgcctgctgttttcctttagcgctgaggttcttaaggttacttttatattactctggaatcaagtattttaaattgtattttttttttaaatgatctctcagcaataattgtttgaaactatccatatataaggttatcagacctacagttccctaagaggaactgcatgttctcttcaatcagaaatatacagtagaagcaggtatatcttccatgcagtttcagtagtaagcactacttatacctacataagagttaaaatccagatgtgggaccttttgataccatcagtgatatatatttttttaaactggtacagagaagtgaaaagattaaattctacttctatttttcttttttttttttggaaacggagtctcgctctgtcaccaaggccggagtgcagtggtgcgatctcggctcactgcaagctccgcctcccaggttcacgtcattctcctgcctcagcctcccgactagctgggactacaggcgcccaccaccacgcccggctaattttttggtatttttagtagagacggggtttcaccatgttagccaggatggtctcaatctcctgacctcatgatccgcccgtcttggcctcccaaagtgctgggattacaggcatgagcaactgcgcccagccaaattctacttcttaaaaatcacaaaaactagtttaaattgatgacttgttcgtatgttcaaaatgtaacaacaaaaaaagctaacaccagtcatttatattaactttttttttttaaatcaaaaattgttaatgttagaaacatactatgaagtgcctttatctgcttagacctaaggaagattttaaagttgggttgcacaggaaatgatgatgcttcaatttcttaatagttaaaaagtgctaaatactacttgaaattattgtttacagattagtgacaagagctggggttaggatccggttggactctgacatcggatgccctcaaacatacagaacttccaaactcaagtccagccataagctattttgccaacatgtcagagtaatctgtatttttgtatgtgatttctacttttatagacttgttttaaaacaataaaacacatttttataaaaatgagtgcttaaactaagtt

SEQ ID NO: 26059 - DNA, 995 bp, Homo sapiens
gaattccgggctgtagagcttgcccgcgcagtggggatggaacgttgctaggcttagcgggtctggctgctgggggcccgagcagcacgctcggagccgccgcgcgccaaagcgggaatctgggaggcgagcagctctgcagttaatgcacgtattttaaactcccgggcctgcggacgctatgcacaggaagcacctccaggagattccagacctgagtagcaacgttgccaccagcttcacgtggggatgggattccagcaagacttctgaactgctgtcaggcatgggggtctccgccctgggaggaaaaacagggaagggggcaagggcccccccccggggaaccccaagggattggggcaagggaaaaaccaaattttcccccccaggggaaacttggctgctctcaaacctgggccacccggagagccccccacggaaacggctgaagagcaaagggagtgacaaagactttgtgattgtccgcaggcctaagctaaatcgagagaactttccaggtgtttcatgggactcccttccggatgagctgctcttgggaatcttttcctgtctgtgcctccctgagctgctaaaggtctctggtgtttgtaagaggtggtatcgcctagcatctctctactttagttagaagatgccccaatcttgtccatctagacttaagtgatagtgtcatgctaaagaatgactgctttcaggaatttttccagctcaactacctccaacacctatcactcagtcggtgctatgatataatacctgaaactttactacaagagctggggttaggatccggttggactctgacatcggatgccctcaaacatacagaacttccaaactcaagtccagccataagctattttgccaacatgtcagagtaatctgtatttttgtatgtgatttctacttttatagacttgttttaaaacaataaaacacatttttataaaaatgagtgcttaaactaagtt

SEQ ID NO: 26060 - DNA, 1444 bp, Homo sapiens
gaattccgggctgtagagcttgcccgcgcagtggggatggaacgttgctaggcttagcgggtctggctgctgggggcccgagcagcacgctcggagccgccgcgcgccaaagcgggaatctgggaggcgagcagctctgcagttaatgcacgtattttaaactcccgggcctgcggacgctatgcacaggaagcacctccaggagattccagacctgagtagcaacgttgccaccagcttcacgtggggatgggattccagcaagacttctgaactgctgtcaggcatgggggtctccgccctggagaaagaggagcccgacagtgagaacatcccccaggaactgctctcaaacctgggccacccggagagccccccacggaaacggctgaagagcaaagggagtgacaaagactttgtgattgtccgcaggcctaagctaaatcgagagaactttccaggtgtttcatgggactcccttccggatgagctgctcttgggaatcttttcctgtctgtgcctccctgagctgctaaaggtctctggtgtttgtaagaggtggtatcgcctagcgtctgatgagtctctatggcagaccttagacctcacaggtaaaaatctgcacccggatgtgactggtcggttgctgtctcaaggggtgattgccttccgctgcccacgatcatttatggaccaaccattggctgaacatttcagcccttttcgtgtacagcacatggacctatcgaactcagttatagaagtgtccaccctccacggcatactgtctcagtgttccaagttgcagaatctaagcctggaaggcctgcggctttcggatcccattgtcaatactctcgcaaaaaactcaaatttagtgcgacttaacctttctgggtgttctggattctctgaatttgccctgcagactttgctaagcagctgttccagactggatgagctgaacctctcctggtgttttgatttcactgaaaagcatgtacaggtggctgttgcgcatgtgtcagagaccatcacccagctgaatcttagcggctacagaaagaatctccagaaatcagatctctctactttagttagaagatgccccaatcttgtccatctagacttaagtgatagtgtcatgctaaagaatgactgctttcaggaatttttccagctcaactacctccaacacctatcactcagtcggtgctatgatataatacctgaaactttactacaagagctggggttaggatccggttggactctgacatcggatgccctcaaacatacagaacttccaaactcaagtccagccataagctattttgccaacatgtcagagtaatctgtatttttgtatgtgatttctacttttatagacttgttttaaaacaataaaacacatttttataaaaatgagtgcttaaactaagtt

SEQ ID NO: 26061 - DNA, 3533 bp, Homo sapiens
gaattccgggctgtagagcttgcccgcgcagtggggatggaacgttgctaggcttagcgggtctggctgctgggggcccgagcagcacgctcggagccgccgcgcgccaaagcgggaatctgggaggcgagcagctctgcagttaatgcacgtattttaaactcccgggcctgcggacgctatgcacaggaagcacctccaggagattccagacctgagtagcaacgttgccaccagcttcacgtggggatgggattccagcaagacttctgaactgctgtcaggcatgggggtctccgccctgggaggaaaaacagggaagggggcaagggcccccccccggggaaccccaagggattggggcaagggaaaaaccaaattttcccccccaggggaaacttggctgctctcaaacctgggccacccggagagccccccacggaaacggctgaagagcaaagggagtgacaaagactttgtgattgtccgcaggcctaagctaaatcgagagaactttccaggtgtttcatgggactcccttccggatgagctgctcttgggaatcttttcctgtctgtgcctccctgagctgctaaaggtctctggtgtttgtaagaggtggtatcgcctagcgtctgatgagtctctatggcagaccttagacctcacaggtaaaaatctgcacccggatgtgactggtcggttgctgtctcaaggggtgattgccttccgctgcccacgatcatttatggaccaaccattggctgaacatttcagcccttttcgtgtacagcacatggacctatcgaactcagttatagaagtgtccaccctccacggcatactgtctcagtgttccaagttgcagaatctaagcctggaaggcctgcggctttcggatcccattgtcaatactctcgcaaaaaactcaaatttagtgcgacttaacctttctgggtgttctggattctctgaatttgccctgcagactttgctaagcagctgttccagactggatgagctgaacctctcctggtgttttgatttcactgaaaagcatgtacaggtggctgttgcgcatgtgtcagagaccatcacccagctgaatcttagcggctacagaaagaatctccagaaatcagatctctctactttagttagaagatgccccaatcttgtccatctagacttaagtgatagtgtcatgctaaagaatgactgctttcaggaatttttccagctcaactacctccaacacctatcactcagtcggtgctatgatataatacctgaaactttacttgaacttggagaaattcccacactaaaaacactacaagtttttggaatcgtgccagatggtacccttcaactgttaaaggaagcccttcctcatctacagattaattgctcccatttcaccaccattgccaggccaactattggcaacaaaaagaaccaggagatatggggcatcaaatgccgactgacactgcaaaagcccagttgtctatgaagtatttattgcaggatggtgtctcttctttagaacagggaaaataggcaggaagcccaattgctggagtacttagctagttttattcttggttttccctttgccttcattctgcaagtatactagggagccatttgagagggaaaactatgaaatcttgctttttgaaatgattctaaaagcttctatcactgctttgctcttaagagccaaagttgtaggccttttgaaattttaggagagtgagcctataatttcaagataccttaaagagcaaaatttgagccacctcttccaagtgcccttcttactaagtctattcagaatcaagcttaaaaattaccaccagcaaacaatcttcatagcccatataacttttatctatttaattttatagtattgctttataagacagcttagaagaacaataagctattgtattatgagctgaacaaaaagagaatcataggatagtagcgtctgaggccatcttttctaggaataggaaagagaaaaatgtatttgaattttgcctttagatttgaaattaggttaatagaaataagtaaccccatgtaattcaccttaaaacttaacaaaagaccaaacattacaaaacccagaggtatagaatcaatataggatttgaaggcccagcagacagttttctatgacaggttaatctgaagtatcctgtaatgttcattaagttactgtgtttccagaatctaaattagatgagaaatataattgtggttttctaacttgataatcaaattatgttaacatgggtcctttagcttttaaaatgacttgctttgttttagaaaggtggtattaatccactctctattcttgaaaatttggatgggagaattctgaagttgcctgctgttttcctttagcgctgaggttcttaaggttacttttatattactctggaatcaagtattttaaattgtattttttttttaaatgatctctcagcaataattgtttgaaactatccatatataaggttatcagacctacagttccctaagaggaactgcatgttctcttcaatcagaaatatacagtagaagcaggtatatcttccatgcagtttcagtagtaagcactacttatacctacataagagttaaaatccagatgtgggaccttttgataccatcagtgatatatatttttttaaactggtacagagaagtgaaaagattaaattctacttctatttttcttttttttttttggaaacggagtctcgctctgtcaccaaggccggagtgcagtggtgcgatctcggctcactgcaagctccgcctcccaggttcacgtcattctcctgcctcagcctcccgactagctgggactacaggcgcccaccaccacgcccggctaattttttggtatttttagtagagacggggtttcaccatgttagccaggatggtctcaatctcctgacctcatgatccgcccgtcttggcctcccaaagtgctgggattacaggcatgagcaactgcgcccagccaaattctacttcttaaaaatcacaaaaactagtttaaattgatgacttgttcgtatgttcaaaatgtaacaacaaaaaaagctaacaccagtcatttatattaactttttttttttaaatcaaaaattgttaatgttagaaacatactatgaagtgcctttatctgcttagacctaaggaagattttaaagttgggttgcacaggaaatgatgatgcttcaatttcttaatagttaaaaagtgctaaatactacttgaaattattgtttacagattagtgacaagagctggggttaggatccggttggactctgacatcggatgccctcaaacatacagaacttccaaactcaagtccagccataagctattttgccaacatgtcagagtaatctgtatttttgtatgtgatttctacttttatagacttgttttaaaacaataaaacacatttttataaaaatgagtgcttaaactaagtt

SEQ ID NO: 26062 - DNA, 2783 bp, Homo sapiens
  misc_feature (2608)..(2608): n is a, c, g, or t
  misc_feature (2701)..(2701): n is a, c, g, or t
gtactctgattggtgacgggtgaggcggcccgaaatcgtaggacttccgaaagcagcggtggcgtttgcttcactgcttggaagtgtgagtgcgcgaagatgcgaaaggtggttttgatcaccggggctagcagtggcattggcctggccctctgcaagcggctgctggcggaagatgatgagcttcatctgtgtttggcgtgcaggaacatgagcaaggcagaagctgtctgtgctgctctgctggcctctcaccccactgctgaggtcaccattgtccaggtggatgtcagcaacctgcagtcggtcttccgggcctccaaggaacttaagcaaaggtttcagagattagactgtatatatctaaatgctgggatcatgcctaatccacaactaaatatcaaagcacttttctttggcctcttttcaagaaaagtgattcatatgttctccacagctgaaggcctgctgacccagggtgataagatcactgctgatggacttcaggaggtgtttgagaccaatgtctttggccattttatcctggtaaagaagctgtgggcttaataagctaatatttcgtgtgatagtttctgtaaagctctgggcacagggcattattatagttgagcagccagttaactgatttaatctcatgtttgagttttcttgattgcatttgccttgtttattgtgagcatggaatacttctggaagctttcctagtagatttttctttaataaatgtactaatagtttttgatttacagaattactgcaaagatagtacagagactttctgtatgccctacacccagtttccccattattaacatttcgcattggtatgatgcatttgtcaaaatagatgaatcaattctgctacattattattaactaaagtacacactttattcaggttctgtttttgcctaatgtcttttttcagttctaggatcccattcaagatactacattacatttagcagtcatgtctccttaggctcttcttggttgtgacagcttctcagactttccttgtttttgatgaccttgacagttttgaggagtactgcttaggtgttttgtagactctctcaatcgggatttgtctgatgtttttctcatggtgagactgaagaatgtggtttttgggaggaaggccacagaggtaaagtgacattctcatgacatcatatcaagggtgtatgctatcagtatgacttctcagtgttgatattaaccttgatcacctggcttgaggtcatgtttgtcaggtttttccattgttaagttactttttctttctcccttttcatactctactttttgaaagaaagttgggccgggcacggtggctcctgcctctaatcccagcactttgggaggccaaggcgggcagattacctgaggtcgggagtttgagatcagcctgaccaacatggagaaaccccatctctatcaaaaaacaaaattagccgagtgtggtgacgcatgcctgtaatcccagctgcttgggaggctgaggcagaagaatcgcttgaacccgggaagcggaagttgtgattcgggaactggagcctctcctctgtcacagtgacaatccatctcagctcatctggacatcatctcgcagtgcaaggaaatctaatttcagcctcgaggacttccagcacagcaaaggcaaggaaccctacagctcttccaaatatgccactgaccttttgagtgtggctttgaacaggaacttcaaccagcagggtctctattccaatgtggcctgtccaggtacagcattgaccaatttgacatatggaattctgcctccgtttatatggacgctgttgatgccggcaatattgctacttcgcttttttgcaaatgcattcactttgacaccatataatggaacagaagctctggtatggcttttccaccaaaagcctgaatctctcaatcctctgatcaaatatctgagtgccaccactggctttggaagaaattacattatgacccagaagatggacctagatgaagacactgctgaaaaattttatcaaaagttactggaactggaaaagcacattagggtcactattcaaaaaacagataatcaggccaggctcagtggctcatgcctataattccagcactttgggaggccaaggcagaaggatcacttgagaccaggagttcaagaccagcctgagaaacatagtgagcccttgtctctacaaaaagaaataaaaataatagctgggtgtggtggcatgcgcatgtagtcccagctactcagaaggatgaggtgggaggatctcttgaggctgggaggcagaggttgcagtgagctgagattgtgccactgcactccagcctgggtgacagcgagaccctgtctcaaaatatgtatatatttaatatatatataaaaccagagctgacaatgacactctggaacattgcataccttctgtacattctggggtacatggatttctactgagttggataatatgcatttgtaataaactatgaactatacactctgcgcgcccgctcttctgctgctgtttgtctacttcctcctgcttcccgccgccgccgccgncatcatgagggaaatcgtgcacttgcaggccgggcagtgcggcaaccaaatcggcgccaagtttttgggaggtgatcagcgatgaagcacggnatcgaccccacgggcacctaccacgggggacagcgacctgcaactggaacgcttcaacgtgtactacaatgaggccccggcg

SEQ ID NO: 26063 - DNA, 1807 bp, Homo sapiens
  misc_feature (1632)..(1632): n is a, c, g, or t
  misc_feature (1725)..(1725): n is a, c, g, or t
gtactctgattggtgacgggtgaggcggcccgaaatcgtaggacttccgaaagcagcggtggcgtttgcttcactgcttggaagtgtgagtgcgcgaagatgcgaaaggtggttttgatcaccggggctagcagtggcattggcctggccctctgcaagcggctgctggcggaagatgatgagcttcatctgtgtttggcgtgcaggaacatgagcaaggcagaagctgtctgtgctgctctgctggcctctcaccccactgctgaggtcaccattgtccaggtggatgtcagcaacctgcagtcggtcttccgggcctccaaggaacttaagcaaaggatgatcaagaaatggttgtatgtgatctgtgttgaagaccatgtttcagagattagactgtatatatctaaatgctgggatcatgcctaatccacaactaaatatcaaagcacttttctttggcctcttttcaagaaaagtgattcatatgttctccacagctgaaggcctgctgacccagggtgataagatcactgctgatggacttcaggaggtgtttgagaccaatgtctttggccattttatcctgattcgggaactggagcctctcctctgtcacagtgacaatccatctcagctcatctggacatcatctcgcagtgcaaggaaatctaatttcagcctcgaggacttccagcacagcaaaggcaaggaaccctacagctcttccaaatatgccactgaccttttgagtgtggctttgaacaggaacttcaaccagcagggtctctattccaatgtggcctgtccaggtacagcattgaccaatttgacatatggaattctgcctccgtttatatggacgctgttgatgccggcaatattgctacttcgcttttttgcaaatgcattcactttgacaccatataatggaacagaagctctggtatggcttttccaccaaaagcctgaatctctcaatcctctgatcaaatatctgagtgccaccactggctttggaagaaattacattatgacccagaagatggacctagatgaagacactgctgaaaaattttatcaaaagttactggaactggaaaagcacattagggtcactattcaaaaaacagataatcaggccaggctcagtggctcatgcctataattccagcactttgggaggccaaggcagaaggatcacttgagaccaggagttcaagaccagcctgagaaacatagtgagcccttgtctctacaaaaagaaataaaaataatagctgggtgtggtggcatgcgcatgtagtcccagctactcagaaggatgaggtgggaggatctcttgaggctgggaggcagaggttgcagtgagctgagattgtgccactgcactccagcctgggtgacagcgagaccctgtctcaaaatatgtatatatttaatatatatataaaaccagagctgacaatgacactctggaacattgcataccttctgtacattctggggtacatggatttctactgagttggataatatgcatttgtaataaactatgaactatacactctgcgcgcccgctcttctgctgctgtttgtctacttcctcctgcttcccgccgccgccgccgncatcatgagggaaatcgtgcacttgcaggccgggcagtgcggcaaccaaatcggcgccaagtttttgggaggtgatcagcgatgaagcacggnatcgaccccacgggcacctaccacgggggacagcgacctgcaactggaacgcttcaacgtgtactacaatgaggccccggcg

SEQ ID NO: 26064 - DNA, 1466 bp, Homo sapiens
  misc_feature (1291)..(1291): n is a, c, g, or t
  misc_feature (1384)..(1384): n is a, c, g, or t
tgagatgggtcagtgtcttctaaacctctctgctgatagactaagagatatatatgtacatactaactcatgtatgtatacatatctataaatatttttctgtgtaactaattcatgtctcttttagataactagttaatactgatgtctctgaccctaatctcttaccatacagtacagtggtttcaaaatttttatctgtattctgtcagtatattttaatactgttttttgtttctttcacccagattcgggaactggagcctctcctctgtcacagtgacaatccatctcagctcatctggacatcatctcgcagtgcaaggaaatctaatttcagcctcgaggacttccagcacagcaaaggcaaggaaccctacagctcttccaaatatgccactgaccttttgagtgtggctttgaacaggaacttcaaccagcagggtctctattccaatgtggcctgtccaggtacagcattgaccaatttgacatatggaattctgcctccgtttatatggacgctgttgatgccggcaatattgctacttcgcttttttgcaaatgcattcactttgacaccatataatggaacagaagctctggtatggcttttccaccaaaagcctgaatctctcaatcctctgatcaaatatctgagtgccaccactggctttggaagaaattacattatgacccagaagatggacctagatgaagacactgctgaaaaattttatcaaaagttactggaactggaaaagcacattagggtcactattcaaaaaacagataatcaggccaggctcagtggctcatgcctataattccagcactttgggaggccaaggcagaaggatcacttgagaccaggagttcaagaccagcctgagaaacatagtgagcccttgtctctacaaaaagaaataaaaataatagctgggtgtggtggcatgcgcatgtagtcccagctactcagaaggatgaggtgggaggatctcttgaggctgggaggcagaggttgcagtgagctgagattgtgccactgcactccagcctgggtgacagcgagaccctgtctcaaaatatgtatatatttaatatatatataaaaccagagctgacaatgacactctggaacattgcataccttctgtacattctggggtacatggatttctactgagttggataatatgcatttgtaataaactatgaactatacactctgcgcgcccgctcttctgctgctgtttgtctacttcctcctgcttcccgccgccgccgccgncatcatgagggaaatcgtgcacttgcaggccgggcagtgcggcaaccaaatcggcgccaagtttttgggaggtgatcagcgatgaagcacggnatcgaccccacgggcacctaccacgggggacagcgacctgcaactggaacgcttcaacgtgtactacaatgaggccccggcg

SEQ ID NO: 26065 - DNA, 1544 bp, Homo sapiens
  misc_feature (1369)..(1369): n is a, c, g, or t
  misc_feature (1462)..(1462): n is a, c, g, or t
catacagcctaatgccgggagcacccccctcaagctagaggtatgggtcttatgtacttgcagggaaacagacacatactttaggtttagctgtctatttattaggccagaaacttcttgaaggcaaggactgtactccatacatcttttaatcttaaatgctcattatgattaaaaagctgatcttcagttaagccaataataggaaaaactcagataaccaggccctgcttttctcccccagcgttaagattggttattttttatactgcaaggttcatgagaatagagactttgtcccactaatttttgcatcctgggtgcctctcacagtgggttctcttaatacatgattcttcaacataaacgttctacccaacttcagagacaactcagaacataaattctttattacctgacttctggctcatgtacatacctcttttattaactagcatgtagctggactgagtcaatatacactgagttaaagtctcattgctacacctctctgttcctagggtctctattccaatgtggcctgtccaggtacagcattgaccaatttgacatatggaattctgcctccgtttatatggacgctgttgatgccggcaatattgctacttcgcttttttgcaaatgcattcactttgacaccatataatggaacagaagctctggtatggcttttccaccaaaagcctgaatctctcaatcctctgatcaaatatctgagtgccaccactggctttggaagaaattacattatgacccagaagatggacctagatgaagacactgctgaaaaattttatcaaaagttactggaactggaaaagcacattagggtcactattcaaaaaacagataatcaggccaggctcagtggctcatgcctataattccagcactttgggaggccaaggcagaaggatcacttgagaccaggagttcaagaccagcctgagaaacatagtgagcccttgtctctacaaaaagaaataaaaataatagctgggtgtggtggcatgcgcatgtagtcccagctactcagaaggatgaggtgggaggatctcttgaggctgggaggcagaggttgcagtgagctgagattgtgccactgcactccagcctgggtgacagcgagaccctgtctcaaaatatgtatatatttaatatatatataaaaccagagctgacaatgacactctggaacattgcataccttctgtacattctggggtacatggatttctactgagttggataatatgcatttgtaataaactatgaactatacactctgcgcgcccgctcttctgctgctgtttgtctacttcctcctgcttcccgccgccgccgccgncatcatgagggaaatcgtgcacttgcaggccgggcagtgcggcaaccaaatcggcgccaagtttttgggaggtgatcagcgatgaagcacggnatcgaccccacgggcacctaccacgggggacagcgacctgcaactggaacgcttcaacgtgtactacaatgaggccccggcg

SEQ ID NO: 26066 - DNA, 616 bp, Homo sapiens
  misc_feature (441)..(441): n is a, c, g, or t
  misc_feature (534)..(534): n is a, c, g, or t
acatttccctaagtagtaattagtaacgatgttgagcaacttttcatgtgctcaatgcctatacaggtcctttgcctgtttttaaaattgtgttgttttagttgggttgtaagagctatttatatattttgcatactggactcatagtgtgtatcattttttttttttttgagtcagagttttgctattgtgccactgcactccagcctgggtgacagcgagaccctgtctcaaaatatgtatatatttaatatatatataaaaccagagctgacaatgacactctggaacattgcataccttctgtacattctggggtacatggatttctactgagttggataatatgcatttgtaataaactatgaactatacactctgcgcgcccgctcttctgctgctgtttgtctacttcctcctgcttcccgccgccgccgccgncatcatgagggaaatcgtgcacttgcaggccgggcagtgcggcaaccaaatcggcgccaagtttttgggaggtgatcagcgatgaagcacggnatcgaccccacgggcacctaccacgggggacagcgacctgcaactggaacgcttcaacgtgtactacaatgaggccccggcg

SEQ ID NO: 26067 - DNA, 1764 bp, Homo sapiens
  misc_feature (1589)..(1589): n is a, c, g, or t
  misc_feature (1682)..(1682): n is a, c, g, or t
gtactctgattggtgacgggtgaggcggcccgaaatcgtaggacttccgaaagcagcggtggcgtttgcttcactgcttggaagtgtgagtgcgcgaagatgcgaaaggtggttttgatcaccggggctagcagtggcattggcctggccctctgcaagcggctgctggcggaagatgatgagcttcatctgtgtttggcgtgcaggaacatgagcaaggcagaagctgtctgtgctgctctgctggcctctcaccccactgctgaggtcaccattgtccaggtggatgtcagcaacctgcagtcggtcttccgggcctccaaggaacttaagcaaaggtttcagagattagactgtatatatctaaatgctgggatcatgcctaatccacaactaaatatcaaagcacttttctttggcctcttttcaagaaaagtgattcatatgttctccacagctgaaggcctgctgacccagggtgataagatcactgctgatggacttcaggaggtgtttgagaccaatgtctttggccattttatcctgattcgggaactggagcctctcctctgtcacagtgacaatccatctcagctcatctggacatcatctcgcagtgcaaggaaatctaatttcagcctcgaggacttccagcacagcaaaggcaaggaaccctacagctcttccaaatatgccactgaccttttgagtgtggctttgaacaggaacttcaaccagcagggtctctattccaatgtggcctgtccaggtacagcattgaccaatttgacatatggaattctgcctccgtttatatggacgctgttgatgccggcaatattgctacttcgcttttttgcaaatgcattcactttgacaccatataatggaacagaagctctggtatggcttttccaccaaaagcctgaatctctcaatcctctgatcaaatatctgagtgccaccactggctttggaagaaattacattatgacccagaagatggacctagatgaagacactgctgaaaaattttatcaaaagttactggaactggaaaagcacattagggtcactattcaaaaaacagataatcaggccaggctcagtggctcatgcctataattccagcactttgggaggccaaggcagaaggatcacttgagaccaggagttcaagaccagcctgagaaacatagtgagcccttgtctctacaaaaagaaataaaaataatagctgggtgtggtggcatgcgcatgtagtcccagctactcagaaggatgaggtgggaggatctcttgaggctgggaggcagaggttgcagtgagctgagattgtgccactgcactccagcctgggtgacagcgagaccctgtctcaaaatatgtatatatttaatatatatataaaaccagagctgacaatgacactctggaacattgcataccttctgtacattctggggtacatggatttctactgagttggataatatgcatttgtaataaactatgaactatacactctgcgcgcccgctcttctgctgctgtttgtctacttcctcctgcttcccgccgccgccgccgncatcatgagggaaatcgtgcacttgcaggccgggcagtgcggcaaccaaatcggcgccaagtttttgggaggtgatcagcgatgaagcacggnatcgaccccacgggcacctaccacgggggacagcgacctgcaactggaacgcttcaacgtgtactacaatgaggccccggcg

SEQ ID NO: 26068 - DNA, 2757 bp, Homo sapiens
  misc_feature (2582)..(2582): n is a, c, g, or t
  misc_feature (2675)..(2675): n is a, c, g, or t
gtactctgattggtgacgggtgaggcggcccgaaatcgtaggacttccgaaagcagcggtggcgtttgcttcactgcttggaagtgtgagtgcgcgaagatgcgaaaggtggttttgatcaccggggctagcagtggcattggcctggccctctgcaagcggctgctggcggaagatgatgagcttcatctgtgtttggcgtgcaggaacatgagcaaggcagaagctgtctgtgctgctctgctggcctctcaccccactgctgaggtcaccattgtccaggtggatgtcagcaacctgcagtcggtcttccgggcctccaaggaacttaagcaaaggtttcagagattagactgtatatatctaaatgctgggatcatgcctaatccacaactaaatatcaaagcacttttctttggcctcttttcaagctgaaggcctgctgacccagggtgataagatcactgctgatggacttcaggaggtgtttgagaccaatgtctttggccattttatcctggtaaagaagctgtgggcttaataagctaatatttcgtgtgatagtttctgtaaagctctgggcacagggcattattatagttgagcagccagttaactgatttaatctcatgtttgagttttcttgattgcatttgccttgtttattgtgagcatggaatacttctggaagctttcctagtagatttttctttaataaatgtactaatagtttttgatttacagaattactgcaaagatagtacagagactttctgtatgccctacacccagtttccccattattaacatttcgcattggtatgatgcatttgtcaaaatagatgaatcaattctgctacattattattaactaaagtacacactttattcaggttctgtttttgcctaatgtcttttttcagttctaggatcccattcaagatactacattacatttagcagtcatgtctccttaggctcttcttggttgtgacagcttctcagactttccttgtttttgatgaccttgacagttttgaggagtactgcttaggtgttttgtagactctctcaatcgggatttgtctgatgtttttctcatggtgagactgaagaatgtggtttttgggaggaaggccacagaggtaaagtgacattctcatgacatcatatcaagggtgtatgctatcagtatgacttctcagtgttgatattaaccttgatcacctggcttgaggtcatgtttgtcaggtttttccattgttaagttactttttctttctcccttttcatactctactttttgaaagaaagttgggccgggcacggtggctcctgcctctaatcccagcactttgggaggccaaggcgggcagattacctgaggtcgggagtttgagatcagcctgaccaacatggagaaaccccatctctatcaaaaaacaaaattagccgagtgtggtgacgcatgcctgtaatcccagctgcttgggaggctgaggcagaagaatcgcttgaacccgggaagcggaagttgtgattcgggaactggagcctctcctctgtcacagtgacaatccatctcagctcatctggacatcatctcgcagtgcaaggaaatctaatttcagcctcgaggacttccagcacagcaaaggcaaggaaccctacagctcttccaaatatgccactgaccttttgagtgtggctttgaacaggaacttcaaccagcagggtctctattccaatgtggcctgtccaggtacagcattgaccaatttgacatatggaattctgcctccgtttatatggacgctgttgatgccggcaatattgctacttcgcttttttgcaaatgcattcactttgacaccatataatggaacagaagctctggtatggcttttccaccaaaagcctgaatctctcaatcctctgatcaaatatctgagtgccaccactggctttggaagaaattacattatgacccagaagatggacctagatgaagacactgctgaaaaattttatcaaaagttactggaactggaaaagcacattagggtcactattcaaaaaacagataatcaggccaggctcagtggctcatgcctataattccagcactttgggaggccaaggcagaaggatcacttgagaccaggagttcaagaccagcctgagaaacatagtgagcccttgtctctacaaaaagaaataaaaataatagctgggtgtggtggcatgcgcatgtagtcccagctactcagaaggatgaggtgggaggatctcttgaggctgggaggcagaggttgcagtgagctgagattgtgccactgcactccagcctgggtgacagcgagaccctgtctcaaaatatgtatatatttaatatatatataaaaccagagctgacaatgacactctggaacattgcataccttctgtacattctggggtacatggatttctactgagttggataatatgcatttgtaataaactatgaactatacactctgcgcgcccgctcttctgctgctgtttgtctacttcctcctgcttcccgccgccgccgccgncatcatgagggaaatcgtgcacttgcaggccgggcagtgcggcaaccaaatcggcgccaagtttttgggaggtgatcagcgatgaagcacggnatcgaccccacgggcacctaccacgggggacagcgacctgcaactggaacgcttcaacgtgtactacaatgaggccccggcg

SEQ ID NO: 26069 - DNA, 1540 bp, Homo sapiens
  misc_feature (1365)..(1365): n is a, c, g, or t
  misc_feature (1458)..(1458): n is a, c, g, or t
gtactctgattggtgacgggtgaggcggcccgaaatcgtaggacttccgaaagcagcggtggcgtttgcttcactgcttggaagtgtgagtgcgcgaagatgcgaaaggtggttttgatcaccggggctagcagtggcattggcctggccctctgcaagcggctgctggcggaagatgatgagcttcatctgtgtttggcgtgcaggaacatgagcaaggcagaagctgtctgtgctgctctgctggcctctcaccccactgctgaggtcaccattgtccaggtggatgtcagcaacctgcagtcggtcttccgggcctccaaggaacttaagcaaaggtttcagagattagactgtatatatctaaatgctgggatcatgcctaatccacaactaaatatcaaagcacttttctttggcctcttttcaagaaaagtgattcatatgttctccacagctgaaggcctgctgacccagggtgataagatcactgctgatggacttcaggaggtgtttgagaccaatgtctttggccattttatcctgattcgggaactggagcctctcctctgtcacagtgacaatccatctcagctcatctggacatcatctcgcagtgcaaggaaatctaatttcagcctcgaggacttccagcacagcaaaggcaaggaaccctacagctcttccaaatatgccactgaccttttgagtgtggctttgaacaggaacttcaaccagcagggtctctattccaatgtggcctgtccaggtacagcattgaccaatttgacatatggaattctgcctccgtttatatggacgctgttgatgccggcaatattgctacttcgcttttttgcaaatgcattcactttgacaccatataatggaacagaagctctggtatggcttttccaccaaaagcctgaatctctcaatcctctgatcaaatatctgagtgccaccactggctttggaagaaattacattatgacccagaagatggacctagatgaagacactgctgaaaaattttatcaaaagttactggaactggaaaagcacattagggtcactattcaaaaaacagataatcaggccaggctcagtggctcatgcctataattccacctgggtgacagcgagaccctgtctcaaaatatgtatatatttaatatatatataaaaccagagctgacaatgacactctggaacattgcataccttctgtacattctggggtacatggatttctactgagttggataatatgcatttgtaataaactatgaactatacactctgcgcgcccgctcttctgctgctgtttgtctacttcctcctgcttcccgccgccgccgccgncatcatgagggaaatcgtgcacttgcaggccgggcagtgcggcaaccaaatcggcgccaagtttttgggaggtgatcagcgatgaagcacggnatcgaccccacgggcacctaccacgggggacagcgacctgcaactggaacgcttcaacgtgtactacaatgaggccccggcg

SEQ ID NO: 26070 - DNA, 3556 bp, Homo sapiens
ctttttttggccgggccgcatgaatccggccagcccagcctgcttgaaggacctacaggtttgtctcttccagatcagaactgaggaacaaaaacccccatcctgggaaaaatggggaagctgatttcgccgggttgcttttgtcttgcgggctcctgtcgggttcggtgtttccgctctgaagactgcgacgcgggctccgatgcagctcgctccctgccggatgggtcatgggattctaaacatgaggcagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagacca

SEQ ID NO: 26071 - DNA, 3334 bp, Homo sapiens
cttcgaaaaagaactagtgtgcagtccattgatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagacca

SEQ ID NO: 26072 - DNA, 5966 bp, Homo sapiens
tcgtagaactagggctgcaggaattgcgccgcgtcgacaaacccccatcctgggaaaaatggggaagctgatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaatttaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaagaaaaaaaaaaaaaaaaaaaaaca

SEQ ID NO: 26073 - DNA, 3599 bp, Homo sapiens
gagaactgatttgaaataagagccaggcggtcctcgcttccctgcgaccgacttttcataggctgggggagaaaaggttgagaaacttgacattgtctcgagcagagtgcgtgtagcaacagatcaaagaaaaagaggacgaaaacgtgctctttgctgcccgtagatttcgccgggttgcttttgtcttgcgggctcctgtcgggttcggtgtttccgctctgaagactgcgacgcgggctccgatgcagctcgctccctgccggatgggtcatgggattctaaacatgaggcagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagacca

SEQ ID NO: 26074 - DNA, 6019 bp, Homo sapiens
ctttttttggccgggccgcatgaatccggccagcccagcctgcttgaaggacctacaggtttgtctcttccagatcagaactgaggaacaaaaacccccatcctgggaaaaatggggaagctgatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaatttaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaagaaaaaaaaaaaaaaaaaaaaaca

SEQ ID NO: 26075 - DNA, 6132 bp, Homo sapiens
gagaactgatttgaaataagagccaggcggtcctcgcttccctgcgaccgacttttcataggctgggggagaaaaggttgagaaacttgacattgtctcgagcagagtgcgtgtagcaacagatcaaagaaagggctcctgtcgggttcggtgtttccgctctgaagactgcgacgcgggctccgatgcagctcgctccctgccggatgggtcatgggattctaaacatgaggcagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaatttaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaagaaaaaaaaaaaaaaaaaaaaaca

SEQ ID NO: 26076 - DNA, 6066 bp, Homo sapiens
  misc_feature (1)..(2): n is a, c, g, or t
nnctgaagtgttagtatgtagtggagctggtggtgtgaagctgattcattttgtttcaaagccccaaatggcatgctgccgaacacaggcacaagcacagcagcgtctccttagaaataatgactccaaggcaaacagccctcattgcaaaatgtagaagactgccatctgcttgtctccactgtggtttattcgtttcagggttttaaatgacgtaataaaaagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacacatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaatttaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaagaaaaaaaaaaaaaaaaaaaaaca

SEQ ID NO: 26077 - DNA, 6078 bp, Homo sapiens
gagaactgatttgaaataagagccaggcggtcctcgcttccctgcgaccgacttttcataggctgggggagaaaaggttgagaaacttgacattgtctcgagcagagtgcgtgtagcaacagatcaaagaaaaagaggacgaaaacgtgctctttgctgcccgtagatttcgccgggttgcttttgtcttgcgggctcctgtcgggttcggtgtttccgctctgaagactgcgacgcgggctccgatgcagctcgctccctgccggatgggtcatgggattctaaacatgaggcagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaatttaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaagaaaaaaaaaaaaaaaaaaaaaca

SEQ ID NO: 26078 - DNA, 475 bp, Homo sapiens
gagctccagtacaccatattcaccggacaagccaacgtcgttagtgagtatctcatggcctatttatttctgtctttggtggctttcttcagattgattgcattcctgaatttaaacttcaaaggaagacaaggaaggaaagaacacacaatatttattgacttgtctttcttgaacaaaaaagtgatagcactcacttgtactacattagtaaaaacagctggctaaatattgatgaaaattaatgacctctagcaaaccacatggatgttaagggaaagaagccagaaacaaatatatagagagaaacaaatatatagagagatacatagagagagaaacaaatatatatatatagtattaatccacatataggttcataacttaaagatcaaaataaactattttgcttaaagaaacattcataggtgttaaaactataaaccctgggcaacctggtgaaaccccatctcta

SEQ ID NO: 26079 - DNA, 3423 bp, Homo sapiens
tcgtagaactagggctgcaggaattgcgccgcgtcgacaaacccccatcctgggaaaaatggggaagctgatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaaaaaaggtatgtctgaccacccattcccatcatggcctgagctagtgtttcaggtttactttagaatgctcttggccaagtggaagggtcgattcagttggttgtgtgcttagaattttatttttgacttacatagactatcagctgcttcatgtcacatctcatgcttctcttatgttgcccagttttctcagtgcttccgactgcatgtttttgtactatatgaaaagccttctttctagaagactaccaattaaatatttctttagaaaaatgtaaaaaaaaaagtcgacgcggccgcgaattcgat

SEQ ID NO: 26080 - DNA, 5944 bp, Homo sapiens
tcgtagaactagggctgcaggaattgcgccgcgtcgacaaacccccatcctgggaaaaatggggaagctgatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaatttaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaaga

SEQ ID NO: 26081 - DNA, 6121 bp, Homo sapiens
  misc_feature (1)..(2): n is a, c, g, or t
nnctgaagtgttagtatgtagtggagctggtggtgtgaagctgattcattttgtttcaaagccccaaatggcatgctgccgaacacaggcacaagcacagcagcgtctccttagaaataatgactccaaggcaaacagccctcattgcaaaatgtagaagactgccatctgcttgtctccactgtggtttattcgtttcagggttttaaatgacgtaataaaaagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaatttaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaagaaaaaaaaaaaaaaaaaaaaaca

SEQ ID NO: 26082 - DNA, 3499 bp, Homo sapiens
gagaactgatttgaaataagagccaggcggtcctcgcttccctgcgaccgacttttcataggctgggggagaaaaggttgagaaacttgacattgtctcgagcagagtgcgtgtagcaacagatcaaagaaaaagaggacgaaaacgtgctctttgctgcccgtagatttcgccgggttgcttttgtcttgcgggctcctgtcgggttcggtgtttccgctctgaagactgcgacgcgggctccgatgcagctcgctccctgccggatgggtcatgggattctaaacatgaggcagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagacca

SEQ ID NO: 26083 - DNA, 4222 bp, Homo sapiens
tcgtagaactagggctgcaggaattgcgccgcgtcgacaaacccccatcctgggaaaaatggggaagctgatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaca

SEQ ID NO: 26084 - DNA, 4268 bp, Homo sapiens
attcggcacaggggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacacatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaatttaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaagaaaaaaaaaaaaaaaaaaaaaca

SEQ ID NO: 26085 - DNA, 377 bp, Homo sapiens
  misc_feature (312)..(312): n is a, c, g, or t
  misc_feature (355)..(355): n is a, c, g, or t
  misc_feature (370)..(370): n is a, c, g, or t
attgtgggtgacaggagcagtgttttcctgctggacccgcaagccaccagctatttcctggtgacacaagctcttctcaggcggggctgcctgcaggctcccgttttctgagcccacgctgcccacagctgaccccagcgcagccccgggcacgcggcactttacatgggggcagcttgggcccagactcctccgctgtgtagcagatgaggaaaatcaggccagaggacaacaggctggcgttttgttgggaactgaagaggaatctgttgaacacagcgaccagatgaccttccatttcaccggcggcanagttttcagcgtgcagttcccaaaccccaaagctgaaccctgngccccatttgaatanggccaga

SEQ ID NO: 26086 - DNA, 360 bp, Homo sapiens
aattgtcagtgtccactatttggaaattctatgagcagtcagctgtctacagatacttgagtgccttttttttttttgctttacagatgcccgcctttattttttaaaatagctttagtgatgtaattcacataccttacagttcacccatttaaaatgtgtaattaggcctgggcagcatagggagacggccctcccatgtttctacaaaaaaaattttttttaagtgaaatcagcgtgtgcctgtagtcccaggtacttggaggcagaggtgagaggatcacttgagcccaggagttccaggctgcagtgagccgtgattgtgccactgtactcccgtctgggtgacagagaccggtc

SEQ ID NO: 26087 - DNA, 848 bp, Homo sapiens
tgtctagattgtcctccttcctccttcctattcatctatcccccacgatgttcatctttctgaagcatgtgtctgatcatacctctcctctgctcagaggttctcatcggttcccatctgtctagaaaataaaatgtgaacacttgaccttgatcaaaatcctttgtaatctgctgattacctacttctctacccttctcatttctctcttttacctaccctcatgcttgaatttcctgcctacttaacattgatcgctcttcacctttacacccctcacttaaaaccccagccctcactccccacacaaacgtggctcccagtgccctggtcaaaatctcactttccttcaagatccagccaagtccactgctgtcatgaagccttctctgattttccttttccacacctcttgcaggaaacaattcttcccttctctggactcctctagtattttacaatttcctccctgaaagcatttaatccccctcttgttctgagattattcacgcactcacctgagctcccaccacagtgattcagcatgtcatgagcagagccagtgagtgcttaacgtgtgctcaccagaagcacttagcgcagtgccttgcactgctcagcagctccatatttgtggaataaagcgtttgtttacttctccaaagtgtttattattccgaaaaggttaaatggctgtttttttttaaaaggtgttaacaaatttaagtatttatctctgaccaattttgaggaagaataaacctgttcatgtgttctaactcatcagagaatagaaatatgtttttgtgaaacttgtttttaacccaaggatttattgacaaaaaaaa

SEQ ID NO: 26088 - DNA, 328 bp, Homo sapiens
gatttgtgggtatagggagtatgcagcccacaaatttccccaggatccgttttcttgcctttaaaaaccaatgcgccaggcacagtggctcacgcctggaatccaagcactttgggaggctgaggtggttgaatcactcgaggtcaggggttcaagaccagtctgaccaacatggtgaaaccccgtctctacaaaaatacaaaagattaactgggcgtggtggcacgtgcctgtaatcccagctactctggaggctgaggcagaagaatcgcttgaaccttggggcggatgttgcagtgagccaagatcatgccattgcactctagac

SEQ ID NO: 26089 - DNA, 371 bp, Homo sapiens
agaaaacaaaacaataatggccattaaacaaaaatacatgatgtagcttgctaaataatttatgggctttttggaagtgttttgggcagatttcaacctaacattactcttatttcctattcttttccttatagaatggagtatcatgataactaggtactaagtcaagtcaacagtgggccaagttgcctctgtggaatttaagctttacatgaagagagacttaagtatatttagtccttggtggtagaactctttagtgtgaagtcaagtagttgcttttgtagctttgattcaaagaagccaaaatcaaatgctatggggcctggaacatggtgaaagtggactatctggcactgaaacttggaaac

SEQ ID NO: 26090 - DNA, 338 bp, Homo sapiens
aggagaactttcttcaaaaagtttaacttttctcacagggttcgcttatgcaacaaattccccaagaatatttgaaaggcctcatgtgctcaaatgtgacaaacgggtctcactctgtcatccaggctggagtgcagtgatgtgatcattgttcactgtaccctcaattttccaagctcaagtcatcctcccgcctcagcctcccaagcagctgagactacaagtacgcaccaccacgtccagctaaattttttaaaatttattattttttttgatatggagttttgctcttgttgcccaggctggagtgcaatggcacgatctcagctcactgtaac

SEQ ID NO: 26091 - DNA, 230 bp, Homo sapiens
taaaaaactgtcatgtttaattgttccagaactagtcactagtagtgtcatcttcttgctagtgcatggcctttcagattttatatctatctatatctatctatctatctatatatatgttgacatatatgattttcaaattacacacatatatacacacatacacacccctttatatgtatgtcctggatcatgattgcaaaatggaattctgactggggttacagtaa

SEQ ID NO: 26092 - DNA, 732 bp, Homo sapiens
  misc_feature (2)..(2): n is a, c, g, or t
cngtccggaattcccgggatcgtccagccgccgagcagggtgcttgagtgtctctgcagaaaagactccaggaccccgccaccatgttcccggagcccccaaccccggggcctccatcgcccgacacgcctcccgactccagtcgcatcagccacggcccagtgcccccctgggccctggccaccatcgtgctggtctcaggcctcctcatcttcagctgctgtttctgtctctaccggaagagctgtcggaggcggacaggcaagaagagccaggcccaagcccaggtccaccttcaggaagtgaaggggctgggccagagttacatagacaaggtgcagccagaagtagaggagctggagccagcaccatccgggccagggcagcaggtggcagacaagcatgagctaggacgactgcagtactccctggattatgacttccagagtggccagctgctggtgggcattctgcaagcaatgggattggcagccttggatcttggtggctcctcggacccctatgtgcgggtctacctgctgccggacaaacggaggcggtacgagaccaaggtgcatcggcagacgctgaaccctcactttggggagaccttcgccttcaaggtcccctacggtggagctggggggcagggctgcctgctctggccgcgtgtccgacttcccgccgctccctccccccctgacgcccctcccgcgccgctccgcgctcccg

SEQ ID NO: 26093 - DNA, 1730 bp, Homo sapiens
tgctccgctccgcggctcccccgccccggagagctccgcgatcagcacccgggacagcgccaccgcccacgtgcagggggtggggtcctgggcggggctggcgcctcggcgtctcccgggagtgtcccgtccagccgccgagcagggtgcttgagtgtctctgcagaaaagactccaggaccccgccaccatgttcccggagcccccaaccccggggcctccatcgcccgacacgcctcccgactccagtcgcatcagccacggcccagtgcccccctgggccctggccaccatcgtgctggtctcaggcctcctcatcttcagctgctgtttctgtctctaccggaagagctgtcggaggcggacaggcaagaagagccaggcccaagcccaggtccaccttcaggaagtgaaggggctgggccagagttacatagacaaggtgcagccagaagtagaggagctggagccagcaccatccgggccagggcagcaggtggcagacaagcatgagctaggacgactgcagtactccctggattatgacttccagagtggccagctgctggtgggcattctgcaagcaatgggattggcagccttggatcttggtggctcctcggacccctatgtgcgggtctacctgctgccggacaaacggaggcggtacgagaccaaggtgcatcggcagacgctgaaccctcactttggggagaccttcgccttcaaggtcccctacgtggagctggggggcagggtgctggtcatggcggtgtacgacttcgaccgcttctctcgcaatgacgccatcggggaggtgcgggtccctatgagctccgtggacctggggcggccagtgcaggcctggcgggagctgcaggcggctccgcgggaggagcaggagaagcttggggacatctgcttctccctccgctatgtccccacggccgggaagctcaccgtcatcgtcctggaggctaaaaacctgaagaagatggacgtaggaggactgtcagatccatacgtcaaggtccacctgctgcagggcggcaaaaaggtgcggaagaagaaaaccaccatcaagaagaacactctgaacccctattacaacgaagctttcagcttcgaggtgccctgtgaccaagtccagaaggtgcaggtggagctgaccgtgctggactacgacaagctgggcaagaacgaggccatcgggagggtggccgtgggggcggccgccggcggggctggcctgcggcactgggcggacatgctggccaacccgcggcggcccattgcccagtggcactcgctgcggcccccggaccgagtgaggctgctgcctgcgccctgactcccaccccaagcccccggccaagcctggactctagcccctgaccccagactcccgagaccggccaaagccaagccagccccacccttaagcttcctctgacggttaccctccccccaccttccaccccaaccatctgaaccattcctgtcttctcacccccaacgatgccaatcacgacaactttccagcacactcccccgaccctcgcggacacacccagatgccccagggaccccgggaagggaaggcagcctggtttctcctgcccccgggtcctgccccctgctttgacaatcagccatcctcgtctgctctcctctctcttccaacacagcccatccctgcactgctcctggggccaaataaatattcagca

SEQ ID NO: 26094 - DNA, 2652 bp, Homo sapiens
tgctccgctccgcggctcccccgccccggagagctccgcgatcagcacccgggacagcgccaccgcccacgtgcagggggtggggtcctgggcggggctggcgcctcggcgtctcccgggagtgtcccgtccagccgccgagcaggtaggagctgctgggacccccgccctcagcccatccgcatccgcatccctagaggaaaggggtgtgcgagtgggggctggggcactggggagacaaccagagggagggcagcagcctgaagcggagagacagggatctggggacgcgagacaggtatggagaagacaaagagccgagggcggggagtggggcgcaggcggaggggagagggagagaccctggagacagaggccaggcgatagggaagagagacaggcgggttggggaggcagacacagggaagacgcctatgtggggtcaagaggcagcgtggagaccgaggcggtcacgagagcagcacggatgcgtggagagaccaacaggccaagaaggatgagggggctcagcacaggcaccgggcagcccccgacccgccctccagcaaaattggggagagggaagagggaacctgcgtctcagctcccaggaccaggtgcggagggagcagtcggctgtgggcgctcggaccacaggctgcccgctccccacctcgcgggacctcaggatcccagtcgggctattggggggttcccaggcaccggtgggccccggagcgagcctgccccgccgggactccgcgtctgtgcgtcagccccgcccgttgtcctggcaacaacccgttgcccgggcaaccagctttgctctcaccccgcttgagaggagcccggctgttgctctgggcaacgcggtctgctggttcccacgtctgccttcgcccgcttccggttcagaccctgcggaggggcgaggacgaggcagaagtcagcgggatgcctgtggggccgtggaggaagagggtatccctttaggatggaactaggtcctggacaccccctctcaagtgcggggaggctgatactacaactcccagcatgactcgcggtggctgtccggtttctgcgcggctgttcgcgcaaaggcctcatgggagttggagttctttgttgtgcgtggggctcaaaggacgtctggggtgggaatgggggactagggtgcttgagtgtctctgcagaaaagactccaggaccccgccaccatgttcccggagcccccaaccccggggcctccatcgcccgacacgcctcccgactccagtcgcatcagccacggcccagtgcccccctgggccctggccaccatcgtgctggtctcaggcctcctcatcttcagctgctgtttctgtctctaccggaagagctgtcggaggcggacaggcaagaagagccaggcccaagcccaggtccaccttcaggaagtgaaggggctgggccagagttacatagacaaggtgcagccagaagtagaggagctggagccagcaccatccgggccagggcagcaggtggcagacaagcatgagctaggacgactgcagtactccctggattatgacttccagagtggccagctgctggtgggcattctgcaagcaatgggattggcagccttggatcttggtggctcctcggacccctatgtgcgggtctacctgctgccggacaaacggaggcggtacgacttcgaccgcttctctcgcaatgacgccatcggggaggtgcgggtccctatgagctccgtggacctggggcggccagtgcaggcctggcgggagctgcaggcggctccgcgggaggagcaggagaagcttggggacatctgcttctccctccgctatgtccccacggccgggaagctcaccgtcatcgtcctggaggctaaaaacctgaagaagatggacgtaggaggactgtcagatccatacgtcaaggtccacctgctgcagggcggcaaaaaggtgcggaagaagaaaaccaccatcaagaagaacactctgaacccctattacaacgaagctttcagcttcgaggtgccctgtgaccaagtccagaaggtgcaggtggagctgaccgtgctggactacgacaagctgggcaagaacgaggccatcgggagggtggccgtgggggcggccgccggcggggctggcctgcggcactgggcggacatgctggccaacccgcggcggcccattgcccagtggcactcgctgcggcccccggaccgagtgaggctgctgcctgcgccctgactcccaccccaagcccccggccaagcctggactctagcccctgaccccagactcccgagaccggccaaagccaagccagccccacccttaagcttcctctgacggttaccctccccccaccttccaccccaaccatctgaaccattcctgtcttctcacccccaacgatgccaatcacgacaactttccagcacactcccccgaccctcgcggacacacccagatgccccagggaccccgggaagggaaggcagcctggtttctcctgcccccgggtcctgccccctgctttgacaatcagccatcctcgtctgctctcctctctcttccaacacagcccatccctgcactgctcctggggccaaataaatattcagca

SEQ ID NO: 26095 - DNA, 814 bp, Homo sapiens
tgagggttcatttccttagaaacctggctgcgcaggaagaaaggcgccagagcctcctcctcgccgcaggctccgtccctctcgtctcccaccccctcccccgtcccgagctccggggccccgagccctcgggtggcagcgagaggtaccctcagccgtgaaaacggacaccgccccttccggggcctcctcccctcacgctcctctctcctcttcctcccgcgcccaccccagaaggtgcaggtggagctgaccgtgctggactacgacaagctgggcaagaacgaggccatcgggagggtggccgtgggggcggccgccggcggggctggcctgcggcactgggcggacatgctggccaacccgcggcggcccattgcccagtggcactcgctgcggcccccggaccgagtgaggctgctgcctgcgccctgactcccaccccaagcccccggccaagcctggactctagcccctgaccccagactcccgagaccggccaaagccaagccagccccacccttaagcttcctctgacggttaccctccccccaccttccaccccaaccatctgaaccattcctgtcttctcacccccaacgatgccaatcacgacaactttccagcacactcccccgaccctcgcggacacacccagatgccccagggaccccgggaagggaaggcagcctggtttctcctgcccccgggtcctgccccctgctttgacaatcagccatcctcgtctgctctcctctctcttccaacacagcccatccctgcactgctcctggggccaaataaatattcagca

SEQ ID NO: 26096 - DNA, 2760 bp, Homo sapiens
tgctccgctccgcggctcccccgccccggagagctccgcgatcagcacccgggacagcgccaccgcccacgtgcagggggtggggtcctgggcggggctggcgcctcggcgtctcccgggagtgtcccgtccagccgccgagcaggtaggagctgctgggacccccgccctcagcccatccgcatccgcatccctagaggaaaggggtgtgcgagtgggggctggggcactggggagacaaccagagggagggcagcagcctgaagcggagagacagggatctggggacgcgagacaggtatggagaagacaaagagccgagggcggggagtggggcgcaggcggaggggagagggagagaccctggagacagaggccaggcgatagggaagagagacaggcgggttggggaggcagacacagggaagacgcctatgtggggtcaagaggcagcgtggagaccgaggcggtcacgagagcagcacggatgcgtggagagaccaacaggccaagaaggatgagggggctcagcacaggcaccgggcagcccccgacccgccctccagcaaaattggggagagggaagagggaacctgcgtctcagctcccaggaccaggtgcggagggagcagtcggctgtgggcgctcggaccacaggctgcccgctccccacctcgcgggacctcaggatcccagtcgggctattggggggttcccaggcaccggtgggccccggagcgagcctgccccgccgggactccgcgtctgtgcgtcagccccgcccgttgtcctggcaacaacccgttgcccgggcaaccagctttgctctcaccccgcttgagaggagcccggctgttgctctgggcaacgcggtctgctggttcccacgtctgccttcgcccgcttccggttcagaccctgcggaggggcgaggacgaggcagaagtcagcgggatgcctgtggggccgtggaggaagagggtatccctttaggatggaactaggtcctggacaccccctctcaagtgcggggaggctgatactacaactcccagcatgactcgcggtggctgtccggtttctgcgcggctgttcgcgcaaaggcctcatgggagttggagttctttgttgtgcgtggggctcaaaggacgtctggggtgggaatgggggactagggtgcttgagtgtctctgcagaaaagactccaggaccccgccaccatgttcccggagcccccaaccccggggcctccatcgcccgacacgcctcccgactccagtcgcatcagccacggcccagtgcccccctgggccctggccaccatcgtgctggtctcaggcctcctcatcttcagctgctgtttctgtctctaccggaagagctgtcggaggcggacaggcaagaagagccaggcccaagcccaggtccaccttcaggaagtgaaggggctgggccagagttacatagacaaggtgcagccagaagtagaggagctggagccagcaccatccgggccagggcagcaggtggcagacaagcatgagctaggacgactgcagtactccctggattatgacttccagagtggccagctgctggtgggcattctgcaagcaatgggattggcagccttggatcttggtggctcctcggacccctatgtgcgggtctacctgctgccggacaaacggaggcggtacgagaccaaggtgcatcggcagacgctgaaccctcactttggggagaccttcgccttcaaggtcccctacgtggagctggggggcagggtgctggtcatggcggtgtacgacttcgaccgcttctctcgcaatgacgccatcggggaggtgcgggtccctatgagctccgtggacctggggcggccagtgcaggcctggcgggagctgcaggcggctccgcgggaggagcaggagaagcttggggacatctgcttctccctccgctatgtccccacggccgggaagctcaccgtcatcgtcctggaggctaaaaacctgaagaagatggacgtaggaggactgtcagatccatacgtcaaggtccacctgctgcagggcggcaaaaaggtgcggaagaagaaaaccaccatcaagaagaacactctgaacccctattacaacgaagctttcagcttcgaggtgccctgtgaccaagtccagaaggtgcaggtggagctgaccgtgctggactacgacaagctgggcaagaacgaggccatcgggagggtggccgtgggggcggccgccggcggggctggcctgcggcactgggcggacatgctggccaacccgcggcggcccattgcccagtggcactcgctgcggcccccggaccgagtgaggctgctgcctgcgccctgactcccaccccaagcccccggccaagcctggactctagcccctgaccccagactcccgagaccggccaaagccaagccagccccacccttaagcttcctctgacggttaccctccccccaccttccaccccaaccatctgaaccattcctgtcttctcacccccaacgatgccaatcacgacaactttccagcacactcccccgaccctcgcggacacacccagatgccccagggaccccgggaagggaaggcagcctggtttctcctgcccccgggtcctgccccctgctttgacaatcagccatcctcgtctgctctcctctctcttccaacacagcccatccctgcactgctcctggggccaaataaatattcagca

SEQ ID NO: 26097 - DNA, 2587 bp, Homo sapiens
tgctccgctccgcggctcccccgccccggagagctccgcgatcagcacccgggacagcgccaccgcccacgtgcagggggtggggtcctgggcggggctggcgcctcggcgtctcccgggagtgtcccgtccagccgccgagcaggtaggagctgctgggacccccgccctcagcccatccgcatccgcatccctagaggaaaggggtgtgcgagtgggggctggggcactggggagacaaccagagggagggcagcagcctgaagcggagagacagggatctggggacgcgagacaggtatggagaagacaaagagccgagggcggggagtggggcgcaggcggaggggagagggagagaccctggagacagaggccaggcgatagggaagagagacaggcgggttggggaggcagacacagggaagacgcctatgtggggtcaagaggcagcgtggagaccgaggcggtcacgagagcagcacggatgcgtggagagaccaacaggccaagaaggatgagggggctcagcacaggcaccgggcagcccccgacccgccctccagcaaaattggggagagggaagagggaacctgcgtctcagctcccaggaccaggtgcggagggagcagtcggctgtgggcgctcggaccacaggctgcccgctccccacctcgcgggacctcaggatcccagtcgggctattggggggttcccaggcaccggtgggccccggagcgagcctgccccgccgggactccgcgtctgtgcgtcagccccgcccgttgtcctggcaacaacccgttgcccgggcaaccagctttgctctcaccccgcttgagaggagcccggctgttgctctgggcaacgcggtctgctggttcccacgtctgccttcgcccgcttccggttcagaccctgcggaggggcgaggacgaggcagaagtcagcgggatgcctgtggggccgtggaggaagagggtatccctttaggatggaactaggtcctggacaccccctctcaagtgcggggaggctgatactacaactcccagcatgactcgcggtggctgtccggtttctgcgcggctgttcgcgcaaaggcctcatgggagttggagttctttgttgtgcgtggggctcaaaggacgtctggggtgggaatgggggactagggtgcttgagtgtctctgcagaaaagactccaggaccccgccaccatgttcccggagcccccaaccccggggcctccatcgcccgacacgcctcccgactccagtcgcatcagccacggcccaggtgcagccagaagtagaggagctggagccagcaccatccgggccagggcagcaggtggcagacaagcatgagctaggacgactgcagtactccctggattatgacttccagagtggccagctgctggtgggcattctgcaagcaatgggattggcagccttggatcttggtggctcctcggacccctatgtgcgggtctacctgctgccggacaaacggaggcggtacgagaccaaggtgcatcggcagacgctgaaccctcactttggggagaccttcgccttcaaggtcccctacgtggagctggggggcagggtgctggtcatggcggtgtacgacttcgaccgcttctctcgcaatgacgccatcggggaggtgcgggtccctatgagctccgtggacctggggcggccagtgcaggcctggcgggagctgcaggcggctccgcgggaggagcaggagaagcttggggacatctgcttctccctccgctatgtccccacggccgggaagctcaccgtcatcgtcctggaggctaaaaacctgaagaagatggacgtaggaggactgtcagatccatacgtcaaggtccacctgctgcagggcggcaaaaaggtgcggaagaagaaaaccaccatcaagaagaacactctgaacccctattacaacgaagctttcagcttcgaggtgccctgtgaccaagtccagaaggtgcaggtggagctgaccgtgctggactacgacaagctgggcaagaacgaggccatcgggagggtggccgtgggggcggccgccggcggggctggcctgcggcactgggcggacatgctggccaacccgcggcggcccattgcccagtggcactcgctgcggcccccggaccgagtgaggctgctgcctgcgccctgactcccaccccaagcccccggccaagcctggactctagcccctgaccccagactcccgagaccggccaaagccaagccagccccacccttaagcttcctctgacggttaccctccccccaccttccaccccaaccatctgaaccattcctgtcttctcacccccaacgatgccaatcacgacaactttccagcacactcccccgaccctcgcggacacacccagatgccccagggaccccgggaagggaaggcagcctggtttctcctgcccccgggtcctgccccctgctttgacaatcagccatcctcgtctgctctcctctctcttccaacacagcccatccctgcactgctcctggggccaaataaatattcagca

SEQ ID NO: 26098 - DNA, 864 bp, Homo sapiens
ggggctctggtgatgggcccctctcctttcagcaggagaagcttggggacatctgcttctccctccgctatgtccccacggccgggaagctcaccgtcatcgtcctggaggctaaaaacctgaagaagatggacgtaggaggactgtcagatccatacgtcaaggtccacctgctgcagggcggcaaaaaggtgcggaagaagaaaaccaccatcaagaagaacactctgaacccctattacaacgaagctttcagcttcgaggtgccctgtgaccaagtccagaaggtgcaggtggagctgaccgtgctggactacgacaagctgggcaagaacgaggccatcgggagggtggccgtgggggcggccgccggcggggctggcctgcggcactgggcggacatgctggccaacccgcggcggcccattgcccagtggcactcgctgcggcccccggaccgagtgaggctgctgcctgcgccctgactcccaccccaagcccccggccaagcctggactctagcccctgaccccagactcccgagaccggccaaagccaagccagccccacccttaagcttcctctgacggttaccctccccccaccttccaccccaaccatctgaaccattcctgtcttctcacccccaacgatgccaatcacgacaactttccagcacactcccccgaccctcgcggacacacccagatgccccagggaccccgggaagggaaggcagcctggtttctcctgcccccgggtcctgccccctgctttgacaatcagccatcctcgtctgctctcctctctcttccaacacagcccatccctgcactgctcctggggccaaataaatattcagca

SEQ ID NO: 26099 - DNA, 1672 bp, Homo sapiens
ggcacgaggccagaatgctggagcgtaggtgaaaggacaaaagccagacacatttcaacatgagggacccactgacagattgtccgtataataaagtatacaagaacctaaaggagttttctcaaaatggagagaatttctgcaaacaggtcacatctgttcttcagcaaagggcaaacctggaaattagctatgccaaaggacttcagaaactggcaagcaagctgagcaaagcattacagaacacgagaaaaagttgtgttagcagtgcctgggcctgggcctcagagggaatgaaatccacagcggacctgcatcaaaaacttggcaaagcaattgaattggaagcaataaaaccgacttatcaagtcctaaatgtacaagagaagaagagaaaatcacttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccagagcattctggagctggagaaggaaagaattcaacttttatgcaataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgaagaagatcctaacagtgcaatggataaagagagacgaaagtctttactaaaaccaaaattattgagactgcagagagacattgaaaaagcctcaaaagacaaggaaggcctggaacgaatgcttaaaacgtactccagcacctcctccttctctgatgcaaagagccagaaagacacagcagcgttaatggatgagaacaatttgaaactagaccttttggaagcgaactcctacaaactgtcatcaatgttagcagaacttgagcaaagacctcaacccagccatccttgtagtaattccatcttcaggtggagggaaaaggagcatactcatagctatgtgaaaatatctcggccttttttaatgaagagattagagaatattgtgagcaaggcatcttctggtgggcagagcaatccaggttcttcaactccagcccctggtgcagcccagctcagcagcagactttgcaaggccttgtattcttttcaagccaggcaagatgatgagttgaatttggaaaagggtgacattgtgattatacacgagaaaaaagaagaaggatggtggtttggatctttgaatgggaaaaaaggccattttcctgccgcttatgtggaggagttaccttcaaatgctggcaacacagctacaaaggcataaaacaagactctgaacatactaccttcacactcggtaatcaacaatacagtgtggttcaaataagaataaagtgctcttacctttaaaaaaaa

SEQ ID NO: 26100 - DNA, 1708 bp, Homo sapiens
ggcacgaggccagaatgctggagcgtaggtgaaaggacaaaagccagacacatttcaacatgagggacccactgacagattgtccgtataataaagtatacaagaacctaaaggagttttctcaaaatggagagaatttctgcaaacaggtcacatctgttcttcagcaaagggcaaacctggaaattagctatgccaaaggacttcagaaactggcaagcaagctgagcaaagcattacagaacacgagaaaaagttgtgttagcagtgcctgggcctgggcctcagagggaatgaaatccacagcggacctgcatcaaaaacttggcaaagcaattgaattggaagcaataaaaccgacttatcaagtcctaaatgtacaagagaagaagagaaaatcacttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccagagcattctggagctggagaaggaaagaattcaacttttatgcaataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgaagaagatcctaacagtgcaatggataaagagagacgaaagtctttactaaaaccaaaattattgagactgcagagagacattgaaaaagcctcaaaagacaaggaaggcctggaacgaatgcttaaaacgtactccagcacctcctccttctctgatgcaaagagccagaaagacacagcagcgttaatggatgagaacaatttgaaactagaccttttggaagcgaactcctacaaactgtcatcaatgttagcagaacttgagcaaagacctcaacccagccatccttgtagtaattccatcttcaggtggagggaaaaggagcatactcatagctatgtgaaaatatctcggccttttttaatgaagagattagagaatattgtgagcaaggcatcttctggtgggcagagcaatccaggttcttcaactccagcccctggtgcagcccagctcagcagcagactttgcaaggccttgtattcttttcaagccaggcaagatgatgagttgaatttggaaaagggtgacattgtgattatacacgagaaaaaagaagaaggatggtggtttggatctttgaatgggaaaaaaggccattttcctgccgcttatgtggaggagttaccttcaaatgctggcaacacagctacaaaggcataaaacaagactctgaacatactaccttcacactcggtaatcaacaatacagtgtggttcaaataagaagtagatggatgatgttcctttttagaagtagtcattaaaataggtgcaacaaccaagaaaaa

SEQ ID NO: 26101 - DNA, 1560 bp, Homo sapiens
ggcacgaggccagaatgctggagcgtaggtgaaaggacaaaagccagacacatttcaacatgagggacccactgacagattgtccgggcaaacctggaaattagctatgccaaaggacttcagaaactggcaagcaagctgagcaaagcattacagaacacgagaaaaagttgtgttagcagtgcctgggcctgggcctcagagggaatgaaatccacagcggacctgcatcaaaaacttggcaaagcaattgaattggaagcaataaaaccgacttatcaagtcctaaatgtacaagagaagaagagaaaatcacttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccagagcattctggagctggagaaggaaagaattcaacttttatgcaataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgaagaagatcctaacagtgcaatggataaagagagacgaaagtctttactaaaaccaaaattattgagactgcagagagacattgaaaaagcctcaaaagacaaggaaggcctggaacgaatgcttaaaacgtactccagcacctcctccttctctgatgcaaagagccagaaagacacagcagcgttaatggatgagaacaatttgaaactagaccttttggaagcgaactcctacaaactgtcatcaatgttagcagaacttgagcaaagacctcaacccagccatccttgtagtaattccatcttcaggtggagggaaaaggagcatactcatagctatgtgaaaatatctcggccttttttaatgaagagattagagaatattgtgagcaaggcatcttctggtgggcagagcaatccaggttcttcaactccagcccctggtgcagcccagctcagcagcagactttgcaaggccttgtattcttttcaagccaggcaagatgatgagttgaatttggaaaagggtgacattgtgattatacacgagaaaaaagaagaaggatggtggtttggatctttgaatgggaaaaaaggccattttcctgccgcttatgtggaggagttaccttcaaatgctggcaacacagctacaaaggcataaaacaagactctgaacatactaccttcacactcggtaatcaacaatacagtgtggttcaaataagaa

SEQ ID NO: 26102 - DNA, 313 bp, Homo sapiens
aattgaggtaaaaagttgttggaaagtattagaactacagaggattgagtagatttttaaaacacaggaaacaagtagaacttagaaatgatgtaacagttaagtggaagagtttggcgagctaaattttcatctcttagagtagggagtcagtggacaccaagatagtacatttcaaaataggcacataagaatattatttagcttattctttagaattaaaaagagaaaagttcaatgtgcttctagggagggcaagtgttgaattttttttatcatgtactgtactatttcattttttattatgtacaca

SEQ ID NO: 26103 - DNA, 155 bp, Homo sapiens
cgaaggagaggggcagccgcaaattagaccttcttcctgggggctcaggccagtagggactgtccgtggtgcccttccctttctttctcctcctgaacgagagccaacgctgccccttcccaggactggatctgagccaaccaaatcctacagcg

SEQ ID NO: 26104 - DNA, 176 bp, Homo sapiens
ctgctgtgtcctgccctgtcctgccccactccacctcgttctccctcccctccttaactcttcccttccttccccataggtaatgactggcaataattttgtgtgtatattgtgtgtacatttgtgtgtatatccttccagaaatttttggcgcatttatatacacagtacatatg

SEQ ID NO: 26105 - DNA, 444 bp, Homo sapiens
tagacagagtctcaatggcatgatcttggctcactgcaacctccgcctcatgggttcaagtaattctcctgcctcagcctcccaagtagttaggattacaggtgtgtgccaccacacctggctaatttttgtacttttagtagagacgggttgcaccatgttggccaggctggtctcgaactcctagcctcaagtgatctgcccacctcagcgtcccaaagtgctgggattacaggcatgggccaccacacctgactgcacgtgctctttctcatttacacgctctctcttgaacacacacacatacactttattccaatagactcaggagacaaaaattatcaatgttacacaaaataacagttgtcacaataataaaccattggctttcgtttttaaaagaaaatgctttgcgaacttcacagtgataaaagtactctaatg

SEQ ID NO: 26106 - DNA, 452 bp, Homo sapiens
cggcatactgcaacctctgactcccgggttcaagcagttctcctgcctcagcctcccaaatagctgggaatacaggcgcgtgccactacgcccagctaatttttgtatttttagtagagacggggttttgccatattgggcaggatggtcttgatctcttgacctcgtgatccgtctgcctcagcctcccaaagtgctgggattacaggcgtgagacaccgcgcccggatgtattatacatatttacataattgaagtaatgttatatgttttataaccaataatttatctgtcaacattacgttggtctatataatttatacttttttccatgttagtaagaatccttcaaacaatgtaatgaatttaattacacccccattattaggatactttcagtatttttcctaatgttaattatttttttccttttttctgagtctgcttgctag

SEQ ID NO: 26107 - DNA, 551 bp, Homo sapiens
  misc_feature (547)..(550): n is a, c, g, or t
ggttgcaatgagccgagatcacgctgttgcactccagcctgggcgacagagtgagactccatctcaaataaagaaagaaagaaggaaggaaagaaggaaggaaggaagagaaagagaaaggaaggaaggaaggaaggaaggaaggaaggaaggaaggaaggacacgaaagcaagcaagcaggcagcatccgtttagtgaccgtgctgaccatcgccagcacttgaaccagcctgggttgggggttatgattactggacttctgtgctgcccagttccaccacacccctactgtgcctttccttttcttcaggttcctgagctccctgtatatatcctagaatggttaaaaatgttaaactgtcaataccaggtgttattgaagatgcagagcaactggaacactcagacactgcttgtgggaatgtaaataggaacaaacacttcgaaaattctttgtcagtgttgactgtaaatatacccaatgacagtaattctactctgaaatatacgcccaagagtaaatacactaaaaaatgatataaaaannnna

SEQ ID NO: 26108 - DNA, 707 bp, Homo sapiens
  misc_feature (703)..(706): n is a, c, g, or t
ggttgcaatgagccgagatcacgctgttgcactccagcctgggcgacagagtgagactccatctcaaataaagaaagaaagaaggaaggaaagaaggaaggaaggaagagaaagagaaaggaaggaaggaaggaaggaaggaaggaaggaaggaaggaaggacacgaaagcaagcaagcaggcagcacctatcagaataagtcatccatgtgggaagggggtgaggggctactctctggcattaactttccatttctcccccaaaagctcagagcctgccctgtcctcagacactgaggtggagagagctgaactcctccaggctctcccttggggatttgcatccgtttagtgaccgtgctgaccatcgccagcacttgaaccagcctgggttgggggttatgattactggacttctgtgctgcccagttccaccacacccctactgtgcctttccttttcttcaggttcctgagctccctgtatatatcctagaatggttaaaaatgttaaactgtcaataccaggtgttattgaagatgcagagcaactggaacactcagacactgcttgtgggaatgtaaataggaacaaacacttcgaaaattctttgtcagtgttgactgtaaatatacccaatgacagtaattctactctgaaatatacgcccaagagtaaatacactaaaaaatgatataaaaannnna

SEQ ID NO: 26109 - DNA, 540 bp, Homo sapiens
  misc_feature (533)..(534): n is a, c, g, or t
  misc_feature (537)..(540): n is a, c, g, or t
gtgaagacgagaagaaggcaactgtctccaatccagacggagatgccaggcacagcccttctgtcacaaccctcagaaggaaccaaccctgccgacaccttggccttgtacttctggcctccagaaccgcaggaaagtacatttctgttgcttaggccgctcagcctgtggcactttgttacagcttctcacccagttcaggcccttttaattgattgctgggcctttgcagttgtttttgcttctaatatattcatctctcaatttatttctggaggctgccacccgaggggcagaacttcaattgtgtccctaatgggaaaccttgctgggatcatgtggtctacagcacaaggttgctaaagcatcttctgccagaattctgtgagtatctggttaggtgggtctggaatatactgagtttaaaaaagttaaataggtttctttactgcaagatgtttcagagactttaatatgctactctgctgtatgaatctccaggcaggaaatcttataaaatgtgtttctgaaannaannnn

SEQ ID NO: 26110 - DNA, 428 bp, Homo sapiens
cctggctgggtacggtggcctgtagtctcagccactcaggaggctgaggcaggaagatcacttgagcccaggagtttaaggctgcagtgagctatgattgcaccactgcattccagcctgggccacagggtgagacgctgtctcaaaaacagaatttgcattcctagtgctgctggtccagggacctcactttgagaaccactacttaaacaaggtggaaagttaccatttcacctaatgtagagaggccagaggtagggaggactccagacaatacaagttggagctcgtgtgcttcagttgtttctttggctactgtttgcctctgacaaggccaggcttcagggcaggtgttcgaggtgctttgtgatcccagcgtttggcaggggctgaagtgagaggatcacttgagcccagaaggttgaggc

SEQ ID NO: 26111 - DNA, 1954 bp, Homo sapiens
ataagtagatactctctgttccctcatctgtagattttttctgtgtgtgccatttagtaaggtaagattgaggtttgctctctgagaactaatgtagcatttaactctcctctaatgtggcatatagtaagaatccagtaaatcacaggtagtaatagttataatatggaaaaataggccttcgggggccatagttgagcaataccatttattactaggtaatgtatcctggatgcttctttggaaaggagtgattccttatggctggtgactcatgctctgttctcttggaagggtctttaggaagtggaaggtgtcgtgtcccatccttcacttgtctatctcacctgctttccctgcctgtatgccacctctgactttgctttcctaccacgtggcctggtcctggacatatgtggtgtttgcagcaaacagaagtctaaaaattttgaaggagggcccagccctacttctgccacttatcagacctgaattatgtggacactgctgggtttctttaaaataacttcagatctggtcttgaatggatcaagaaagattttcttaataaaacaaacaaaaacagcaatcctgtcctttatgaatttacttgttttggaaaacttaatttccacattggacaagagaaaaggtgaatcccggtaggtgagggcacaacctgggtatcactctcctctctagtgacacaagggtcaccctttgtcaccctcacctgtcaataccctcttacattttagaatttttctggcattcaaaaccttcaaattttaaaatcagaaccctgttctccagctaacacatccagattttccaacttcctgcatttttgtcttgcaggttattttatagtgcctgcttaaaacaggcaataatctattgatatcatagaaaatttagagtttgattgctctgcctatggagtagccattctttattcctttactttcttaataaacttgctttcacttaaaaaaagaaaactccaccttcatttataagtattttaagaaacaacctgttccttcattaattggacattattgactattttaaaacaaacatacagggtaatcttcccccagcaccgcccccagcagtcaccagcgagcctaatcatgttttggttcttttacacggaagtattttacatgaatggcaaacttacgttggatcagatggaaaaactttactagaaggagggctgtgtccaaactcttacagcagtgtagccagtaagtgattctgtccttgcatttgccaggggcaaaagcatacatcagtgccttttacctgagcagcatgtgtcagggcacgctcttaacctctaattactttcttctaagctggtagagtagagtcatgggaagagtatggagtcaggttgggtccaatcctggctgagtgaccactgacaagttgtatatctcctctgagccttgctttcctccttggtaaagtgaggataataatgccgacttcatggacttattttccaggttaagaacaagctgccaggtccccagaaagtgcttagtggggtgcagggtctgcccctttgctgggcactctacctactgaggcactgctgcccatctggaactcagtctatcaagaataagtgaaacttgcctttctccactgacaaattctctcagcctctgtttggcttacttggaatttgtttgacagtatatctgtctggcccataaagaggggaatttagacagggttgaaatgcatcaaattaagtcctgtctccacaaagaaaacacttttgtacttctgtgaaaaggctgcagagacgtggtgactggccatgagtcagcccaggactgtggtgcagctgtggtccttaatccctgccccacaaaagatttgatttaaatgccttgtcacacttgttgaaatctgggaagtggtatcgttaaaaaaa

SEQ ID NO: 26112 - DNA, 363 bp, Homo sapiens
tcgaccattgaacagatactaagagaaaaagacaattgaggtcttagagagttttgaatttaagagggaaaagaaagcagaagaaaacaatcaatttatttaggactttcctgtgtacattgctaattcaataacccattggcctgtgattactaagtgagcgaaattaggttcagggatttatgttcaggtactgtgtatctaaatgaagtatatctaatagtctttttactccaatcagtcaagcacaggaagggattgagcttgaaactggatgctttcattttacacagaatgaaaggaagtaaatgtaaatgagtaccaagagttttatgactggaggcagaaagaaatcaaaaagct

SEQ ID NO: 26113 - DNA, 827 bp, Homo sapiens
gactgtacaatctgactttaggactaaatataaaaccacagaatcatgatagtgtggtgcttgcatagggcagaaaaatagatcagtaggatgcaatagagagcccagaaaggttaaaaaaaaaattgttagggaaaggacagtgttttcaataaatggtattgaaataagtggatatccatatgaaaaaaaatgaaccttaatttcatctcacatactacctcaaaattaattttcactcattacaggcttgagccactgtgcctggcccaattaagtctattttgattgccctctcatgctgtcagtgtcactggtactaattgtatagtgagggtcaaggaaaagattctgtaaggttgtaacttcaatgagtaaattttcctgggaaagaacattctttttatagaaatgattctaaatctggtacagttgtgctgctttggtttacagctctgtggtatacatatttagtacatgaggacagggaacttgtttggcacatcatgggtacttaaagtatatgtataagaatgagggccgggtgcagtggcttacgtctctaattcctgcactctgagagtctgaggcaggaggatcgcttgagcccaggagttcaagactagcctgggcaacatagttgagaccttgtctatacaaataataataatcataaaaaaaaaattagccgaggatggtggggtgtgcctgtagtcccagctactcagaaggctgaggtgggataatcgcttgagcctgagcagttgaagctgtagtgagttgtgattgtgccaccacactctggcgacagagtgagaccttgtctg

SEQ ID NO: 26114 - DNA, 521 bp, Homo sapiens
ctggccaagcatgcctcctgtgccaggaaaatctgcagaggttagctgtaagagctttcagcacatagacctgaaagctggcaaaacccagtgagatgatgattgtgtctggtacaggtgtggaagggtcacagcccctacctgaagacactggcctgggtatggcccttccattcccattccatagggagaatttagtcacattaactagaggggtggagaaaagcaggtgtctcagccacaatacttctgtgcagcagaatggggatggattatggtggatgactgaaagtctctaccatggcaggcaaagtcaactgatgtccactcttagccttttttgcttcctcctcccaactctgtttacctgtcctgctcttcagccagttgctagggaaatccagccaaagtgcccaaaatcatgatttaggggttcctcagggctggcagccctggagccttgggtctgaaggtgttggggatggagacccatgagctattaacttgtaccgagtccaccc

SEQ ID NO: 26115 - DNA, 366 bp, Homo sapiens
acctggaccttggccaggtcactgccttctctgtgagcctcattattccctcatctgaaaaaagggaggtgattgtagcactttcatgagtgtagggagaaagggacgagaagaagaattcaaggctcactggggcccttcacagtggctcacacctgtaatcccagcactttaggagaccaaggtaggaggatcgcatgcgcccaggagtttgagaccagcctgggcaacatagggagaccccatctgtacaaaacaaaaaaattagctgggcatggtggtacatacctgtagtctcagctacttggggggctgaagtgggaggaaggattacttgagccctggaggtggaggctgcagtgagct

SEQ ID NO: 26116 - DNA, 1513 bp, Homo sapiens
gccaggccctgggcccgggggcaggacaggcagggaccatgagcagctccacagaaacccttccccagggcttcaggggccaggcgggacccccacttccgggaggagaccccagtgcccctcacgctcaggggtgcggtgggtggagagattcggaggggagagctgggggctccggaggaggggctgtgggtgggaccccatccccctctggctgcagcaggcagtgaagctgcatcaggggctccaccctgctgaccacagtcctggggcacccagtggaggccggagacaccagcaggttctcctggtcacatggccccacctgccctgtcccccagagccccccaggcttgggatgagttgcgaggggtcggatggacggcgcaggacacacgacacagagtagttgtggcggttgcccctagggagacgtggagagaggccccagggcaccctggaagcggaggctgtggctccgtgtgtcccagggcacagcaccgcccctcacagccgaagctctgatcccttggtctcaggaaacactcaggaagtgcagggcgggcgtgggtctgatttcagggtgagggagctggcagccccaggagtgaggaggccccagtcccctttcaccaagcccgtcctccccttcccgctgccacgacactggtgcctgcagccgtgccagctaggagggcgacgtggacaggatttctctctagaaaggatcctggggtccgattgagaagctggcttgaacgttagacgctgtagctcagagcactgggtatgcacccagaaggagaagtgctcatcacatggtaattcttttgttttgtttttttaagaaaaaggtctcactctttgcccaaagcaactttcttatttatctttgcatcctaagagtctaaaacaatgactggcatgaagtatacaaactatacatcgcctagtaagtggataaaacgattaattaatttgcccaacattcaaaacgtgatggggtgggattcacagccatgacttctcattgcaacgctcaagctccttgtgctgctccacgccgcctttcggtacacgagaagctgaggatccacgccgcctttccgtacatgagaaactgtaggatccacgccacctttcagtagagaagctgtaggatccacaccgcctttccgtacacaagaagctgtaggatccacgccgcctttccgtacacgagaagctgtaggatccacgccacctttcagtagagaagctgtaggatccacgccgcctttccgtacacgagaagctgtaggatccacgccacctttcagtagagaagctgtaggatccacaccgcttttcagtacacgagaaactgtaggatccacgccacctttcagtacacgagaaactgcaggacaaatgaccgtatgcccaggttccaatggcaaaacgccacacctcttatgatactatctttgtgcacataaaatgttcatttttgtctaataaataagtgacttgt

SEQ ID NO: 26117 - DNA, 289 bp, Homo sapiens
tttcctccccagttgcactacttttctgtctcatttcctgccattccccacatataacctgtgcattcttgcaatgccttgcacggtattcttggaacacaccatcttctttcttccctccaacttggcactgacccctattcctagaacacactccatcctctgctggaaagagtctaaattattctctgaattattcttccagacccagcttgaacatcacatccttcaggaagccttcctgactcttctgtgctcgtagagcaaagtggatcctttttctatcaaa

SEQ ID NO: 26118 - DNA, 275 bp, Homo sapiens
tatataatgaagactatatccaagagctgccctggcactactgagtgcccctcattgttcatccctgaagacttgtgtcacgcccggtctcacctttgttcaccatctgtgcttgttaatgcttatccttcctggaaaagagaaaaattgaattttacctctttggcagggcattctgaggacaaatcttttctagaaatattcttatatatatcaatcaaggataaatctccaacttggattgaactcaccgtatgagtaacataaaaacacag

SEQ ID NO: 26119 - DNA, 433 bp, Homo sapiens
cagacaggtacttcttttaacttgtttttgctggtaaacaccctgatgggcatctgctcactgtacatgtcattttcttttggacagaaatgctaaatttactattatttgttcatttattttatgtttttccaaaatggaaacatctttctgaaacaatgggaaagggatcagaatatgccaccccaggctgggcatggtggcagggcctataatcccagcattttgggaggctgaagtgagaagatcccttgaggccaggagtttgagaccagcctgggcaataaagcaagaccctgtctctaccaaaaacaaaataaaataaattagcggggcggggtagtgtgtacctgtagtcctagctacttggttcaagatgacagtgaggtatgatcacactaccacactccagcctgggcaacaacaaacaaga

SEQ ID NO: 26120 - DNA, 359 bp, Homo sapiens
aaatggagaggttgagggactcacccaaagtcactcagctttcagagtggtagagcagggatttgaacctgtgcatatgatttcagaaccttgctcttaatcacaccaggctgccagtctaatacaagccccatcctgtcagatcttccagtttttccagagaagttaaaaatgtggatttttaaaaatatgaaatctatttcaacactgctagacaaacaaaatgaggctctgagttgtagcttgtccatgcagtgggttttactttctatcctcctcaaatacatccacatctgtgttcccatttgtccaagaacaaagagtagatatcctcatccccatgtttcagatggaaaaaa

SEQ ID NO: 26121 - DNA, 205 bp, Homo sapiens
tatgttctagtttgattattgatcatttacttcttagctatttatattcttccttgagtcatcggtttctgccctttgacaatttttctgtgaatgttttgtgtcgattatatgagctttgtctgtattgagaacatccacgaattgtattattgcatctgttttgctagttgagaacatcgacctgctgtattattgcaaatgt

SEQ ID NO: 26122 - DNA, 762 bp, Homo sapiens
aaagctaggcgccccgtgtcctgggctttccgcggcacattccttgggaaacctttttacgcggccctccggcccagctagccgcagcatttatcaccacttggcaccacactgtggttagaagtctggctttgaagtcacgctgcctgggttcatgtcttggctctgacacagtctagctgggcgacactagaaatatgatgtctaggccacagccagacgcatccttgtgtaattacctcccattgggtgtgggaatatgacatgcttccaaccaatggaatacggcaaaggtgacaagatatatacgactatgtgtatgtgattacactacgtaagacggtaacatctgttttgctgagaaacactctcccttgctggctctgaagaagcaggctgccatgttgtgagctgcttatggagatagccatgtggcaaggaactgagggcagcctcccaccagcaacaaactaaggtctttaatctgacagcctgcaaagaactgaactctgccaacaaccacatcagtttaaaaggaaatgcttcccagtcaagtgccatattagaccctagctccagctgacaccttggactacggcaatgcagaggacccgacaaagtcacacttggactcctgacctacagaaagtgtaatataataagtgtgcattgttttaagccactaagtttgtgagaatttgttacatagcaatagataactaatacaatgaccaaaaacatttatttcagaaatgtaaggat

SEQ ID NO: 26123 - DNA, 445 bp, Homo sapiens
aaagctaggcgccccgtgtcctgggctttccgcggcacattccttgggaaacctttttacgcggccctccggcccagctagccgcagcatttatcaccacttggcaccacactgtggttagaagtctggctttgaagtcacgctgcctgggttcatgtcttggctctgacacagtctagctgggcgacactaggcaagtacttaacctccccaagcctcagtttctccatgcataaaatggaaatagtaattgtctttactccataacagtacttacttggccagattcaatgagagcatgcagtgactctcagctcggtgcctgacatgttgtaggtacttttttctaaatattcttcatgtcttggtctagactctaaacattttgaggacagtaaccatgccaaatgcatcttcctatcctctaagagtgtaacagagttga

SEQ ID NO: 26124 - DNA, 566 bp, Homo sapiens
aacattttgggttcctcaggcaaaaggtatttattagtagtggtttagtcatcctgagaattttccttcaccttggtctttctgtcagatgtttctagtccacaaccaggggtgtaagtcattttgaaagacaagctccaggcctgcttccttcatctgctttgctttttcccccagtgcattaagtggctgattttctgtcctgttcctcacgtacttgatccataactccagattctataggtagaaagtatgtttgtgggaaagcactttgaggaagctggctggaaaagagaacttggagtgaactgagacttaggcaactagttgctgccatgtctctctcagcctgtgatagcgaaagggcacgtgagattccattcattttctgattctaggtctgtttgggagtagttatgtcatcttatcccacttcctttctcttccttgtcgttagtcatggtgcagtctcctcataattccccttattagaagctttcctgccaggcgcggtggctcacacctgtaatcccagcattttgggaggccgaggcaggcagatcacc

SEQ ID NO: 26125 - DNA, 229 bp, Homo sapiens
tatgattctctgaggattcattcatttctgcatattttgaatgtctgctacacagagataaatgatgtaaaatccaggctatcagagctgggtcacaatttagtggagaagatgagtacgacaaaaatttaccatggagtgtgaaaagtgctcctcatagagacatgtacatcatgccatagtaagtttagggaatttggaaactcacttaagtcctaactcaatttaa

SEQ ID NO: 26126 - DNA, 224 bp, Homo sapiens
agcaatgtcaccaacagatgtcagtttaagctcagaagtggaaaagcagagagctcagagggtcagctttttcatcagttcttttaatgttatcaccacaattatgtgagaatgaccttgcttagagaaaattatgttattttcgagatctttccccctgtgttggaactaggctgatgaaagcatgggcttgacttatttattgattgtattcgttttgtaca

SEQ ID NO: 26127 - DNA, 992 bp, Homo sapiens
gtgttctaataactacattgaaagaggtaaaaagaaataggcaaaattaatgttaataaggtatcttatttaaaccaatttatccaaaatattatcacttcaacatgtgattggtacaaaaaaattattaagatgttttaccttctttgtactaagctttcacatttttgtgtatattttatacctacagcacacctcactttggattcatcactgtcaagtgattaatagccatgtgtgactagtggccccagatctagagcataccatggtagtacattcacagaagggtgagcagggaaaacaacattgtgttaaatactcccaggcatcacactttggaaaacactgccattggcgtttccatagcctgagttcatgatataaagggatccctagtcattttatattaaatgagattccttaattgaccctaaaattgcccacaacctcttcagagagattgattaccctgtcctaggaaagatctttcatactgcaacagatgcatctagattcatcgtggtctgaattgccgttcctttgggccattgctgaaactaagaaaaactctgaactggcagcatttggttagataatggtttctgttttcccttctatctcctggcaagttttgcaattttacaatccaaagctttcaaagctgttggttgtcaattagctgctcctatggtatttatactgtactctaattctcatttcaggccatgtgcatagtcaacatggagtgtgaaaaagactatttaaagcatatatccattttttaaagttatcctcactacatgtaaaaatagcatacaccctgtcatcttgagtgagaattgtttagactagtcacacagctctgctatctgaatccactaggccacagaattgctcaactctgtttgccattgacaatataggtctgcttaattatgcatgttctgttttgtgtttcagtttttctgaaaataaaggatatgaaaaat

SEQ ID NO: 26128 - DNA, 402 bp, Homo sapiens
  misc_feature (380)..(380): n is a, c, g, or t
ttataaactcatttagactaataatgaatgagttaatagataaaaagatcaagaactgaccactcatgagactgtgttataaagccaggaatgagaagaagctgattctgtaaagcaaagctaacttgcagagaatagcaagacgattacatgtttgagtggcggcactggggccaatatgtcccatagtcagatgtttttcttaatgcaggtgatggattcaagaatgttcactattgatgtaaaattcataacttaaataattcaataaataaaaggagagtgaatctaatctaagggatgggggagttgattcaagcatttgtcatctccccctcccgggggtaccctcctcttcaaacagactaggcgtggatacnggaacttctttaccacccccag

SEQ ID NO: 26129 - DNA, 145 bp, Homo sapiens
ctcatacacgaattttaagttgtaacctacatgtgataagttgctttatcttccaaatgtaataaaaaccagaagttactttgaaataaattgaaggattagcagtggtgactgaggaataaaaattataatttaaaattgtcct

SEQ ID NO: 26130 - DNA, 2626 bp, Homo sapiens
agaagcgggcggcgcgggggagatggtgtgacagcatggagaagctaaaggctcttctgccaagactggagcaggagctgaaggacacagccaagtttaaagatttttatcagtttaccttcaccttcgctaagaacccagggcagaaaggtttagacttagaaatggctgttgcgtattggaaattagtgttatctggaaggtttaaatttttagatctctggaacacattcttaatggaacatcacaaaagatcaattccaagggacacctggaacctcctgctggactttggaaacatgattgcggatgatatgtctaactacgatgaagaaggagcttggcccgttcttatagatgattttgtagaatatgcacggccagtagtcacaggtggaaaacgcagccttttctaggcagcaagttaagcaggagtaagattatgaaatgatttgtatcctgcaaggagattgcagtcagttcctgggtgcattgtcgctgattccagaagtcattcttgaccagccatgaaaccagaggcgccatcccattctgccggaggacagccagcggctgctttgtggacaccgcaggaagttcctcgggacacggctgctttgggatgtttggagatttgtcatcatagcttttgcgttaggaaatttctgcatgattttttaatatttacaaaatactaaggtagagccatagcgccgcctgtgggaccgcagagcatgctgcgtagctcgcgcgtcaggcgaaccagcgtccggcagcgtcccgccgaatgacgttgcggtggcactggcaacacggcatgtgtcctctgcagggcgctgcgtttttatacacgtcaaagctgttaagaatgtgccctaagggagaggatcttgtcgtagagtctaatgttttttaaaattggtgccagcaattcacgatttatattttttgaattaccaaatatctagatttaccagctctatttttgttttcattttctctagacattcatctgaaaatcattttatggttctcaatccccatgtagctttgcatagcaacggcacacgtggcacgattccagcagagtttatctcacaccgtttatatatcactgggcctctcttacttaaatattatttgacctgcctgagaagcttcataaagtatgtttttttaaaatatattttaattacatttaaaaagacatttttccatgaaaaacatttattttatgagtgatgaattatagattttaaaatcaaggccgggcgtggtggctcacacctgtaatcccagcattttgggaggccgaggcaggtggatcacctgaggtcaggagtttgagaccagcctggccaacatggtgaaaccctgtctctactaaaaatacaaaaattagccgggcatggtggcacatgcctgtaatcccagctactcaggaggctgaggcaggagattcgcttgaactcaggagacggaggttacagtgagtcgagatcgcgccactgcactccagcctggacgacagagtgagattctgtctcaaaataaatacatacatacatacaataaaaccgaatgagctggttctttccatcctcttgtggtacccgtagtgcccagcatccagacctttgtgcccctgtgcacatttggaagctaaaatgtacatcgttgtctgaaaaaacccaaccccaaaaccttcatctgattggtgagctgaagtctgtccttgcaccatgttatcatctgtttctcgtgtccgcctggttgaggaggacccacgagtgctgccgaggtgtggagggctggtattgagttgtggacatcactgttgaccctacctcacgtgccgagactctcatgtcacaggcgtgccttgctgcccccctgcagcactgtgcaggacgtggaccagctggagctgctgcccagcacagaggagagtcgccgcagatgacctagctgcggtgtgagagagcatggcccagacaagcagctgggttggcttctgagaacaggacttaccctgggcttcaggaacatctgatggctgaggttagtgtgcttggaggctgcaggacgaactgtcgatgtttcttagcagagatggtcacagagggcagcagggacaggactggaagggacctgcagcctgcagaccccgcctggcccccgctggcttctggctggtccagtgatgggcaagtgacagaccttccccaggctctgcttccagaactctaatgggaaactgggcctgtctacctttagaagtcttcgattctcagagagcatttgtctaatacaataaaaactggcattaatacaaacctcaaaaacgtgagcgtatcttccaggcttcatggattcttgacatgtaattgttttgttcagaaaagtttatagaattcacataattctgtataaactatggagatccacagtacttttttgtttttgagatttaaagttctaagggattgtcaatagatatcaaaatattaatcattggacaaaggcttttccaaaaattgtgggtttttttcttctgttgtatccatttgagtcctgcatgctgtgaaatgctgagaacagaagcattaaattggtttttctcggg

SEQ ID NO: 26131 - DNA, 3164 bp, Homo sapiens
agaagcgggcggcgcgggggagatgcataagcttaaatcgtctcagaaggacaaggtccgccagtttatggcgtgcactcaggctggcgagagaactgctatctactgcttaacgcagaatgagtggagactagacgaggccacggacagcttcttccaaaacccagactcgctccacagggagtccatgcggaacgctgtggacaagaagaagctggagcggctgtacggcaggtacaaagatccacaagatgaaaacaaaattggagtcgatgggattcaacagttttgtgatgatctgagcctggatcctgccagtatcagtgtattggtcatagcgtggaagttcagggcagcaactcagtgtgaatttagcagaaaggaatttctagatggcatgacagaacttgggtgtgacagcatggagaagctaaaggctcttctgccaagactggagcaggagctgaaggacacagccaagtttaaagatttttatcagtttaccttcaccttcgctaagaacccagggcagaaaggtttaggttcacctccatttctcaatgtgaaagctttacatcattaagatgagttgaatatagatttcaattaatgttcttcctaagtgataaggatgtagacttataagcaggacaagactaatcatcttcttagcattttactgcgggtcccatcgacttagaaatggctgttgcgtattggaaattagtgttatctggaaggtttaaatttttagatctctggaacacattcttaatggaacatcacaaaagatcaattccaagggacacctggaacctcctgctggactttggaaacatgattgcggatgatatgtctaactacgatgaagaaggagcttggcccgttcttatagatgattttgtagaatatgcacggccagtagtcacaggtggaaaacgcagccttttctaggcagcaagttaagcaggagtaagattatgaaatgatttgtatcctgcaaggagattgcagtcagttcctgggtgcattgtcgctgattccagaagtcattcttgaccagccatgaaaccagaggcgccatcccattctgccggaggacagccagcggctgctttgtggacaccgcaggaagttcctcgggacacggctgctttgggatgtttggagatttgtcatcatagcttttgcgttaggaaatttctgcatgattttttaatatttacaaaatactaaggtagagccatagcgccgcctgtgggaccgcagagcatgctgcgtagctcgcgcgtcaggcgaaccagcgtccggcagcgtcccgccgaatgacgttgcggtggcactggcaacacggcatgtgtcctctgcagggcgctgcgtttttatacacgtcaaagctgttaagaatgtgccctaagggagaggatcttgtcgtagagtctaatgttttttaaaattggtgccagcaattcacgatttatattttttgaattaccaaatatctagatttaccagctctatttttgttttcattttctctagacattcatctgaaaatcattttatggttctcaatccccatgtagctttgcatagcaacggcacacgtggcacgattccagcagagtttatctcacaccgtttatatatcactgggcctctcttacttaaatattatttgacctgcctgagaagcttcataaagtatgtttttttaaaatatattttaattacatttaaaaagacatttttccatgaaaaacatttattttatgagtgatgaattatagattttaaaatcaaggccgggcgtggtggctcacacctgtaatcccagcattttgggaggccgaggcaggtggatcacctgaggtcaggagtttgagaccagcctggccaacatggtgaaaccctgtctctactaaaaatacaaaaattagccgggcatggtggcacatgcctgtaatcccagctactcaggaggctgaggcaggagattcgcttgaactcaggagacggaggttacagtgagtcgagatcgcgccactgcactccagcctggacgacagagtgagattctgtctcaaaataaatacatacatacatacaataaaaccgaatgagctggttctttccatcctcttgtggtacccgtagtgcccagcatccagacctttgtgcccctgtgcacatttggaagctaaaatgtacatcgttgtctgaaaaaacccaaccccaaaaccttcatctgattggtgagctgaagtctgtccttgcaccatgttatcatctgtttctcgtgtccgcctggttgaggaggacccacgagtgctgccgaggtgtggagggctggtattgagttgtggacatcactgttgaccctacctcacgtgccgagactctcatgtcacaggcgtgccttgctgcccccctgcagcactgtgcaggacgtggaccagctggagctgctgcccagcacagaggagagtcgccgcagatgacctagctgcggtgtgagagagcatggcccagacaagcagctgggttggcttctgagaacaggacttaccctgggcttcaggaacatctgatggctgaggttagtgtgcttggaggctgcaggacgaactgtcgatgtttcttagcagagatggtcacagagggcagcagggacaggactggaagggacctgcagcctgcagaccccgcctggcccccgctggcttctggctggtccagtgatgggcaagtgacagaccttccccaggctctgcttccagaactctaatgggaaactgggcctgtctacctttagaagtcttcgattctcagagagcatttgtctaatacaataaaaactggcattaatacaaacctcaaaaacgtgagcgtatcttccaggcttcatggattcttgacatgtaattgttttgttcagaaaagtttatagaattcacataattctgtataaactatggagatccacagtacttttttgtttttgagatttaaagttctaagggattgtcaatagatatcaaaatattaatcattggacaaaggcttttccaaaaattgtgggtttttttcttctgttgtatccatttgagtcctgcatgctgtgaaatgctgagaacagaagcattaaattggtttttctcggg

SEQ ID NO: 26132 - DNA, 2517 bp, Homo sapiens
gaagaagcgtagcagcgctcgtgagatgacttagaactggctgtgcgttatcgtggatatatgtgatcttcgtaagagtatccattttcatgatctctggaacgcatcctttcctggaacatcacgcaccagatcaatccgaagggtacatctggaatctcctgtcgtggatctttggagaccttgatggctcgtttctatgtctatctacgatgactcaaaggatcttggtccgctcccttactctgatgattttgtagaatatgcacggccagtagtcacaggtggaaaacgcagccttttctaggcagcaagttaagcaggagtaagattatgaaatgatttgtatcctgcaaggagattgcagtcagttcctgggtgcattgtcgctgattccagaagtcattcttgaccagccatgaaaccagaggcgccatcccattctgccggaggacagccagcggctgctttgtggacaccgcaggaagttcctcgggacacggctgctttgggatgtttggagatttgtcatcatagcttttgcgttaggaaatttctgcatgattttttaatatttacaaaatactaaggtagagccatagcgccgcctgtgggaccgcagagcatgctgcgtagctcgcgcgtcaggcgaaccagcgtccggcagcgtcccgccgaatgacgttgcggtggcactggcaacacggcatgtgtcctctgcagggcgctgcgtttttatacacgtcaaagctgttaagaatgtgccctaagggagaggatcttgtcgtagagtctaatgttttttaaaattggtgccagcaattcacgatttatattttttgaattaccaaatatctagatttaccagctctatttttgttttcattttctctagacattcatctgaaaatcattttatggttctcaatccccatgtagctttgcatagcaacggcacacgtggcacgattccagcagagtttatctcacaccgtttatatatcactgggcctctcttacttaaatattatttgacctgcctgagaagcttcataaagtatgtttttttaaaatatattttaattacatttaaaaagacatttttccatgaaaaacatttattttatgagtgatgaattatagattttaaaatcaaggccgggcgtggtggctcacacctgtaatcccagcattttgggaggccgaggcaggtggatcacctgaggtcaggagtttgagaccagcctggccaacatggtgaaaccctgtctctactaaaaatacaaaaattagccgggcatggtggcacatgcctgtaatcccagctactcaggaggctgaggcaggagattcgcttgaactcaggagacggaggttacagtgagtcgagatcgcgccactgcactccagcctggacgacagagtgagattctgtctcaaaataaatacatacatacatacaataaaaccgaatgagctggttctttccatcctcttgtggtacccgtagtgcccagcatccagacctttgtgcccctgtgcacatttggaagctaaaatgtacatcgttgtctgaaaaaacccaaccccaaaaccttcatctgattggtgagctgaagtctgtccttgcaccatgttatcatctgtttctcgtgtccgcctggttgaggaggacccacgagtgctgccgaggtgtggagggctggtattgagttgtggacatcactgttgaccctacctcacgtgccgagactctcatgtcacaggcgtgccttgctgcccccctgcagcactgtgcaggacgtggaccagctggagctgctgcccagcacagaggagagtcgccgcagatgacctagctgcggtgtgagagagcatggcccagacaagcagctgggttggcttctgagaacaggacttaccctgggcttcaggaacatctgatggctgaggttagtgtgcttggaggctgcaggacgaactgtcgatgtttcttagcagagatggtcacagagggcagcagggacaggactggaagggacctgcagcctgcagaccccgcctggcccccgctggcttctggctggtccagtgatgggcaagtgacagaccttccccaggctctgcttccagaactctaatgggaaactgggcctgtctacctttagaagtcttcgattctcagagagcatttgtctaatacaataaaaactggcattaatacaaacctcaaaaacgtgagcgtatcttccaggcttcatggattcttgacatgtaattgttttgttcagaaaagtttatagaattcacataattctgtataaactatggagatccacagtacttttttgtttttgagatttaaagttctaagggattgtcaatagatatcaaaatattaatcattggacaaaggcttttccaaaaattgtgggtttttttcttctgttgtatccatttgagtcctgcatgctgtgaaatgctgagaacagaagcattaaattggtttttctcggg

SEQ ID NO: 26133 - DNA, 2952 bp, Homo sapiens
agaagcgggcggcgcgggggagatgcataagcttaaatcgtctcagaaggacaaggtccgccagtttatggcgtgcactcaggctggcgagagaactgctatctactgcttaacgcagaatgagtggagactagacgaggccacggacagcttcttccaaaacccagactcgctccacagggagtccatgcggaacgctgtggacaagaagaagctggagcggctgtacggcaggtacaaagatccacaagatgaaaacaaaattggagtcgatgggattcaacagttttgtgatgatctgagcctggatcctgccagtatcagtgtattggtcatagcgtggaagttcagggcagcaactcagtgtgaatttagcagaaaggaatttctagatggcatgacagaacttgggtgtgacagcatggagaagctaaaggctcttctgccaagactggagcaggagctgaaggacacagccaagtttaaagatttttatcagtttaccttcaccttcgctaagaacccagggcagaaaggtttagacttagaaatggctgttgcgtattggaaattagtgttatctggaaggtttaaatttttagatctctggaacacattcttaatgatgattgcggatgatatgtctaactacgatgaagaaggagcttggcccgttcttatagatgattttgtagaatatgcacggccagtagtcacaggtggaaaacgcagccttttctaggcagcaagttaagcaggagtaagattatgaaatgatttgtatcctgcaaggagattgcagtcagttcctgggtgcattgtcgctgattccagaagtcattcttgaccagccatgaaaccagaggcgccatcccattctgccggaggacagccagcggctgctttgtggacaccgcaggaagttcctcgggacacggctgctttgggatgtttggagatttgtcatcatagcttttgcgttaggaaatttctgcatgattttttaatatttacaaaatactaaggtagagccatagcgccgcctgtgggaccgcagagcatgctgcgtagctcgcgcgtcaggcgaaccagcgtccggcagcgtcccgccgaatgacgttgcggtggcactggcaacacggcatgtgtcctctgcagggcgctgcgtttttatacacgtcaaagctgttaagaatgtgccctaagggagaggatcttgtcgtagagtctaatgttttttaaaattggtgccagcaattcacgatttatattttttgaattaccaaatatctagatttaccagctctatttttgttttcattttctctagacattcatctgaaaatcattttatggttctcaatccccatgtagctttgcatagcaacggcacacgtggcacgattccagcagagtttatctcacaccgtttatatatcactgggcctctcttacttaaatattatttgacctgcctgagaagcttcataaagtatgtttttttaaaatatattttaattacatttaaaaagacatttttccatgaaaaacatttattttatgagtgatgaattatagattttaaaatcaaggccgggcgtggtggctcacacctgtaatcccagcattttgggaggccgaggcaggtggatcacctgaggtcaggagtttgagaccagcctggccaacatggtgaaaccctgtctctactaaaaatacaaaaattagccgggcatggtggcacatgcctgtaatcccagctactcaggaggctgaggcaggagattcgcttgaactcaggagacggaggttacagtgagtcgagatcgcgccactgcactccagcctggacgacagagtgagattctgtctcaaaataaatacatacatacatacaataaaaccgaatgagctggttctttccatcctcttgtggtacccgtagtgcccagcatccagacctttgtgcccctgtgcacatttggaagctaaaatgtacatcgttgtctgaaaaaacccaaccccaaaaccttcatctgattggtgagctgaagtctgtccttgcaccatgttatcatctgtttctcgtgtccgcctggttgaggaggacccacgagtgctgccgaggtgtggagggctggtattgagttgtggacatcactgttgaccctacctcacgtgccgagactctcatgtcacaggcgtgccttgctgcccccctgcagcactgtgcaggacgtggaccagctggagctgctgcccagcacagaggagagtcgccgcagatgacctagctgcggtgtgagagagcatggcccagacaagcagctgggttggcttctgagaacaggacttaccctgggcttcaggaacatctgatggctgaggttagtgtgcttggaggctgcaggacgaactgtcgatgtttcttagcagagatggtcacagagggcagcagggacaggactggaagggacctgcagcctgcagaccccgcctggcccccgctggcttctggctggtccagtgatgggcaagtgacagaccttccccaggctctgcttccagaactctaatgggaaactgggcctgtctacctttagaagtcttcgattctcagagagcatttgtctaatacaataaaaactggcattaatacaaacctcaaaaacgtgagcgtatcttccaggcttcatggattcttgacatgtaattgttttgttcagaaaagtttatagaattcacataattctgtataaactatggagatccacagtacttttttgtttttgagatttaaagttctaagggattgtcaatagatatcaaaatattaatcattggacaaaggcttttccaaaaattgtgggtttttttcttctgttgtatccatttgagtcctgcatgctgtgaaatgctgagaacagaagcattaaattggtttttctcggg

SEQ ID NO: 26134 - DNA, 3105 bp, Homo sapiens
agaagcgggcggcgcgggggagatgcataagcttaaatcgtctcagaaggacaaggtccgccagtttatggcgtgcactcaggctggcgagagaactgctatctactgcttaacgcagaatgagtggagactagacgaggccacggacagcttcttccaaaacccagactcgctccacagggagtccatgcggaacgctgtggacaagaagaagctggagcggctgtacggcaggtacaaagatccacaagatgaaaacaaaattggagtcgatgggattcaacagttttgtgatgatctgagcctggatcctgccagtatcagtgtattggtcatagcgtggaagttcagggcagcaactcagtgtgaatttagcagaaaggaatttctagatggcatgacagaacttgggtgtgacagcatggagaagctaaaggctcttctgccaagactggagcaggagctgaaggacacagccaagtttaaagatttttatcagtttaccttcaccttcgctaagaacccagggcagaaaggtttaggttcacctccatttctcaatgtgaaagctttacatcattaagatgagttgaatatagatttcaattaatgttcttcctaagtgataaggatgtagacttataagcaggacaagactaatcatcttcttagcattttactgcgggtcccatcgacttagaaatggctgttgcgtattggaaattagtgttatctggaaggtttaaatttttagatctctggaacacattcttaatggaacatcacaaaagatcaattccaagggacacctggaacctcctgctggactttggaaacatgattgcggatgatatgtctaactacgatgaagaaggagcttggcccgttcttatagatgattttgtagaatatgcacggccagtagtcacaggtggaaaacgcagccttttctaggcagcaagttaagcaggagtaagattatgaaatgatttgtatcctgcaaggagattgcagtcagttcctgggtgcattgtcgctgattccagaagtcattcttgaccagccatgaaaccagaggcgccatcccattctgccggaggacagccagcggctgctttgtggacaccgcaggaagttcctcgggacacggctgctttgggatgtttggagatttgtcatcatagcttttgcgttaggaaatttctgcatgattttttaatatttacaaaatactaaggtagagccatagcgccgcctgtgggaccgcagagcatgctgcgtagctcgcgcgtcaggcgaaccagcgtccggcagcgtcccgccgaatgacgttgcggtggcactggcaacacggcatgtgtcctctgcagggcgctgcgtttttatacacgtcaaagctgttaagaatgtgccctaagggagaggatcttgtcgtagagtctaatgttttttaaaattggtgccagcaattcacgatttatattttttgaattaccaaatatctagatttaccagctctatttttgttttcattttctctagacattcatctgaaaatcattttatggttctcaatccccatgtagctttgcatagcaacggcacacgtggcacgattccagcagagtttatctcacaccgtttatatatcactgggcctctcttacttaaatattatttgacctgcctgagaagcttcataaagtatgtttttttaaaatatattttaattacatttaaaaagacatttttccatgaaaaacatttattttatgagtgatgaattatagattttaaaatcaaggccgggcgtggtggctcacacctgtaatcccagcattttgggaggccgaggcaggtggatcacctgaggtcaggagtttgagaccagcctggccaacatggtgaaaccctgtctctactaaaaatacaaaaattagccgggcatggtggcacatgcctgtaatcccagctactcaggaggctgaggcaggagattcgcttgaactcaggagacggaggttacagtgagtcgagatcgcgccactgcactccagcctggacgacagagtgagattctgtctcaaaataaatacatacatacatacaataaaaccgaatgagctggttctttccatcctcttgtggtacccgtagtgcccagcatccagacctttgtgcccctgtgcacatttggaagctaaaatgtacatcgttgtctgaaaaaacccctgtttctcgtgtccgcctggttgaggaggacccacgagtgctgccgaggtgtggagggctggtattgagttgtggacatcactgttgaccctacctcacgtgccgagactctcatgtcacaggcgtgccttgctgcccccctgcagcactgtgcaggacgtggaccagctggagctgctgcccagcacagaggagagtcgccgcagatgacctagctgcggtgtgagagagcatggcccagacaagcagctgggttggcttctgagaacaggacttaccctgggcttcaggaacatctgatggctgaggttagtgtgcttggaggctgcaggacgaactgtcgatgtttcttagcagagatggtcacagagggcagcagggacaggactggaagggacctgcagcctgcagaccccgcctggcccccgctggcttctggctggtccagtgatgggcaagtgacagaccttccccaggctctgcttccagaactctaatgggaaactgggcctgtctacctttagaagtcttcgattctcagagagcatttgtctaatacaataaaaactggcattaatacaaacctcaaaaacgtgagcgtatcttccaggcttcatggattcttgacatgtaattgttttgttcagaaaagtttatagaattcacataattctgtataaactatggagatccacagtacttttttgtttttgagatttaaagttctaagggattgtcaatagatatcaaaatattaatcattggacaaaggcttttccaaaaattgtgggtttttttcttctgttgtatccatttgagtcctgcatgctgtgaaatgctgagaacagaagcattaaattggtttttctcggg

SEQ ID NO: 26135 - DNA, 1975 bp, Homo sapiens
tttttgcttctgtttgtctgcacgctccttcatgtcatagaactctagcaatggatgagaaatctgccagcaccagacacatcaaaattgggcacatagatggaaaattttgcaatttttcatgaatttatagggtttccagaatctagttgaggcaaagctcatttggctatagagtaaatgtaagacttgttacaacagaaatttaagtggccagttcaatgtcctttggctatatttgacctacctttaaaacctagcccatttcatatcagcctcttctgtgcctgggcttgaaatgtctaaagctgccttcgtgtctgggattacaccatgtaggtcagtataaagagggcagtcactcctccatttctcccagcgtgtccagttcagcagatttctaaagctgttaagcagcctctctttttgaccgtcctaaactttgtgaaaataaataccccacacccagataaccattaatagaagtaatgtagttttttaggcttttggaatatgtcttctcttttgtatttatgatggtgtttggaatttttcactagtgtatttttagactgaagtgggtgcattaggataaaactttcccttgctgagcctgaaggcaagcaagagggaagaaattgacctgtattgtatcattggggaggcgactacttcttgtggtggtagggggtggggggaatggggcattgtagattatgtgggggtacaatagaattctggcctgaggctccccaagtcttattaccttgtatgaaaaatccccatattagcctcacttaatctcaatagaagcctgctgtttaccctcagggaacaagtagttttcaaaattgagctcctccaaggtcattggccaatgctgtgtgcaggcattggtcatctttgtaaactcatggcattatttcctcatatgcattatgatactaagaaattcaaccccaacctgtatgaaaagcacagcccagggccctaattgaggctagcatgaatgcctttgaggggccagggggccataggaggcccatgcaatttaactgaagctcaggtgccacgttggatttttattcttattaggccgcaacctttctgaatgagtttagggcaggggctgctgatccggctgtggattcagggagctctaaaatgaatctctaccgttcctttaaaggtctttctggttcctcccagtgttgtcattgctgaggtcgatctcgtagttgttcagttgtgctctttttgctgtcttgtgagtcttagccagtgatccagctgcccaaggacagggcctccagagggcctagcgccctcctggtaccaagcgtgtgctcctggcctgtgtgacagtgtctttcccgaagcagtgaaatgagaaattctgcaagtggccacccggaagatcagtctgtagctcttgggcctggatttctactatgttagtgagtgtaggaatatactgtgtctttaatggatgaaaattcaatgtatgctgtgaatttgttggtttgaaacattgaaatttttcattagacaatgtttacatacctcacctgaagaacctttgagagtgtatatataaaattttaaaatatattaagttgctttaaaacaatatgtatagctataaaagttggagttattttaactttgaatatgtaccaagtctcttaaatattgaaatcttgtagacttcttgtgcttctgtgttttgctttcctatcaggccatgtaggaaactgtgttcttgttattggtagaggggccctcactgaaatccaagcttggaaggatgtcctgtgttgtttcagattctcttgtttggttttgaaggatgcggtgtggagccagaggatgtgtgggaggggtttctctaacactgacttctattccatgagctttttcaaggcgcttattttatggcagcgtattaaacttctttgatattcaaaaaagtctg

SEQ ID NO: 26136 - DNA, 452 bp, Homo sapiens
ggcacgaggggagctaatttttgggaaagagactataccaacaagatttgcataattttttatatttataccacaggtagggattatttttagagtcactatagcttaaggttattgatttcactagtgtggtttctgcattctaaatagttctcggagactgtgttagtaactggtttcaaatacatatatataatatttatacacaccactgtgggaatttatttcactgtgtaaatagtgatattttcctgttcagatacttctatagaaagtatttattttaacaagaaaattaactgtgcaaaagggctttccaaaaagtgttctttctagccacccatcctccccagctaccatggctcaaccattggggcccccaaacaacagtggaaagcagaaaggtgtgggccttgaaaccttcactgtatttggacagatgcaacagaagc

SEQ ID NO: 26137 - DNA, 286 bp, Homo sapiens
ggcacgaggggagctaatttttgggaaagagactataccaacaagatttgcataattttttatatttataccacaggtagggattatttttagagtcactatagcttaaggttattgatttcactgtgttgtttcagattctcttgtttggttttgaaggatgcggtgtggagccagaggatgtgtgggaggggtttctctaacactgacttctattccatgagctttttcaaggcgcttattttatggcagcgtattaaacttctttgatattcaaaaaagtctg

SEQ ID NO: 26138 - DNA, 313 bp, Homo sapiens
gtgatccacccgcctcagcctcccagagtgctgggattacagatgtgagccactgtgcctggctgagaaatctaattgatgtttttactctgcatattactctttgttcttcagcttatatattagaatttttaaaactttaaaaaaatgttggtcaggctgggtgcagtggctaatgcctgtaattgcagcattctcgggaggctgaggcaggagaatggcttgaacccaggaggtggaggttgcagtgagccgagatcgtgccactgcaccccagcctgggcaacagagcaagactccatctcaaaaagga

SEQ ID NO: 26139 - DNA, 617 bp, Homo sapiens
tggtctccatctcttgacctcgtgatccaccctccttggcctcccaaagtgctgggattacaagcgtgagtcactgtgcctgtcccagcatatgtatttttaaaagagaattcattctattggtataattagaaaaatatttatgaaatattatttatatagttcatgaagtctccaagaaaaacaaactgggataacaaagccagaaaatatcactgcagccttatcaggctatttagaatgaaccaagctattgcttaaagccagaagctgcatcgcattcttccccaggccagatgcctcctcacccttttttgacagaaggtgagccttctatatactagtctcactgagatgcatctattgggaagaacctagacttcctccgtcatagcagtttatggcaaacctattcatactcttccttgcagtggtggtgctcccaatgtgagaaaataaaaaatatcttgaggtaaatattattttttatcagctactcaggcttcaacttatcctatcattcaaagtttatgaagcatcggtcgggtgcggtggtttacgcctgtaatcccagcaatttgggaggctgaggcgggtagatcacctgacgtcaggag

SEQ ID NO: 26140 - DNA, 384 bp, Homo sapiens
ttttttttttttttttgagacagggtattgctctgtcacccaggctggagtacagtggcatgacctcagctcactgcaacctctgcctcccaagttccagtgactctcgtgcctcagcctcccaagcagctgggattacaggtgcccaccatgacacccagctaatttttgtatttttagtagagatggggtttcaccacattggtcaggctggtcttgaattcctgacctcaagtgatcagcctgcctcagcctcccaaagtgctgggattacaggcgtgacgaccacgcctggcctcatactttaattctaatgccaatgggttgtttccagtttggggctattaagaacagcgttattatgaacacttttataagtgtaca

SEQ ID NO: 26141 - DNA, 412 bp, Homo sapiens
ttttttttttttttttgagacagggtattgctctgtcacccaggctggagtacagtggcatgacctcagctcactgcaacctctgcctcccaagttccagtgactctcgtgcctcagcctcccaagcagctgggattacaggtgcccaccatgacacccagctaatttttgtatttttatagaaacgaagtttcaccatgttggccaggctggtctcgaacccctaacctcgtgatccacctgcctcggctcccaaagcactgggattacaggcatgagccaccacacccagccacattaacattttaaaagtatgtattaatgcactgaacaaatataaattgaagccaggcacctgtagtcccagctactcaagagggtggggtaggagaattgcttgagcccaggagtt

SEQ ID NO: 26142 - DNA, 327 bp, Homo sapiens
gaagctgtagttggccataaagttgacgttggccaggagcccgttggggtcactagaggagttgccataagtagaggtacctcagtgaaaccacagtgtagatcagatccatgtatctctgagtgaggtccacagattctgcaaatcagaggtgctggcaccacctgggacctgctggatcaggcccagcagctgagagtgcagctgggactctattttggacactttttcctcagttgattctgatgcacctcaaagcttgaggaccagtgataaccatccatttgacagatggagaaattgaggctcaaagaagtcagattctct

SEQ ID NO: 26143 - DNA, 487 bp, Homo sapiens
tggtttggagaaatttccctgaggaagtgatattggagtaggttttgtaggctagttggaatttgattggggtcttatggtggtagtggttgggaaaggattggtaggaagacacatcagtagagacacattgagcaggtggggtgggggtggcatgtgtgcagatgcagagacaagaaagagcatggagagtttgggagcaatgacaagcaattcattatgggtggacatcaccctgcacagaagggagtggtatgacataaaactctaaagttaggcaggatagatcactgaggaccctgtactacacacgaaagtatgccatggatggggagtgttatgatcaatgtgaagattggaaagatggtggcagtatgaagcgtggacaggcagggagtgatcctagagcagtagttttcaaatgttgtggtttcaggatttctttacactcttaaaatcattcatgaacccaaagaacttttgttta

SEQ ID NO: 26144 - DNA, 821 bp, Homo sapiens
ggctgttccagtttcttatctcaggagggaagagctgcagatgtctttactgtgaatgagggagagaaacgctaaagcacagaaatgttcagaaccaaagagctggatcactcatgcttctagaaaagacattggcatcttctcattgctcatctactgtgcctggcacagccttattttctagctttctgaatgtgagttccatccatatcctttgcataacggtggtactgggctgtggagagcttggaatgtgtgtccatggggaaatgggctgttctggttattataaaacggccaagggagggctccatggcacacctctgagtaacccaggacactcctgtttgggaaatgcaaaccatccatacggcaggggcacaattataaagattgatcctgtcacgggaatggtttcaaatctgaccaacctcatggcatacattggggaagcaattgtgaaaccccttgattctttggatctggacatgctgtactgtgacaatggtttgtgtgtgacagaaaatgtagctgtgtctaccgggaaagactggggaaatttcttcctgtggagttctttataaagcaaaagtgcatgaaactgtcagtaatattgtagtctataaagggaaattgctcttagaggctaatattgcacaatgactactttttttgcttatttggaaaagatctttatctcttggagtattaagaagtcaacatataattgccaccctatacattgtgttctggagtgcctgatttattgaaatcagtgtgaaacctattttaaataaatatctatttcaaaaccaaggcca

SEQ ID NO: 26145 - DNA, 350 bp, Homo sapiens
aaaaaaaaaaaaagaaaagaaaaggaaaaaaaaatgaaaaagaagccattgaataccctattgaccataagaaaaaggtagggaaagttggtcaacggcaacccaggcactgaaggaaaaagaacatggagaatgacaaaagcccagagggaagagtaaaaggacacaaacaccattctcagggaccaggactgggcgccgttctcagggaccaggactgggcactaatcacagaactgtaacaggcaccccatgggaatgaccaactgttagacggggcctgcagggcagcacttccctcttgcctcccaccaacagcttctaaagggaaatgccgactgttttcacac

SEQ ID NO: 26146 - DNA, 422 bp, Homo sapiens
gcatttgaacttgatgtaggcagaaaagtcggcaaatacatccagcccagctgtgtttgactcaggatttagagctcttagcttggggtacctgcaggggaacagcactgcctccagaaattcctcaatcttttgggtgtctatgtgtgcttccatgccacgcagcaggaacaggagctgcccttctgggcacagcttctgcactgtcacggtctacctcttggtgtcaatggtggtgatgttgaaagtgactcctttgagccagagcaccatgaacagtctctagaagaaggggcagttcctggccaagcgcggtggctcacgcctataatcccagcactttgggaggccgaggtgggtggatcacctgaggtcgggagttcgagaccagcctcgccaacatggagaaaccccgtctctac

SEQ ID NO: 26147 - DNA, 701 bp, Homo sapiens
tttctccaaagggagtgggggctgttgagcctgaaatagggaacaccaggacagtaagatcaaatgctttgaaagtggctgtgccaacgctttttgctaattaaagaatgttaggacaatcaccactagcagcagtaaagggcgccccattacctcgctttatggagagctgggtaaatttaaaggcagctataaatatcccactgagtgccagagctatagcacagtcggcgggtacctgctgggcaaggagaggagcccagagcttctggtcccctttgtctagggttctcatctctattacctgtcagtccccaaattttgcttgaccaaggaagaattccatcaacgaacccttaatttaaaaacactcagggagacagcaaacagctgtgtattgagtctgcctgggagcccaggctacctgggtccttctccagctttgtcagtgactttcttttccttttgcctggatggaagatatttcttcacgttgtgattttgtttccttgaaacacggggtgtgtcacagaaatttaaaaaaaaaaaatccaggtgcagtgcttatgcttgtaatcccagcattttgggaggccaaggtgggggaattgcttgagcctgggaggaggaggttgcagtgacctgagatcgcaccactcactccaactctggtcatcaaacagagcaaggtcctatcttta

SEQ ID NO: 26148 - DNA, 1087 bp, Homo sapiens
ggttgagagctaagcagacatcaggactaccagctgcagagaggagctacccactgtgggcttcgtctctgctgagagctgaacactcactgggacgccctgcctatggaaaccagctgttcactctgggtctcctctgagctgttctgtcgctcagtaaaggtcttcttctgcttactcgccctccatttgtctgccttacctcattcatcctggacacaggacaagaacttgggacttgccggtatggtggagctaaaatagctgtaacacaaacaggattgaaacatgccccttgctcgccacattgtggatgacaagagggagggaagaaaggagagaagatctgcgacccttcggcaaacccagacttaggagatcggagagccaagactgtgacaccctttctggggctctgtggttcctggcgtctccaagcttctgggcacctcggctttccccggtgccagtcgtggaagctgcttgtgcagagtcttgctttgtcacccaggctggagtacagtggcgtgatcacagcttactgaaacgtctgcgtctcaggttcaagcgatttttctgcctcagcctctggtgtagctggaattacagtgttagcagtcactgatgctcaaacatgagaagactgggacatccatcagataagaaacgctgcccaaagtgttagactaataagtgacagggttggacaatgaacccaaccactcaaccttccggaaaagtgagttttaaacaatagattatgctaatcttatcagaaaaaaacgacattgtccgggcacggtggctcacgcctgtaatcccagcactttgggaggccaaggcgggcggatcatgaggtcaggagatggagaccatcctggctaacacggtgaaaccccgtctctgctaaaaatacaaaaaattagccgggagtggtggcgggtgcctgtagtcccagctacttgggaggctgaggcaggagaatggcatccacccgggaggcggagcttgcagtgagcagagatcgcaccactgcactccagcctgggcgacagagtgagactcgatttcaaaaaaaaaaaaaaaa

SEQ ID NO: 26149 - DNA, 423 bp, Homo sapiens
agcaacttttcggtgaatctgacaggataaattgtttgtaaaatatactcttacataactatagacagatctgtatgaaggttttgtatatgaaccaattgaatatgccatggataattttgtttttagaaagactgatccaggccgggcgtggtggctcacgcctgtaatcccagcactttgggaggccaaggcgggtggatcacctgaggtcgggagttctagaccagcctgaccaacacggagaaacctcatctctactagaaatacaaaattagccgggcatggcagcgcatgcctgtaatcccagctactcgggaggctgaagcagaactgcttgaacctgggaggcagaggttgtggtgagccgagatcacgccattgcactccagcctgggcaacaagagcgaaactctgtctcag

SEQ ID NO: 26150 - DNA, 768 bp, Homo sapiens
acacctgcccttcaaatattagaagacagttctcaggtcccctgaatcttctcttcaccaggttaacatccctaatgctgccagcatttccttatatgatgtggtttcaagtcattctttacctctgtcactctcctctggacaattccagggatttagcatctttctcaatgtatgtcttccaaagttgaacccgagacttcatagtggtccgacatgtgtagggggtgcagcaggactattcttcacttgttctgggccttgacgtggcctcatagcatgaaaagagccactggcattagagccagcctacacatgggctcaaactaatgttggcatcccatcagcccatgtaactaggggtaatacctcaaaatatttaacaaatgacatggttcaggaactaactagtcaattacagctttggagcacagtaaaaaagcccctgctgtgcctgatgttatccttttggtttttggatcatggggtagaggtggaggtgggggatcagggaagcagctaattctcaaccaacacacaatatctgaacattttaacagctggtacaagccacacctgtgtggaccaggtagatatcagtaatggatacaaccagattaaagtaacttcagtgctctgagcctcagtttcctcatctgtgaaatggagttgaaggtagtagccactgctggggactttgaagggacactgtattacttcattttcacactgctgataaagacatacccgagactgggtaatttataa

SEQ ID NO: 26151 - DNA, 282 bp, Homo sapiens
gagagatggggtctctctgtgttgccctcagagacctggttggtctctctaactcctgggctcaagcgatccatccactcagcctcccaaagtgttgggattacaggcgtgagccactgtgcccagtcttcttagttctagggacacatctcaagtaaacagtgtccattccctgtggaacccaccccagaaatccttcctcgtcctaacgtcccgataccagcctaagggtgctgtggtccgcgtgccccactctcaggcaggggcctggtcagcatccca

SEQ ID NO: 26152 - DNA, 342 bp, Homo sapiens
atcactaacttcctcgtctgcaactaggcagagaaaaaaattttaaaaggctcatatgagggtcggaggcggtggctcatgcctgtaatcccagcactttgggaggccaaggcgggcagaccacctgaggtctggagttcaaggccagcctggccaacatggagaaatcccgtctctactaaaaatacaaaattagccgggtgtggtggtgcattcttgtaatcccagctactccgaaggctgagagaggagaatggcatgaacctgggaggcagagcttgcagtgagccgagatcgcgccactgcattccagcctgggcgacagagcaagactcggtctca

SEQ ID NO: 26153 - DNA, 604 bp, Homo sapiens
ccgtcccgctctcacaggtgaggacagtggctcctacagatcttcaggaagaatcaccaacattctagagcacttgccaggtcccatgcagcaggctgggatgctcccatggattacctcactgtcccctctcagtaatcctgtgaaaatagatgttattattcccagtttccagatgaggaaatgagagctgagagaaattagataactgcctgagatcgcctgggcggtatgtggtggtggagcctcaacccgcctctggggcctgtgctggtgccgtggggccgccagctgcttggcacttagtggggtgggtatcagtgcgtctaagtccctggtgtgctggtccttacagcgctgcccgtagaaggctcatgggaaccacaggcatcatttaaaattttccaggagctgcgtttaaaaagtaaaaagaaacacagatgaaactattttaataatatacttgagcccaagacatgaagaatattagaatttaaacacgtgataccttatttcacttgctcagtagctacgtgtggttggcacaatggtgcagatctaagaaatagaaagaattttgaaaatgcagagtggttttttattt

SEQ ID NO: 26154 - DNA, 301 bp, Homo sapiens
aattccttacaaagataacttgcaaaactgataaaagatggaaaaaaaaaaaaaactgaatggctctgtacctacgaaagaattggattttcaagtaaaagccttcttacgaagaaagctgtgggccaggcgtagtggctcatgcctgtaatcccaggactttgggaggccaaggcgggtggatcacctggggtcagggcaggcggatcacatgaggtcgggagttcaagaccagcctgaccaacatggagaaaccctgtctctactaaaaatacaaaattagccaggtgtggtggcgcat

SEQ ID NO: 26155 - DNA, 349 bp, Homo sapiens
ctttctatatatactctgggttcaaattttatcttcaccgcttgtccaaaatgtcaacggtggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctc

SEQ ID NO: 26156 - DNA, 344 bp, Homo sapiens
gagaccagcttggataacatggcgagaccctgtctctacaaaagatacaaaaattagccaggtgtagtggtatgcgcctgtagtccagctactcaggaggctaaggtgggaggatcacctaagccaggaagttgaggctgcagtgagctatgaaaaaaaaaaaaacccactaaaactgaaataaaatagatagcaatttaactaaaagtttagaaatatcaagtttaatggtatgagaaagagatgaggctggacgcagtggctcacacctgtaatcccagcactctgggaggccgaggtgggcagatcacttgaggtcaggagttctgagaccagcctggcca

SEQ ID NO: 26157 - DNA, 424 bp, Homo sapiens
tctttttttgagatggggtctcattctgtcaaccagtttggagagcagtggcatgatcacagctcactgaagccttgacctcctgtgcttaagcaatcctcccacctcagcctcccaaatagctgggagcctcccaagtacaggagaatgccaccacacctggttattttttttaatttttttatttttttggtagagaccgggttttgccatgttgcccagtctggtctcaaactcctgggctcaagcaatcctctcacgttagcctccccgagtgctgggattatcgaccacgatttcctttttaatcttttggtaactcaactgactaggccatgttgtaccataaagggtagcagtgatagaaagtgaaggactaagaacaacactgaaaaaacaatagcacagataataagcattaagt

SEQ ID NO: 26158 - DNA, 738 bp, Homo sapiens
ctgtagtcccagctttttgggaagctgagggaggagaatcgcttgaacccaggaggtggaggttgcagtgagccaagatggtgccactgcactgcagcctggtgacagagcaagactccgtctcaaaaatataaataataaataaataaaaacaaaacaaaaaacacaggtggctcccactgcttcctgatggtgagtagcccgaggctgcaagatgagtaactccagaggcctcccgacggggcacctgcctgaagcacttgcctggtctagtctgtctcatccccagagccacacagctgtccactaccttacacagcttctcctgcatcccctacccacacaccgcagcctctctccttgttttactttacttgatgcatgttagaataataagtgtctttggtacagcccatatctatccaaaagtgagcttcaggaagggtttgtaggatatccgaagaatgtcagtccttccgggcagcagagttctcatcttcattgtatatgagcccctgggaagtgtgtgaaggatgcccttgtccaggctccacctagagacggacgcagtggatctagggacttttgagagctccaccggcagctttagggtcatgtgaattcctgcctggccgcatgttccatcttctctcctggcccagcctgccagtcatggaagattgagaggctagttactcatctttcttcattataaaatcttttgcttagcaaaaaaaa

SEQ ID NO: 26159 - DNA, 395 bp, Homo sapiens
ttggaattgcaaaacttcaaatattgttttccctctgttttaacaggaatagttgtatattaagtaagacagaggatctttccatgttaaagttgttagaaaaatataactccaggccgggtgcagtgcctcatgcctgtaatcccagcactttgcgaggccgaggcgggcggatcacggagtcaggagatcgagaccatcctggctaacacggtgaaaccccgtctctactgaaaatacaaaaaattagccgggcgtggtggcgggcgcctgtagttccagctactcaggaggctgaggcaggagaatggcgtgaacccaggaggtggagcttgcagtgagccgagatcacgccactgcactccagcctgggcgacagagcgagactccatatc

SEQ ID NO: 26160 - DNA, 509 bp, Homo sapiens
gggccaatagaaatgtatggctcagccaagcaacacacacaagggggaatgaatcccataggactctgtctaacctgaatgaaaaagaacttaatgatggtgaggctattgaagcagtaagaacaggagactgaaagtcctggattggcttcccattgactctttttttttttttttaattctgcatgaccttggatgggacaatgccttagtttctctgtccccctgagcttgcagaggtattgtagatggagtttcaaatctattgctatttttactgctattatcatttcataggtcttgcacagttctgagtaaaaatcagctttttcttaacaaaatgcatgctctaattgaccttaagaggttatatagtcaaaccactgtttctaggtaagattatatttcgtctaaacgcaacgatctactttctatttgaaaatctccagaaggggaggtaacatatcttagtatgttttaaattatagtactcaaaaactattcaaatc

SEQ ID NO: 26161 - DNA, 644 bp, Homo sapiens
ctgctcacacagagatggtagcatcacatggcatttgaagtggttattcaccagaactcactgcaatagcaacaagaggtggctatgaaagtattacagtgatacagtatgaactacagttaattttatgcatgagtggtttaatactgcatctttacatttgtttacatttctctcgactgggaatgggaccatgtctgtaagtgtttgtgtaagttttgaaaatttttaactttttataatagatttgtgtgtattttatggtagtaaatgataaaatagatgggtagctacatatttttatacattcatgacaactttattttaatttcgtcaatatttctcagctacattgttgtctgtgagttttttcaaactgtgatgtgttcaagggtcaattgtagttggtcaatgcctgtcctagactgtcattttcatttatttatgtatgatatctatctggttcactactgaatccctaatgtctggctcttattaggccctcaataaattattgaatgaatgaatcaatgaatgttcagaatgggcataatgggaaaaaattgggacttgaaggtaaaaggttaaaaaatgtatcttttgggaaaactttagttttcttttattatcaggtgatcatgacc

SEQ ID NO: 26162 - DNA, 491 bp, Homo sapiens
agaaagtcccagataagccagacatataggtgagccactgtggacattctaggcctgtcaagtttccacctaaaagaggaagctaggacatgactcaattgcccactgagataatggaagaattaataaatatctgaatgacaaaagtaatcaagaggaaaattctttgataatcagatacatgtggttgttattgggaagatatataatttaacataagcattcaagacactgcatgccacttaagtattcaataaatgttagctattataaccgctgttaaagaaatctcagtctcccaagtttctcttctatttattattttatccatcagatgtcagctatcccttgcttccaacttttggcaattatgaataaagctcctataaacattgtatgcaggtttttgtgtggacatgttttcaactccttttggtaagtaccaaggagcgcaactgttggatcatgtggtaagagtgtttagtttttta

SEQ ID NO: 26163 - DNA, 470 bp, Homo sapiens
agagtaagagatttccagtgaacatgtattctatgttttctttaataatataacatggattttaattcagtttatcagccatgccaatttatcagtctgctgaaaaatacttgaggttcatggtctgttgtaaattcaaagtgttcattgtcatattggggaagtttggctcatcgtttagggcccattatgcttgcgtatggtatctttatcacctgctagacaattatactctgatatatttatataaacttgaagacaaattctagtcaacttataaagacaaaagccaatatcagacggtacatttaaaacctgtgaatcaaggtttgactttagtggccttttcaccaaataatagtccccttttccttcccccctcagtttagcacagcggtaataacaccttagagaggaacctttcttacaaacaccttccctccttggtgattggaaggcatattttctga

SEQ ID NO: 26164 - DNA, 395 bp, Homo sapiens
cctaaaagctttggaagaagtcatttacttcctctttgcagtggctggccatgcagtcccagtgaaatcaatctatgttctgtaaataaattgttaataaacacactcacttattggcatcggccacaggaatagataaaatccccagccaattattcaactgttctaggaattgcatagttgatttgcagacaggtacaccctcttgataacctatgtaggttctctgtgggaatgcttcctgaactgcatacctattgcccgattatagaaaaagccctggagcaatccaaaagtctctggttcctgcaaagtcaaagagagagctgcaagtcatcaaatcttccccctccttcctaagagatgtagaatttgtggccaataaaacagatctt

SEQ ID NO: 26165 - DNA, 4545 bp, Homo sapiens
cagaaatcgttttacagaaattccttctgatgtctggttatttgcaccccttgaaacattaaatttatatcataattgcatcaaaaccattcctgaagccattaaaaatctgcagatgttaacataccttaacattagccgaaatcttttatcaacattgccaaaatacctatttgatcttccccttaaagttttggtcgtcagtaataataaactggtatccattccagaagaaattgggaagttaaaagatttaatggaattggatattagctgcaatgagattcaagtccttccccaacaaatgggaaaattacattcacttagagagctaaatataagaagaaataatcttcatgttttgccagatgaattaggagaccttcccttagtcaagctggatttctcttgtaataaagtgaccgaaattccagtttgttacagaaagctgcatcatttacaagtaataattttggataacaatccattgcaagtaccaccagcacagatatgtttaaagggtaaggtgcacatatttaagtacttaaatattcaagcatgttgcagaatggataagaaaccagattccctggatcttccatcattgagtaaacgaatgccctcacagcctctcacagacagtatggaagatttttatccaaataaaaatcatggccctgactctggaattggaagtgataatggagagaaacgattatccacaacagaaccatcagatgatgacacagtcagccttcattctcaagtctcagaatcaaatagagagcagacatcaagaaatgacagtcacataataggaagtaagactgattctcagaaagaccaggaggtatatgattttgttgaccccaacacagaagatgtagcagttcctgaacagggaaatgcacatattggatcatttgtatcattctttaagggaaaagaaaaatgttctgaaaaatctcggaaaaatgaagaattaggagatgaaaaaagacttgagaaagaacagttactggcagaggaagaggatgatgatttgaaggaagtaactgatttgaggaaaatagctgctcagttattgcagcaagaacagaagaacaggattcttaatcattcaacttctgtgatgagaaacaagccaaaacaaactgtggaatgtgaaaagagtgtctcagcagatgaagttaattcaccattatcacccctcacctggcagcccttagaaaatcagaaggatcaaatagatgaacaaccgtggccagaatctcaccctataatctggcagagtgaagaaaggaggcggagcaaacagattagaaaagaatatttcaagtataaatcaatgaggaagagttcaagtggcaatgaaaatgatgagcaagacagtgataatgctaatatgtcaacacaatctccagtatcatctgaggaatatgacagaactgatggtttttcacacagtccctttggcttgaagcctagatcagcttttagccgctcatctcgccaagaatatggggcagcagatccaggatttacaatgagaagaaagatggaacatttacgggaagagcgagagcaaatacgacaacttcgcaacaatcttgaatccaggttaaaagtaattttgcctgatgacattggagctgcactgatggatggggttgttctttgccatttagccaatcatataaggccacgttctgttgctagtattcatgtaccatcaccagcagtgcccaaactgagcatggcaaaatgtcgaagaaatgtagaaaattttcttgatgcttgtaaaaagttgggtgtctcacaggaaagactttgtttgcctcatcatattttggaagaacgaggacttgtgaaagttggtgtcacagttcaggcgctccttgaattaccaacaaccaaggcatctcagctttctgtggcttaatataacattttaaaattctaagtgtatagtttcatttatttgaagtgatttcaaatatttcaaattcatgaataagaatattccgtcaaaaatagtttgccttaggtcacgccttaggattttaaaaaaattacattgaaacatcaaacttaaacattgaattgcccgaacttctttgggggaaaactggattaacttaataagagtatttgataaactcaaattctctttttactaagtcagttgataatcttgattatttttcagaaagcagactgatactaaatttaaaatgtagtttcaatttaataatcacattaggtttaatttttttacatcatagcatattagtaaacatctggataaaggtaattttttttagcaatttagagcaattctatatttgagttatttaatacacttctaattctagtttatacacaatttcttcaatctttggtcttagttttctagaaaaaaggagtagaaaaaacaattctggctttatattaaattcttttagtattataggttggtgccaaaatattttcagttgtactgtagattgtttacatgtgaagtgcctgtgtaattgatgactcttacatagtcttaagcatttttgcaattttttaaatgtattaatagagtcaatggaactttaaaatattttagtagattttgtaaagtcagtaatatgtgaggatttaaatgagcctcacattgtgacatttgtggttttttagttagtccattgcagtttcccttaaattggttatttcatgttgtcaaaaataccaatgttaatatgattaatttatgctatttaattttgtgaaacttaatcatcttttaaaatgtattatttgaagagtattttatttctgtattgaaaatgttacacaaagcagtaaagtttttgagaactagtgaagtactaattatcaaggacattttgataaaactgccaaagtttgggtttatatcttccctttgagcagcattctatcagtgctgcctttagctatactcagagagcagcagttgaggaataggtttttactcaaaatctggccatttgtgaatcctgtaaaccttgtgatcttcaattactttgatgttaaattaaacacagactcttctataaatattttcatgagatactgtgttacacaaagtccttgttttaacttaggtatgggtaaatttacattggtggtattgcaggaatttttcaaaaacattactgtaatgaataactgagtttcctatagaagaacctgaataattacttttgtagtaaccaagcaagcatcatatcttaagtatgtgatcatttgcacttgttacctcttaatatggatgcaacttattaaaaatgttggcctgggtatttcaaagggtatatataaaaggtaaaaaactagtgtgccaaatggtataggaacaactgtactttttttgatcagttggcatgaagccatagaattaaattttggctttagaatacagatgtgttcattacattccccaagggtcaaattggagcttttaaagaattaaagcttctatgagtatatggtttaagaattaaattattagtaatttattattttaaatatttgacctcattagttgttaattttttagttggataaaaaaaaaactcgctgacataatctccctagtgaaaacttgggtaatatatgtaagaaatggcaaataaataccttagttaatgactttttatgtagaaatttgacagcattacaaattaagtgaccattaaaaacacagcaatcattcatactgctttcataggtgttatgatagtctctgattaatcaatctagtatgaattattttacaagtgttgtcctgtttcatatctttgaagtagtagtgaaattgtaggccattttcttataacatttcagttacttttcagttaattattcctttaaaaagaaaatacagcagaacctcactgtagcattctttactgcagagcaaaattcaatttaagatgggcttctctgaggtccacatcatggcagttcatttactcttgtgccaaatggcaacaccacgtctaaagcagtttcacagcatggtcccctacaatgttataccaaggctctgatgtatttcttttagtagtttctaagtgtaaaatttattctaaatgtttttatggctattatctatttcatcagttattgaattaagaatgattttcattacttgagtgggatttgtgatttaatgacagttgaataatcaaaaatattttattaggcccccaaaatttaatagatatctatttctgttacattttattactgtatggcacaagaaagaagtgacattgggtatgttagaaatgaaataaggagtaaaaatgcattaccatttgtttaataattatctttacagaatgctagtttaatgacttttttaactgaattttttgaataaatcagaaatgtttgtattggtcacagatctatcataattgcttttctgatgcatttaaaaataaatggaacacttaaatgtatattaccgatgcaaactgtggataaagttgaaaaaaaaaattt

SEQ ID NO: 26166 - DNA, 1038 bp, Homo sapiens
tggcttgatccccaaaggaattttctactccaaaatagaatttttctaggatgctatttctcagtccctggagatactcaaacaaagggcttgtcacaagggtttttgtagaagctattcttcacagaggttgggggagagattaagccaaaggatctctgaggtctttttcaaatctataattatgtggccttttgttcattgacttccatgtgttctagttgatcattacaaacctggcaggccttctcaagggttcagtaattagctgtcatttcccatttgtccagagagtgtccaacacaaaatacccctaagatcttggccaatagagaaatgtcatggaattttagaaatgacagtatctgcggagtttattccaagttatatcatttcaaagatgaagaaacccaggctcagagggagccatcacatccacaccctgtcacccttcgtggccagtgccagacagtagctagttggatgctaaaagtagaatttagatatcttaacaataagcccagcagtctttcaacttcattcgtaaatcatttttgttttgagcatctgtcacgtggcagcacttgcctggatactggagagctgagaaggaatgcgacaggcaagtcctactctcacagtgtatacattcaggaggaacaagacacacagtgccaagtaaataaagtagctgaacttcatcaaatgattttattcttaaagtcattaaagcatgtaatgttcccctttttttgtttcaggggtgtacagattgaagaagtgtaggtgtttatgtggttttagtgacaaaccccatgtgctttcattgattttatgttttatgttaaaacatcaaccgcaaggtaaaatgcatattgtatgttgttggatacgtacttaactggtatgcatcccatgtctttgggtactagtgtatgaattctaatctctgtaaatgaaatgttgtatgtgttaatatatttaatagatgtaacttaataaactggcattgaagactgaagaattttcacactgtca

SEQ ID NO: 26167 - DNA, 1638 bp, Homo sapiens
ctgcctcggagcccatggttcggacgtttgcccgagccgtttcccggggccttccctccagctccgagcgtctggccgtgtccgcggcgatagcatcgccccgttacggcctctgcgggagggggaactgaggggacgacgcgggctctggaaacatttcggacccgtttcgggcaggcatgagtcttccgagcgccttgtgattcctcggggggctcaacgtcgaaagaaaggcgagggagactctggggcctgggccacgctgtgcgggagtaagaggagccgaggacgaggctgacggccgtgaaactagccgagtgccacaaaggaccttcccctcaccgcctctggcgctcctttccttgcagcctggagggccggctctggctctgcgcaggcgcgcgggcgcagcccctctcccaactcttgtttgctctttctggccagcgaccccagtgtggggcacgcgggagagccccacatttcttctagtcgcagtcccgccggcgtggggtggcccctgaccgtgcaacgggcgcaaggctcgcacccactacggcccctcgggcggcggagcgaggctccgcgaacccgggactgggcgcgccaggcccgcgcgctgaggccccctcccccggctctggccacgcgggctgctctgcctctgtgagtgtgcgggacacagagccagggggagggagggccgtgttctgcggtcacaggcagacaggagtgccggaagatgcagtctggagcccccgggggactgtgagtgaggtcttctccccggtccctccttagatctcccatttcccagttctcccctcccgcccacaccttttttgtcattccagacggttccggcccagcagcagccgccatccccacgttgggtggcgagatccgaaagtttccagctacgaacagtttgcttttttttttccttgatcgctttttttggcaagggcggagagcaccagtagcgtggggggtttaaatgcactttccctgaatgcaacagagaaatgccgggctggagggcaaactccaccgggacagggaggcgggagatagcctgagcgcccccccatcccccacactctgagcgtcgcaaccccgggggcacctccagggactacttgccttgtgcgtcagcgagtgacagcgtcacacacacgccccctcccgcacatgcccgctgcaccctccctttccccctccccttcccttctctcttttcccctagctcttcccaccaggcagagaggctcagccgacccacacgctcccagagcactgaaagctaaaaatatagccggtgtgttagcaacagccttcccattggtcgggggaaagggagaagcggtgtctgattgggtttaggatccagccgctaagactgggcccttgggagtgtgcgtttgcgccagcgggcacggcaagggatgctggtatttgtagtcattgattaaggcagccatgtaaataggtgggtttacatcccagttcggctacctactgtgtgatcttgatttaatgcagcaaaacgcttgacatcaccaaacctcagtttccccatctataaaatggagctcgtgtcggggattaaatatgatgctgtatgtaaagcctggctca

SEQ ID NO: 26168 - DNA, 485 bp, Homo sapiens
gtgtggtggcaggcgcctgtaatcccagctattggggaggctgaggctggagaatcacttgaacccaggaggcggaggttgcagtgagccgaggttgcgctccagcctgggcttcagagagagacgctgtctcaaaaaaaaaataaaataaaaataaatgtatattagtacccttagtaaatatgcaggtgaaggttttccaagttttcacagaaaaaaaaatccgcatttctctgcctagatcttcaggaactagtacattggcagttttcagtaagactcctctctgtcactgccatacgaaaaagaaagcctatgggttttgtttttgttttgtagtgggaaaagttggcctcataattggccctggattccaggactttttttttcggtagtgtgtcttaaccttctgacagctgctgtgacgaagctagaaagcttaatgagactgtgtggtaaaggatcctgatgttcgaaaaaaaaaa

SEQ ID NO: 26169 - DNA, 317 bp, Homo sapiens
tttttttttttgagacagagtcttgctctgacacccaggctggaactctgtctttaaaaaaagcaaaagaaaaccaacttgtagaaagtcactgagctggaaccagaactagaatagggctctactctttctgggtccaaagttctttaaatcagcaacccctcttactgcctatgtaagggtatacctttagttcctgttgacttgggatgtacaaagaatgaggtagtctaagagagtaacagcacactggctgtggagtcagaaagactccacctctaaactttgtttccatctctaaactttccagcagtgtg

SEQ ID NO: 26170 - DNA, 244 bp, Homo sapiens
aacctataaaacagggaaaagctccttgccattggtttttgtgacaattttttagatgtgacatcaaaagcacaaggaataaaacgcaaaaataaattagaactacatcaaacaaaaaagtgtctgcacaacaaaggaaacaacaaaatgaaaaggcagcacatgtagcgggagaaaatatttccaaccatatatctgataagctattaatatccaatatatataaggaactcatataactagc

SEQ ID NO: 26171 - DNA, 378 bp, Homo sapiens
taattttgtcagttttaactcctaaatatctttcagtttcttcgacttttctctctttctgtcacccctcttggcctaagtgcctgttgtcttttctctgggctacatcagtagtctttatatttcccgattccctgctcactcctttcctccctgcattcattctttcccctgtttcattctccacatttctgccaaaatgatacagcacactatactttttcctttattgtgcttcacacagttcataattggatatttgcaggattattttgttgctgttttccccactatactctaggcgtctaatttgcttactctagaagtttgagcacttggtacagcatgtagtatgtagagtgtgtatgtatgaatgaa

SEQ ID NO: 26172 - DNA, 305 bp, Homo sapiens
gcggccgcctactactactaaattagcggccggtcgacagatgccgtgagcaaaataaaggagggcagatgctggcaaaaaccagataccacttccctccacctgggagccctccccattccatcgagagggcgaaggggcatgggactggtcggctgtgtgggggcgtgtgctaaattcaggaatgtggctcacgtgatcgcatgtgacacgtgtctgtgtggctgcctggagacacactgcatggcccactgaccgtgtttctggggtatatcagagtgggtccagcatcaaaggggccccag

SEQ ID NO: 26173 - DNA, 404 bp, Homo sapiens
gcttgatgggttactatactactgatgatctatatttcctgtcagttgcattttagttattccatcctgggaatactgccattcattgtgattggatttggatgttccccaactgttcttgggcatgacattaaaaaaaaaggtttttgaacaaccagctaatctttattgtgcatggagacacagtaattatactcccataggcgctttttgtttctttggtcttggagcatccctcagcaacctattctgtggctgatggtacagtagctattaatagtttatacaggaggttgggcgcggtggctcatgcctcccaccactttgggaggctgaggtgggcagatcaccagaggtaaggagttcgagaccagcctggccaacatggtgaaaccctgtctctc

SEQ ID NO: 26174 - DNA, 477 bp, Homo sapiens
ctgggtggcagagccagaccctgtctcaagaaaaaaaaagaaatttattacatttcatataaattgcatttttctcaggtaaagaggaatctaacgttagactaaggttcttcatcctcttttcatgaaatctcaaaacatggcagaggacttttttctatgaatatatgtgttatagtattagaaaacaaaatctgtggaatccttgaaattcagaaggcaaacaaaaccagaccaatgctggaaacacatcctagtcataacacagaggaggatgatggcctcagcacctccacctcttcatttttctctttgttatggattaccctttcttcttccccacgcccccaccttcttgtcttccttcacaacccacaatcatgttaataataaattattatgggcatagtgaaatgaaatggtgttttgtcatagctaaataccgtagttacaacaaacaaatatatcaattctgtt

SEQ ID NO: 26175 - DNA, 1377 bp, Homo sapiens
ggggcaaatgccattgaaaccgctagtcttatttcctttctacttttctttggcactcttactgcctgtaaggagtagaactgttagggcacactgttgctatacagtttaactcccattttcatgttttgtctttcttttcccatttctggggcttacctcctgatacctgcttactttctggaagtagtgggcaagtaagatttggctcttggtttctaatttttaaatttctgaatactgccctagtctgaacttggcctttatagattaatctttgcttcacatttttagtgttgtatttaaactattttataatttaaaaatagattctaatctgaagatacttttcaagaaatattattaactgatgtcatcctcatcccagcagctcatctgttaggaatgaagttgagatgcttctattccatgtttttgtatttgggaaggattcaaagttgaaggtttattgtcgttgggtttttcagatggtgacatgtaaactcaggatagcaaaccctaatgttcacacagtgctctgcctctgcatctcagttgggatagttgctccttttgagtgttttaatcatcgtataactaatcatagtgccaagaagttcataatgtgttatgtagctaatgtcactgaaaaacagtcctaccattttaggtaagaccaaacagagtctctaacccaaggacttgttacacctgacaacctatagtatatttgctttttctcacaaaatgaaaccaattttgccgaaagctagctgggataataggatcatcacaagttgcagtttctataactaaaattagattgaaatctcttctgacctagaacattttacttcaggcattcagcagatttcagaaagaattaccttattttaagttagtttctttgttagtttactgtgtgtctcttattcaataaacaagcagaatttgtgtcctgccctatccatgtcttaaagatgagaagttggatccactgagttagtttcattggggcgggggaaagaactgtaattaaacttgtttaatccttattttgtattgtagctattttttgtaaaagcaacttaaaatcttttaaaaattttatagtgacattagagacaatggtcatacaaattatcacataaacatggacttgaaaaattaggcttttcataaaacacatcacatgtcattgactgctttttagaaatacacttccaaggcagtacatctgtattgctactgaaaagtgccatttcacagaacacagacttctttttgctctttgacatcttgaaaacatctgtttttcttttttaatacaaaactttgtgctcaagacaaagggaacaccaggatcctgtagtcagc

SEQ ID NO: 26176 - DNA, 1905 bp, Homo sapiens
ggggcaaatgccattgaaaccgctagtcttatttcctttctacttttctttggcactcttactgcctgtaaggagtagaactgttagggcacactgttgctatacagtttaactcccattttcatgttttgtctttcttttcccatttctggggcttacctcctgatacctgcttactttctggaagtagtgggcaagtaagatttggctcttggtttctaatttttaaatttctgaatactgccctagtctgaacttggcctttatagattaatctttgcttcacatttttagtgttgtatttaaactattttataatttaaaaatagattctaatctgaagatacttttcaagaaatattattaactgatgtcatcctcatcccagcagctcatctgttaggaatgaagttgagatgcttctattccatgtttttgtatttgggaaggattcaaagttgaaggtttattgtcgttgggtttttcagatggtgacatgtaaactcaggatagcaaaccctaatgttcacacagtgctctgcctctgcatctcagttgggatagttgctccttttgagtgttttaatcatcgtataactaatcatagtgccaagaagttcataatgtgttatgtagctaatgtcactgaaaaacagtcctaccattttaggtaagaccaaacagagtctctaacccaaggacttgttacacctgacaacctatagtatatttgctttttctcacaaaatgaaaccaattttgccgaaagctagctgggataataggatcatcacaagttgcagtttctataactaaaattagattgaaatctcttctgacctagaacattttacttcaggcattcagcagatttcagaaagaattaccttattttaagttagtttctttgttagtttactgtgtgtctcttattcaataaacaagcagaatttgtgtcctgccctatccatgtcttaaagatgagaagttggatccactgagttagtttcattggggcgggggaaagaactgtaattaaacttgtttaatccttattttgtattgtagctattttttgtaaaagcaacttaaaatcttttaaaaattttatagtgacattagagacaatggtcatacaaattatcacataaacatggacttgaaaaattaggcttttcataaaacacatcacatgtcattgactgctttttagaaatacacttccaaggcagtacatctgtattgctactgaaaagtgccatttcacagaacacagacttctttttgctctttgacatcttgaaaacatctgtttttcttttttaatacaaaactttgtgctcaagacaaatcttacatgaaactctcataaaccatgaaaatgtagctggccttcgggccttaggcatgaaataagcatgaggaacatattcccctaacttctacccccagcccagcaagttatcctttaagaaatctcctaggaattctggagtttgaaaacaattgctctatgttattcctgcttccagtctctaagtaacaagggcatttaaaagcatagtctcttaaggtccactatagtggttctttatttaaggaataactcagctgggtgcagtggctcacgcctgttatcccagcactttgagaggctgaggcaagcagatcacttgaggccaggagttcgagagtctggccaacatggtggaaacccatctctacaaaaaatacaaaaattagccaggtgtggtggcgtgcacctatggtcccagctatttgggaggctgaggcaggagaattgcttgaacctgggaggtggaggttgcagtgagccaagattgtgccgctgcactccagcctgggtgacagagtgagactctgtctcaaaaaaaaaaaaaaaag

SEQ ID NO: 26177 - DNA, 161 bp, Homo sapiens
aaatgctctagacagcaaacaaatattttactcactggaaacatacattctatgttatattccacagagactgtaactgtgaggataggaaattgttaatgacagctgtgtccctagttccttagaataatgcttcgcacaaagtaggttctttacaacta

SEQ ID NO: 26178 - DNA, 374 bp, Homo sapiens
tttacacatgaggcttcattataaaggaaaggtcattcaaagtaactgctgaagttgttggctttgactgagaaaatctaagcctgtcccgtttacttgcctcaatcatcaggagaatgcctaccccaaccacacacattatatagagggctgtgttcctaaaggagacttctggtactacagaggagaattaattcaaagcagatagaatgtggaccttgccttgagtgttcctggtgtcatgttgcaatctctggggagcagtgaatctatatctaatgtataacaaaggccaaggtcttgggaatcatggaaagaagcaattcaaatgttaaatatagcacatttttttgtgtgtgcattccctcatgtgt

SEQ ID NO: 26179 - DNA, 449 bp, Homo sapiens
gtccaaaagaaaagataaccccaaagattatgttttattgtcaccagtttgtttgttcattgaaatctaacctagccatcttactctagttctttttgggttttacgcatatatgtgtgtacaaacacacacacacccctaattcctcaaatgctcttggcataagttttatctcttactggtctcctcaaggcgtaaaataaatctttgaccttgatcattttaattttaaaaaaggtaaaagtcgtgagaaaaaggagtgttttatatgaaaagaataaagggacatataattaaggcaatacacaaacctgactggatcctggttcaaaaagaacagcttgatacaactgaggaaattagaacatgctctgggtatcagatgctactatggaattccccatcattctcctgggtgtggtaacagtcatggttatgtaggagaatgt

SEQ ID NO: 26180 - DNA, 416 bp, Homo sapiens
  misc_feature (2)..(2): n is a, c, g, or t
  misc_feature (187)..(187): n is a, c, g, or t
anttcggcacagcctcggataatgccactgaatagtcaggaattgactccaagctgttttgctgcttattcacctgtactaagttgttcgtttcttatagtcaatatccctcaatatcaactttctgagacatgggatcttgcctttcactaccatattcagattaaaggagtttatttatttattntattatttattttttttttgagacggattctcgctctgtcgcccaggctggagtgcaatggcgcaatctcggctcactgcaacctccgcctccagggttcaagcgattctcttgcctcagcctcccaagtagctgggattatagacacccgccaccacgcctggctaatttctgtatttttgtagagacagggtttcaccatgttggccgggctggtctcaaactcctg

SEQ ID NO: 26181 - DNA, 345 bp, Homo sapiens
ttgagatggagactcgccctgtcaccaacgctggagtgcagtggcgagatctcggctcactgcaacctctgcttcccgggttcaagatattctcctgcctcagcctcccgagtagctgggattacaggcgcacaccaccatgcctggctaattttttgtatttttagtagagacggggtttccccatgttggccaggctggtctagaattcctgacctcagatgatccacccacgtcatcctcccaaagtgctgggattactggcatgagctaccacaccaggccaaaaatatctttcaaaaacaaaagttaaatgaagaattgttcatacatacaaaagatgaa

SEQ ID NO: 26182 - DNA, 472 bp, Homo sapiens
tctcaagcgtcaaaatctaatggaatttgtcatgctatgtttctgacttgcttgggatacaagatccccttccttctaatttctttcatctgaaatgagaatgtctatcctttacctgtcacccattgtattttggaagcagataacttgtctgtttttcccaggttcacagctggagatgaacttctccccagcatgattcatacctgtaatcttacccattcttgatttagatgagatttggatttcgagttgatgctagaatgggttaatacttttgaggatgttgggttgggatgaatgtatttcttatgtgagaaggacatgacctttgtggggactgaggaaggaatgtggtatttacttgtgtcagccctggaaaacaatgagaaaagatgtttgccctgttttattaatttttcattgttttataataaagttttaactaatctagttcaaaatgctgccagaa

SEQ ID NO: 26183 - DNA, 419 bp, Homo sapiens
gctctctctgaactcccttaagtggctgaagatagagcctccaaaaagaaacacaattgtcataggtatcctccctgggaatctcatcagtgaaggaagattaactcacaggagacaccacactccagaaagactttgtcacaaactatccattacctcttcttctgatgagatccttggagacaacttttattacctgagagatgttatctgtataacaagacaacctttgttctccatgcattccctcctcttactcccctgcaacttgtatagacaccacccccgataaaccaccaacccctactcctttctttagctcaggatgctataaaaacttctatcatctggcccctcttcaagtcctctactttgtgggactcctgtgtgtaattaaaatagcttttctcctactaaac

SEQ ID NO: 26184 - DNA, 378 bp, Homo sapiens
ttttttttcaaaatgagggcaaagagaacagttcaaatcttgccacttaattctcatttctgggctaggagacctacctttctcacatttaacaactatagcattcttttacaagaatggcatgccctgctaaagaattctggaaacattcagataatacctagccaatgaagatcctaagattattgcaacagagaaacaactttagtccctagttacatgaccttgagcatgcatttgttttctctaagcctttgtttcctcatcatatgatgttagtaagattaacctcacatggttgttttaagtataaagtacaccagtgtaaatgaagggcctggcataatgtgtgctacctgcagaaacacatagtatgtc

SEQ ID NO: 26185 - DNA, 483 bp, Homo sapiens
gcttagttcttcttaattcttctgcaactgtaagaaaataattctttaatctaaaccatattctcttttagctcattcctctaaagtgaaaaaaatctcatttgtatggtgttccccttctgaagttcatgcattcctcaaagttttgcaagcaaaacaagaaaaactatttcttctacaagcatatcaggatttaaagtaattttctgcaatgttaggcaatgttttgtgcctttgtgttcatgttttcggttttagttttaattttctcaaattcttgaagtgtttatcttcaggaagcagtttctccaatagtatgcaaatcccaaacctgggtcgtgaatgtattgctcagaatcttcaagaatataggagatttttcaatgtgacagaaggtaaaactttgtcttaaaaaagaaaaaaagttaaaaccttataaattatgaatgatatctctctgtaaagctgttatttaaaaaaaaa

SEQ ID NO: 26186 - DNA, 2141 bp, Homo sapiens
gtgctgactggcaggcattgctgggatgggtttccactagaatagctttgtgatgtgggatgggtgttctttgtggtttggtttttcttggatgttgtttctagcttggtttatccaagtctggttctctggccctctgagagatctgtgaactaaatagtatcttttaatccctttttgcttcaaccagcccagtcacagccagctacataatttgtggagcccagagcaaaatgaaaacgtaaggcctcttgttccaacacaggggaaaatgtgctattatctgtattaaaatataaagctttttctttgttctgtcgtcgctctctccacttgtcatagtgtttttaaatttgctttttaatgtcattctatgagaagaaaaattaaattttttaattcttaggatgaattttaccattcatctttatattgtgtaatgccgttttaaaatgcaaatataagagcatttcaattgtatgtggaatcaccaaaattatacaattcatagcttgtaaatgcatatgtattttgtgctatcagagcagtgtaaactctgcacaaaacaaaactatttttgttttccttcttgatatgcacacattctaccaacattctccatcttctgcttactgatgagtaaggaaggatgaaaggaaagggagtgctgagttgccctactttccctttcattctttgtcatcattttttgtgtaaatggttggctaatagtggtaagtaacacatgagtaaggaaggatgtgatgtaatcacttgtgtttcttaaagatgctgttgccttctttctgcacctgaagcaagttcggatttgaatgaaaagtgtagcctcttggaactgtctatgcctccactaactcagtcatagatgttacatgcttgttttgtattaactttgttactctcttgagttcctgcacctcataggtccaccagaatcctttgtcatgaggcatcatggagaccatatgcaaatagaacggcaaggaagaaaggatacatacctctgcttgcatattatgctctgctataccactggacttacaaaacagatagtcaaacataaaagtattacaattttcaagacagtgactacagagcattaaaccaagcactgggccctgtgtgactatacttgtcgcatgttcatgaagttgatggctctgagcgcttgggtttctcaaatggggcttctggcatttttggtgaaacagtttttcattgtgcaggacatttaacatccctggcccccatgcactacatgccactgtaacaataaaaaattccccatgtatttctaaatgtccccaaagaggagttgctgctctccactaaactcctagagtgacctccactgtgtacagctatgaaccatgagcactacagagttgagttaaaaaggatttcaaattctcatatcccggaaagcagaattatgatgacttttttcgtattgtcaaataaataataccacctacattgatgatgaaacaaatatttgagataacaatttaaaggtggttagtgggttctatgtgtcacatataaatggtagttgactccagatagatggcaatttctgatagtttaaaaaaaaaaagaaaagagcagagcaccacagaaaagcaaagagaaccatcttaccttcattatcttcatcaggtagcccccaggaaaaactaagaaagttgtcataataagatatgctactcttattacattggatttggaatttagttttatcatatctatttttttttaaggtatagttcttcatttaagaatattaactgtcagggccaggcacagtggctcaactctgtaatcacagcactttgggagaccaatgcgggaggattgcctgagcccaggagttcgagaccaggctgggcaacgtggcaaaaatccatctctaccagaaatacaaaaattagctgggtgcgatggtgcatgcctgtagtcccagctacttgggggctgaggtggaaggatagcttgagcttggggaggtcaaggctgcagtgagccttgagcctcatgagcataggattctggtggacctatgaggtgcgagaactcaaaagagtaataaagttaatataagacaaacgtacatctatgac

SEQ ID NO: 26187 - DNA, 203 bp, Homo sapiens
gtcaataataaatttgaagaatggagaataatacattatcacgtgccagaccttatgctaaacactggatatgttatattgtgtttcatactcaggatgatgctacggtaggtaccattattatcttattttacttataagaaaacagaagcctggagaagttaaacaatttcctcagtatcagaaagaaccaagatcaaata

SEQ ID NO: 26188 - DNA, 515 bp, Homo sapiens
gcatccttatccttcagacggcggcaattctgcagctgctcattgaggacatgagctggcatctttcccggtaggactgcggcacgtctgtagccacgcactaaggacctgggtaggcgtcatgaccctgggagcagcggcacagctgcgactgcgtatggaggacccaggcaggctcctcactctgccgactgcagcgcgcctgtggttgtgcaccaaggacccacccagacaggcgttcttaccctgtggacagcggcacagctggggctgtgcaccccaagatccagctgggcattcttatcctgccgactgtggcacgtctgtggccaggagtttttatggtgtggacagcagcacagctgcggctgcacactacggacccagacgggcgttcttgccttgtagactgtggcagggcggtggcggggcacccacgatgcaggcgagtgtattaccctgcgactggcaacacaggctgcgcagccaggactcaggcgggagtccttactctg

SEQ ID NO: 26189 - DNA, 484 bp, Homo sapiens
tttagttacctttaccagtgctctttatttcttcatgtggtctcaaattactgtctcgtgttccttcatttcaagatggactccctttagtatttcttgtgtgacaggtttgctaatgacaaattgttggttttgttggacataaaattcttggttgacagtcttttttccagcactttgaatgtcatcctatggctttctggcctccatggttactgataagaagtcagctgttaatcatgtgaaggagctcttctaaatgattaattgcatttctctttcttcaagactcttttctttggattttgacagtttgattatgatgatgtgtataggtgtggatctttttaagtttgtcctagttggagttcattgagcttcttggatatggagataaatgtttttcagcaaatttattttgtttttcagcaaattgtttcttcaaatattatttctgtccttttctcttctactaggactctca

SEQ ID NO: 26190 - DNA, 615 bp, Homo sapiens
gtgaagacttatatgaaaaatcagctgttactatgtaaatatgtcagtttctgttaaccagatattgcagtgatgccttaaaggggctggtgcttaagcaaaaatgctttgtagagcagggaagaaggcagcactgtgaataaaagtgtctggtttttgtgtttctagaactgcctgatgctccatggggattcttcatgatgatttttttttgccttagagattatatatgcttatgttaatttatattagatggtatataaggggcttgataataacatgtctggtgcctcaggggctcataaataagaaagtacttaaacacacacaccaaaatttttgagagtgataattttaaaaataaataggaaaaaaagaaaggcttggtaaacactggctacttcggactggtgtcttcattgttgttactcagcagaggtagctgttaaacactgagtgggcatgagcccacaagggctgcggttggagcacatgacagtggttactatacatacgtggatcacttgttatgtaagtgattcatgcactcccagtgcccttggttgggcttattctcaataaaaccagtatcattgttctcctcaaattaaaaaa

SEQ ID NO: 26191 - DNA, 445 bp, Homo sapiens
agaccagctttctgggagtcatagtctgctacagctcttccttcacttccaacagataatcagtgatgtgctccttatcccttttattccccaaacagctgttataaccatgtctttgattattcttttttgctataataatttgtgttaccacttattctctcctgaccatactattttaacaactttcagctggtctcctttctgtcttagcctaattcacactgatgccaggatgatctttagaaaacacaagtatgatcctgaaaccccatctttactaaaaatacaaaaaattagccgggcacagtggcacacatctgtaatctcaggtgctcaggaggctgagacaggagaatcacttgaacctgggagtaggaggttgcagtgagccgagatcgcaccattgcactccagcctggggagcaagagtgaaactccatct

SEQ ID NO: 26192 - DNA, 636 bp, Homo sapiens
tcttagatgccacacagtcaggcctcatgacactggaattgcgatgatcactgttaggaaacagcatctgttccagtgtggcccaaaagtaactctaaagggatgtagttactgtctccttagaagggagcacgacttgctccctgctctattaactctctattaaaagaactctattcaaaattggatagcaaccaaccaaagcacacagatttttaaaatttttctccagggcattatgaaaatgtaccattcaaaggcaggactgtaaagtcagagtcagcagtacagagaagccaagaacagagggagtagctgggtctcaaagtaatctttgaatagaaaaggattattaggctgggtacagtggctcacgcctgtaatcccagcactttgggaggcaggcagatcacctaaggtcaggagttcaagaccagcctggccaacatggtgaaaccctgtctctgctaaaaatacaaaaaagttagccaggtgtggtggcacacacctgtaatcccagctactcgggaagctgaggcacgagaattgcttgaacctgggaggcggaggttgcagtgacccgagatcacgcccctgcacctcagcctgggcgacagagtgagactctgtctcaaa

SEQ ID NO: 26193 - DNA, 455 bp, Homo sapiens
aactcagtaatcaagataaattgtatcttaatgcaatatttttaaaaatcaaaattaatgctaaaaaccatccataatgagcaaaatatcaacgttttaaagacagcatctgacagtgtcatactggctttgttgagcctgtggccaaaggaaaaacgtgccttcatatacatattttaatgtattctttaatggtaattttctcccaaatcgttgaagtagttgaaaaatatacactgaaaagttagaagtaagtgtattaaaactcacagcattacttatgttttattttatttataccccaaacagaatttgtatcaattttactttgctgggtttaatggaagcaaactcatcgctaatattttcaaaatctactcctggaaagaatttaactgtgaaaaaatagattatttatatgtatgaggctagccgggcatggttgcgaatgtctg

SEQ ID NO: 26194 - DNA, 415 bp, Homo sapiens
aataagtaagttaagctgactaagctttaatgacacatagttatgatgctgttcaataaataaaaatggccaaatattcatttaaatcactaaaattattatacgcaacatggtttaaagcattattgtggaatggcattattgagtttatttgtttgcctgttttttttttttttttttactttagttttgccattttagttcatggtaatggagctaataatggatcagttttgccacttcacatggtccccaaacatgaggcttaatgactgtgatggttaattttgtaagtcaatttgattaggccatgcagtttccaaaaatttggtccaacatcattgctgggtgtgtttgtgagagtgtttctggatgagattagcaggtgatttggaagactgaggaaagcagattg

SEQ ID NO: 26195 - DNA, 420 bp, Homo sapiens
actttagatttcaagtatgttagcagcagtaattagggatgttttcctctaaggaaaattatagttataaaattattatttgttagaaatgattcctgctacttcaaattatttatccttaaatgtagaggattaacaatgaacaacttgaaataacttggttatcacctcagaagtttagtttatcactgatttaatgaagaagggcaagaagaggaaggctttatgataatgaggagaatgccaggtgagcaagttgtcaccgtagaatcagaatggacgttatcatccgtagtgagaatggcaaatggataatcaacatcagcccaattgccagactaaaacatcattatgacagacttcatttgcaagaattcttaaaacggagaagctgaagaataaagtggccagtgcaaaaaa

SEQ ID NO: 26196 - DNA, 3317 bp, Homo sapiens
tcccaccccttgcgaggcccctccccgggccgcgcgccctggcgcgcgcacacgcgcacacactccccagtcgcctgtaccaaccaccttctcaagttgtagcggtcgctcgcctggggttctccgtgggcggccgacgggcgcgtgggggagggggttcgggccgcccagcgcggcaaggagcgagtgtgtgcacgcagagggccggggctacggggcagcgccccgggcgatgaggggccggcgttgaccgggaagagcgggcaccgcggcagtggctccgaggggacccgcgatggcagcgccctgagaggaggctccaggcagggcgggctgcgctggcagcggccgctgaggtgctggccggccggctggctggcgacgggggcagaagcgacgagaggcgcgctcggcacccgcacccccgtgcccccgcctcagttgtctaaacttcgggctctcttccacccgctctgcgcgcccagagtcaacaacttcttcacccccctccgcccccgcccttccctccgtcagccccgggagctcgccgcgcgccggggaccaggaacctccagcgctgagatgtggccgtgaggcgttggcgggcggcgaggagaagctcggcggcgtcccggggccggagggccgtggggccggggcgcaggggcgcgagcaccccgcgcctctcccccgcctcctcctgccgtctccgccgctgcccgtgccttgcaagcagcagccggagctgccaagcgtcagggccgcggagatgtcgtcgtcgtcgccgccggcgggggctgccagcgccgccatctcggcctcggagaaagtggacggcttcacccggaaatcggtccgcaaggcgcagaggcagaagcgctcccagggctcgtcgcagtttcgcagccagggcagccaggcagagctgcacccgctgccccagctcaaagatgccacttcaaatgaacaacaagagcttttctgtcagaagttgcagcagtgttgtatactgtttgatttcatggactctgtttcagacttgaagagcaaagaaattaaaagagcaacactgaatgaactggttgagtatgtttcaactaatcgtggtgtaattgttgaatcagcgtattctgatatagtaaaaatgatcagtgctaacatcttccgtacacttcctccaagtgataatccagattttgatccagaagaggatgaacccacgcttgaggcctcttggcctcacatacagttggtatatgaattcttcttgagatttttggagagccctgatttccagcctagcattgcaaaacgatacattgatcagaaattcgtacaacagctcctggagctttttgatagtgaagatcccagagaacgtgacttcctgaagactgttctgcaccgaatttatgggaaatttcttggattaagagcattcatcagaaaacaaattaacaacattttcctcaggtttatatatgaaacagaacatttcaatggtgttgctgaacttcttgaaatattaggaagtattatcaatggctttgcattgccactgaaagcagaacataaacaatttctaatgaaggttcttattcctatgcatactgcaaaaggattagctttgtttcatgctcagctagcatattgtgttgtacagttcctggagaaagatacaacactaacagagccagtgatcagaggactgctgaaattttggccaaaaacctgcagtcagaaagaggtgatgtttttaggagaaattgaagaaatcttagatgtcattgaaccaacacagttcaaaaaaattgaagagccacttttcaagcagatatccaagtgtgtatccagttctcattttcaggttgcagaaagggcattgtacttctggaataacgaatatattcttagtttgattgaggagaacattgataaaattctgccaattatgtttgccagtttgtacaaaatttccaaagaacactggaatccgaccattgtagcactggtatacaatgtgctgaaaaccctaatggaaatgaatggcaagcttttcgatgaccttactagctcatacaaagctgaaagacagagagagaaaaagaaggaattggaacgtgaagaattatggaaaaaattagaggagctaaagctaaagaaagctctagaaaaacagaatagtgcttacaacatgcacagtattctcagcaatacaagtgccgaataaaaaaaaagcctcccacctctgccggataggcagagttttgtatgcttttttgaaatatgtaaaaattacaaaacaaacctcatcagtataatataattaaaaggccaattttttctggcaactgtaaatggaaaaatatatggactaaacgtagccctgtgctgtatcatggccatagtatattgtaacctttgtctaatcattggatttattgtgtcacttctgaagtttcacagaaatgaatgaattttatcatctatgatatgagtgagataattatgggagtggtaagaattatgacttgaattcttctttgattgtgttgcacatagatatggtagtctgctctgtatatttttcccttttataatgtgcttttcacactgctgcaaaccttagttacatcctaggaaaaaatacttcctaaaataaaactaaggtatcatccttacccttctctttgtctcacccagaaatatgatggggggaattacctgccctaacccctccctcaataaatacattactgtactctggaatttaggcaaaaccttaaatctccaggctttttaaagcacaaaatataaataaaagctgggaaagtaaaccaaaattcttcagattgttcctcatgaatatcccccttcctctgcaattctccagagtggtaacagatgggtagaggcagctcaggtgaattacccagcttgcctctcaattcattcctcctcttcctctcaaaggctgaaggcagggcctttccagtcctcacaacctgtccttcacctagtccctcctgacccagggatggaggctttgagtcccacagtgtggtgatacagagcactagttgtcactgcctggctttatttaaaggaactgcagtaggcttcctctgtagagctctgaaaaggttgactatatagaggtcttgtatgtttttacttggtcaagtatttctcacatcttttgttatcagagtaccattccaatctcttaacttgcagttgtgtggaaaactgttttgtaatgaaagatcttcattgggggattgagcagcatttaataaagtctatgtttgtatttt

SEQ ID NO: 26197 - DNA, 465 bp, Homo sapiens
ttaaaacaccgcaatctctgccgcctgagttcaagcgattctcctgcctcagcctcccgagttgctgggattacaggtgtgagccacttcgcctggccccctctttctttttaagcaaaattcggaaagaacaatttataatttaaagaagatgaatccagaggttatctgtaatcttcaggagcttaggtctgaggaagtcagagttattggatagagaaaagagagaaacaaacacctgctttctttgtatcttgaagaggtttacagattttgaactaagcttacagctataacttttttctgaaagtgatctttaaaatacttcgttttgaattgtccaattcaattacacatacaacaacgaacgtaaaattattttttctttacagatcagtgctaacatcttccgtacacttcctccaagtgataatccagattgcggtgtttggggtaccgagctcg

SEQ ID NO: 26198 - DNA, 410 bp, Homo sapiens
tcccaccccttgcgaggcccctccccgggccgcgcgccctggcgcgcgcacacgcgcacacactccccagtcgcctgtaccaaccaccttctcaagttgtagcggtcgctcgcctggggttctccgtgggcggccgacgggcgcgtgggggagggggttcgggccgcccagcgcggcaaggagcgagtgtgtgcacgcagagggccggggctacggggcagcgccccgggcgatgaggggccggcgttgaccgggaagagcgggcaccgcggcagtggctccgaggggacccgcgatggcagcgccctgagaggaggctccaggcagggcgggctgcgggtgccgagcgcgcctctcgtcgcttctgcccccgttgccagccaaccggccggccagcacctcagcggccg

SEQ ID NO: 26199 - DNA, 1870 bp, Homo sapiens
tgcggaccgtagccgatcaacctcaggtttatatatgaaacagaacatttcaatggtgttgctgaacttcttgaaatattaggaagtattatcaatggctttgcattgccactgaaagcagaacataaacaatttctaatgaaggttcttattcctatgcatactgcaaaaggattagctttgtttcatgctcagctagcatattgtgttgtacagttcctggagaaagatacaacactaacagagccagtgatcagaggactgctgaaattttggccaaaaacctgcagtcagaaagaggtgatgtttttaggagaaattgaagaaatcttagatgtcattgaaccaacacagttcaaaaaaattgaagagccacttttcaagcagatatccaagtgtgtatccagttctcattttcaggttgcagaaagggcattgtacttctggaataacgaatatattcttagtttgattgaggagaacattgataaaattctgccaattatgtttgccagtttgtacaaaatttccaaagaacactggaatccgaccattgtagcactggtatacaatgtgctgaaaaccctaatggaaatgaatggcaagcttttcgatgaccttactagctcatacaaagctgaaagacagagagagaaaaagaaggaattggaacgtgaagaattatggaaaaaattagaggagctaaagctaaagaaagctctagaaaaacagaatagtgcttacaacatgcacagtattctcagcaatacaagtgccgaataaaaaaaaagcctcccacctctgccggataggcagagttttgtatgcttttttgaaatatgtaaaaattacaaaacaaacctcatcagtataatataattaaaaggccaattttttctggcaactgtaaatggaaaaatatatggactaaacgtagccctgtgctgtatcatggccatagtatattgtaacctttgtctaatcattggatttattgtgtcacttctgaagtttcacagaaatgaatgaattttatcatctatgatatgagtgagataattatgggagtggtaagaattatgacttgaattcttctttgattgtgttgcacatagatatggtagtctgctctgtatatttttcccttttataatgtgcttttcacactgctgcaaaccttagttacatcctaggaaaaaatacttcctaaaataaaactaaggtatcatccttacccttctctttgtctcacccagaaatatgatggggggaattacctgccctaacccctccctcaataaatacattactgtactctggaatttaggcaaaaccttaaatctccaggctttttaaagcacaaaatataaataaaagctgggaaagtaaaccaaaattcttcagattgttcctcatgaatatcccccttcctctgcaattctccagagtggtaacagatgggtagaggcagctcaggtgaattacccagcttgcctctcaattcattcctcctcttcctctcaaaggctgaaggcagggcctttccagtcctcacaacctgtccttcacctagtccctcctgacccagggatggaggctttgagtcccacagtgtggtgatacagagcactagttgtcactgcctggctttatttaaaggaactgcagtaggcttcctctgtagagctctgaaaaggttgactatatagaggtcttgtatgtttttacttggtcaagtatttctcacatcttttgttatcagagtaccattccaatctcttaacttgcagttgtgtggaaaactgttttgtaatgaaagatcttcattgggggattgagcagcatttaataaagtctatgtttgtatttt

SEQ ID NO: 26200 - DNA, 3265 bp, Homo sapiens
tcccaccccttgcgaggcccctccccgggccgcgcgccctggcgcgcgcacacgcgcacacactccccagtcgcctgtaccaaccaccttctcaagttgtagcggtcgctcgcctggggttctccgtgggcggccgacgggcgcgtgggggagggggttcgggccgcccagcgcggcaaggagcgagtgtgtgcacgcagagggccggggctacggggcagcgccccgggcgatgaggggccggcgttgaccgggaagagcgggcaccgcggcagtggctccgaggggacccgcgatggcagcgccctgagaggaggctccaggcagggcgggctgcgctggcagcggccgctgaggtgctggccggccggctggctggcgacgggggcagaagcgacgagaggcgcgctcggcacccgcacccccgtgcccccgcctcagttgtctaaacttcgggctctcttccacccgctctgcgcgcccagagtcaacaacttcttcacccccctccgcccccgcccttccctccgtcagccccgggagctcgccgcgcgccggggaccaggaacctccagcgctgagatgtggccgtgaggcgttggcgggcggcgaggagaagctcggcggcgtcccggggccggagggccgtggggccggggcgcaggggcgcgagcaccccgcgcctctcccccgcctcctcctgccgtctccgccgctgcccgtgccttgcaagcagcagccggagctgccaagcgtcagggccgcggagatgtcgtcgtcgtcgccgccggcgggggctgccagcgccgccatctcggcctcggagaaagtggacggcttcacccggaaatcggtccgcaaggcgcagaggcagaagcgctcccagggctcgtcgcagtttcgcagccagggcagccaggcagagctgcacccgctgccccagctcaaagatgccacttcaaatgaacaacaagagcttttctgtcagaagttgcagcagtgttgtatactgtttgatttcatggactctgtttcagacttgaagagcaaagaaattaaaagagcaacactgaatgaactggttgagtatgtttcaactaatcgtggtgtaattgttgaatcagcgtattctgatatagtaaaaatgatcagtgctaacatcttccgtacacttcctccaagtgataatccagattttgatccagaagaggatgaacccacgcttgaggcctcttggcctcacatacagttggtatatgaattcttcttgagatttttggagagccctgatttccagcctagcattgcaaaacgatacattgatcagaaattcgtacaacagctcctggagctttttgatagtgaagatcccagagaacgtgacttcctgaagactgttctgcaccgaatttatgggaaatttcttggattaagagcattcatcagaaaacaaattaacaacattttcctcaggtttatatatgaaacagaacatttcaatggtgttgctgaacttcttgaaatattaggaagtattatcaatggctttgcattgccactgaaagcagaacataaacaatttctaatgaaggttcttattcctatgcatactgcaaaaggattagctttgtttcatgctcagctagcatattgtgttgtacagttcctggagaaagatacaacactaacagagccagtgatcagaggactgctgaaattttggccaaaaacctgcagtcagaaagaggtgatgtttttaggagaaattgaagaaatcttagatgtcattgaaccaacacagttcaaaaaaattgaagagccacttttcaagcagatatccaagtgtgtatccagttctcattttcaggttgcagaaagggcattgtacttctggaataacgaatatattcttagtttgattgaggagaacattgataaaattctgccaattatgtttgccagtttgtacaaaatttccaaagaacactggaatccgaccattgtagcactggtatacaatgtgctgaaaaccctaatggaaatgaatggcaagcttttcgatgaccttactagctcatacaaagctgaaagacagagagagaaaaagaaggaattggaacgtgaagaattatggaaaaaattagaggagctaaagctaaagaaagctctagaaaaacagaatagtgcttacaacatgcacagtattctcagcaatacaagtgccgaataaaaaaaaagcctcccacctctgccggataggcagagttttgtatgcttttttgaaatatgtaaaaattacaaaacaaacctcatcagtataatataattaaaaggccaattttttctggcaactgtaaatggaaaaatatatggactaaacgtagccctgtgctgtatcatggccatagtatattgtaacctttgtctaatcattggatttattgtgtcacttctgaagtttcacagaaatgaatgaattttatcatctatgatatgagtgagataattatgggagtggtaagaattatgacttgaattcttctttgattgtgttgcacatagatatggtagtctgctctgtatatttttcccttttataatgtgcttttcacactgctgcaaaccttagttacatcctaggaaaaaatacttcctaaaataaaactaaggtatcatccttacccttctctttgtctcacccagaaatatgatggggggaattacctgccctaacccctccctcaataaatacattactgtactctggaatttaggcaaaaccttaaatctccaggctttttaaagcacaaaatataaataaaagctgggaaagtaaaccaaagtggtaacagatgggtagaggcagctcaggtgaattacccagcttgcctctcaattcattcctcctcttcctctcaaaggctgaaggcagggcctttccagtcctcacaacctgtccttcacctagtccctcctgacccagggatggaggctttgagtcccacagtgtggtgatacagagcactagttgtcactgcctggctttatttaaaggaactgcagtaggcttcctctgtagagctctgaaaaggttgactatatagaggtcttgtatgtttttacttggtcaagtatttctcacatcttttgttatcagagtaccattccaatctcttaacttgcagttgtgtggaaaactgttttgtaatgaaagatcttcattgggggattgagcagcatttaataaagtctatgtttgtatttt

SEQ ID NO: 26201 - DNA, 3691 bp, Homo sapiens
tcccaccccttgcgaggcccctccccgggccgcgcgccctggcgcgcgcacacgcgcacacactccccagtcgcctgtaccaaccaccttctcaagttgtagcggtcgctcgcctggggttctccgtgggcggccgacgggcgcgtgggggagggggttcgggccgcccagcgcggcaaggagcgagtgtgtgcacgcagagggccggggctacggggcagcgccccgggcgatgaggggccggcgttgaccgggaagagcgggcaccgcggcagtggctccgaggggacccgcgatggcagcgccctgagaggaggctccaggcagggcgggctgcgctggcagcggccgctgaggtgctggccggccggctggctggcgacgggggcagaagcgacgagaggcgcgctcggcacccgcacccccgtgcccccgcctcagttgtctaaacttcgggctctcttccacccgctctgcgcgcccagagtcaacaacttcttcacccccctccgcccccgcccttccctccgtcagccccgggagctcgccgcgcgccggggaccaggaacctccagcgctgagatgtggccgtgaggcgttggcgggcggcgaggagaagctcggcggcgtcccggggccggagggccgtggggccggggcgcaggggcgcgagcaccccgcgcctctcccccgcctcctcctgccgtctccgccgctgcccgtgccttgcaagcagcagccggagctgccaagcgtcagggccgcggagatgtcgtcgtcgtcgccgccggcgggggctgccagcgccgccatctcggcctcggagaaagtggacggcttcacccggaaatcggtccgcaaggcgcagaggcagaagcgctcccagggctcgtcgcagtttcgcagccagggcagccaggcagagctgcacccgctgccccagctcaaagatgccacttcaaatgaacaacaagagcttttctgtcagaagttgcagcagtgttgtatactgtttgatttcatggactctgtttcagacttgaagagcaaagaaattaaaagagcaacactgaatgaactggttgagtatgtttcaactaatcgtggtgtaattgttgaatcagcgtattctgatatagtaaaaatgatcagtgctaacatcttccgtacacttcctccaagtgataatccagattttgatccagaagaggatgaacccacgcttgaggcctcttggcctcacatacagttggtatatgaattcttcttgagatttttggagagccctgatttccagcctagcattgcaaaacgatacattgatcagaaattcgtacaacagctcctggagctttttgatagtgaagatcccagagaacgtgacttcctgaagactgttctgcaccgaatttatgggaaatttcttggattaagagcattcatcagaaaacaaattaacaacattttcctcaggtttatatatgaaacagaacatttcaatggtgttgctgaacttcttgaaatattaggaagtattatcaatggctttgcattgccactgaaagcagaacataaacaatttctaatgaaggttcttattcctatgcatactgcaaaaggattagctttgtttcatgctcagctagcatattgtgttgtacagttcctggagaaagatacaacactaacagagccagtgatcagaggactgctgaaattttggccaaaaacctgcagtcagaaagaggtgatgtttttaggagaaattgaagaaatcttagatgtcattgaaccaacacagttcaaaaaaattgaagagccacttttcaagcagatatccaagtgtgtatccagttctcattttcaggttgcagaaagggcattgtacttctggaataacgaatatattcttagtttgattgaggagaacattgataaaattctgccaattatgtttgccagtttgtacaaaatttccaaagaacactggaatccgaccattgtagcactggtatacaatgtgctgaaaaccctaatggaaatgaatggcaagcttttcgatgaccttactagctcatacaaagctgaaagacagagagagaaaaagaaggaattggaacgtgaagaattatggaaaaaattagaggagctaaagctaaagaaagctctagaaaaacagaatagtgcttacaacatgcacagtattctcagcaatacaagtgccgaataaaaaaaaagcctcccacctctgccggataggcagagttttgtatgcttttttgaaatatgtaaaaattacaaaacaaacctcatcagtataatataattaaaaggccaattttttctggcaactgtaaatggaaaaatatatggactaaacgtagccctgtgctgtatcatggccatagtatattgtaacctttgtctaatcattggatttattgtgtcacttctgaagtttcacagaaatgaatgaattttatcatctatgatatgagtgagataattatgggagtggtaagaattatgacttgaattcttctttgattgtgttgcacatagatatggtagtctgctctgtatatttttcccttttataatgtgcttttcacactgctgcaaaccttagttacatcctaggaaaaaatacttcctaaaataaaactaaggtatcatccttacccttctctttgtctcacccagaaatatgatggggggaattacctgccctaacccctccctcaataaatacattactgtactctggaatttaggcaaaaccttaaatctccaggctttttaaagcacaaaatataaataaaagctgggaaagtaaaccaaaattcttcagattgttcctcatgaatatcccccttcctctgcaattctccagagtggtaacagatgggtagaggcagctcaggtgaattacccagcttgcctctcaattcattcctcctcttcctctcaaaggctgaaggcagggcctttccagtcctcacaacctgtccttcacctagtccctcctgacccagggatggaggctttgagtcccacagtgtggtgatacagagcactagttgtcactgcctggctttatttaaaggaactgcagtaggcttcctctgtagagctctgaaaaggttgactatatagaggtcttgtatgtttttacttggtcaagtatttctcacatcttttgttatcagagtaccattccaatctcttaacttgcagttgtgtggaaaactgttttgtaatgaaagatcttcattgggggattgagcagcatttaataaagtctatgtttgtattttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagggggggggggccgcgtaagaaaaatactctccacggcggggggcggcccactaaagtatgcgcgacgcaggccttttgttttgtaaaggaagggaggccctcacccaagagaagaagcgatcgactatcttatacaagagcagcaggccggccgcgctataaaacagcgcgctcatgacagaaacaccgctagtgcggactatttgtcgagaaggagcacccaactgtggtggggggcaacagccaggcgagcaacacc

SEQ ID NO: 26202 - DNA, 624 bp, Homo sapiens
cggtacaaccccctcctaatactaactacctggactcctacccctccctcaataaatacattactgtactctggaatttaggcaaaaccttaaatctccaggctttttaaagcacaaaatataaataaaagctgggaaagtaaaccaaaattcttcagattgttcctcatgaatatcccccttcctctgcaattctccagagtggtaacagatgggtagaggcagctcaggtgaattacccagcttgcctctcaattcattcctcctcttcctctcaaaggctgaaggcagggcctttccagtcctcacaacctgtccttcacctagtccctcctgacccagggatggaggctttgagtcccacagtgtggtgatacagagcactagttgtcactgcctggctttatttaaaggaactgcagtaggcttcctctgtagagctctgaaaaggttgactatatagaggtcttgtatgtttttacttggtcaagtatttctcacatcttttgttatcagagtaccattccaatctcttaacttgcagttgtgtggaaaactgttttgtaatgaaagatcttcattgggggattgagcagcatttaataaagtctatgtttgtatttt

SEQ ID NO: 26203 - DNA, 1652 bp, Homo sapiens
gcaacttctgcctcctggttcaagcaattctcctacctcagtcttctgagtagctgggattacagatgccacttcaaatgaacaacaagagcttttctgtcagaagttgcagcagtgttgtatactgtttgatttcatggactctgtttcagacttgaagagcaaagaaattaaaagagcaacactgaatgaactggttgagtatgtttcaactaatcgtggtgtaattgttgaatcagcgtattctgatatagtaaaaatgatcagtgctaacatcttccgtacacttcctccaagtgataatccagattttgatccagaagaggatgaacccacgcttgaggcctcttggcctcacatacagttggtatatgaattcttcttgagatttttggagagccctgatttccagcctagcattgcaaaacgatacattgatcagaaattcgtacaacagctcctggagctttttgatagtgaagatcccagagaacgtgacttcctgaagactgttctgcaccgaatttatgggaaatttcttggattaagagcattcatcagaaaacaaattaacaacattttcctcaggtttatatatgaaacagaacatttcaatggtgttgctgaacttcttgaaatattaggaagtattatcaatggctttgcattgccactgaaagcagaacataaacaatttctaatgaaggttcttattcctatgcatactgcaaaaggattagctttgtttcatgctcagctagcatattgtgttgtacagttcctggagaaagatacaacactaacagagccagtgatcagaggactgctgaaattttggccaaaaacctgcagtcagaaagaggtgatgtttttaggagaaattgaagaaatcttagatgtcattgaaccaacacagttcaaaaaaattgaagagccacttttcaagcagatatccaagtgtgtatccagttctcattttcaggttgcagaaagggcattgtcacttctggaataacgaatatattcttagtttgattgaggagaacattgataaaattctgccaattatgtttgccagtttgtacaaaatttccaaagaacactggaatccgaccattgtagcactggtatacaatgtgctgaaaaccctaatggaaatgaatggcaagcttttcgatgaccttactagctcatacaaagctgaaagacagagagagaaaaagaaggaattggaacgtgaagaattatggaaaaaattagaggagctaaagctaaagaaagctctagaaaaacagaatagtgcttacaacatgcacagtattctcagcaatacaagtgccgaataaaaaaaaagcctcccacctctgccggataggcagagttttgtatgcttttttgaaatatgtaaaaattacaaaacaaacctcatcagtataatataattaaaaggccaattttttctggcaactgtaaatggaaacctttgtctaatcattggatttattgtgtcacttctgaagtttcacagaaatgaatgaattttatcatctatgatatgagtgagatattatgggagtggtaagattatgacttgattcttcttgatttgttgccatagatcggtagtctgctctgatattttccctttataa

SEQ ID NO: 26204 - DNA, 2019 bp, Homo sapiens
actttagatttcaagtatgttagcagcagtaattagggatgttttcctctaaggaaaattatagttataaaattattatttgttagaaatgattcctgctacttcaaattatttatccttaaatgtagaggattaacaatgaacaacttgaaataacttggttatcacctcagaagtttagtttatcactgatttaatgaagaagggcaagaagaggaaggctttatgataatgagtggtctgtgaattcctgcacaacaccatgtggttttaattactaaatgtgatgccacttcaaatgaacaacaagagcttttctgtcagaagttgcagcagtgttgtatactgtttgatttcatggactctgtttcagacttgaagagcaaagaaattaaaagagcaacactgaatgaactggttgagtatgtttcaactaatcgtggtgtaattgttgaatcagcgtattctgatatagtaaaaatgatcagtgctaacatcttccgtacacttcctccaagtgataatccagattttgatccagaagaggatgaacccacgcttgaggcctcttggcctcacatacagccctgacaactaccaatctgctttctgtctctggatttgcctattttggatacttcatataagtgaaattatttggtatatgaattcttcttgagatttttggagagccctgatttccagcctagcattgcaaaacgatacattgatcagaaattcgtacaacagctcctggagctttttgatagtgaagatcccagagaacgtgacttcctgaagactgttctgcaccgaatttatgggaaatttcttggattaagagcattcatcagaaaacaaattaacaacattttcctcaggtttatatatgaaacagaacatttcaatggtgttgctgaacttcttgaaatattaggaagtattatcaatggctttgcattgccactgaaagcagaacataaacaatttctaatgaaggttcttattcctatgcatactgcaaaaggattagctttgtttcatgctcagctagcatattgtgttgtacagttcctggagaaagatacaacactaacagagccagtaagtgttctatttattttcatgtttttggtctgcattaatagcatttcattgtagctttcgttttatagcctttatagttattaagtagaataatgtacgttaagctaaaatcatttagaagaagaaatgtgagattaatctacattaaaagaaggggttaggaggggagagttctcgtgagttatgtcttgaataaccgaaatatagactactattaatatgtagtagttaagatgtacgatgataggatcagatgaccacagtgaaattttatatgcatactgtcttcaccaataatcttttaaatcttcattcaccttttggaattaaagcatacttcgagggtcccaaaactactactcccttgaattttgttttgtttttaataatagaatttttgccactcattaacaataaaccacttgatagggatagaaaacatttccttgcttttggtgattaagatataagatgtaatcttggaataaaagtagtttatgaaccagcaaggcaacttaggctttgaattctactgttatttgcctctagaatgaaaattcaggagagagtgaaaacataattagttatgaaaatttactgaggattcaagaaaaacaaaagatgaagtagggtgaaacagaaaagtataaaagcatagaaaacattttaaccttggtgaagtaagtattttgagagaatgctttctaggcatgttcagtctaaatatttacctagtattaggttggtacaaaagtgattgcggcttttgccattacttttaatggcaaaaaccacaatcactttagcagcaacctaataaatatttagtaaatagcaaagggtttgaaaaactaaaatatatatgtatttttactatattatgaaccttctcaggctatccgtagggatgct

SEQ ID NO: 26205 - DNA, 355 bp, Homo sapiens
taatttctgattacaaaaattttggtttatctacagagagaaaaagaaggaattggaacgtgaagaattatggaaaaaattagaggagctaaagctaaagaaagctctagaaaaacagaatagtgcttacaacatgcacagtattctcagcaatacaagtgccgaataaaaaaaaagcctcccacctctgccggataggcagagttttgtatgcttttttgaaatatgtaaaaattacaaaacaaacctcatcagtataatataattaaaaggccaattttttctggcaactgtaaatggaaaaatatatggactaaacgtagccctgtgctgtatcatggccatagtatattgt

SEQ ID NO: 26206 - DNA, 510 bp, Homo sapiens
gaagaattatggaaaaaattagaggagctaaagctaaagaaagctctagaaaaacagaatagtgcttacaacatgcacagtattctcagcaatacaagtgccgaataaaaaaaaagcctcccacctctgccggataggcagagttttgtatgcttttttgaaatatgtaaaaattacaaaacaaacctcatcagtataatataattaaaaggccaattttttctggcaactgtaaatggaaaaatatatggactaaacgtagccctgtgctgtatcatggccatagtatattgtaacctttgtctaatcattggatttattgtgtcacttctgaagtttcacagaaatgaatgaattttatcatctatgatatgagtgagataattatgggagtggtaagaattatgacttgaattcttctttgattgtgttgcacatagatatggtagtctgctctgtatatttttcccttttataatgtgcttttcacactgctgcaaaccttagtta

SEQ ID NO: 26207 - DNA, 238 bp, Homo sapiens
ttcattgcctgatattcaatgtcttcacaaccattgttttatatattttgttttaggctcaagggaatcttatcctttatactctgtcttggacaaaagccccatttgggggaaaaatgtgtgtgtgcatgtacaggcgttggaggggagtctaaaatataaaccaaactgttaactctggtgagtaagattacaggagacttccattttcttttgtttttttttgttttttttgaga

SEQ ID NO: 26208 - DNA, 121 bp, Homo sapiens
tctttcctgatgaaatcagacacaaaatctccatttcataaagcgaatagcaggacactgctctggtggaaccgggacagatagccgggactcctgcccacctggctcccccacctttctg

SEQ ID NO: 26209 - DNA, 443 bp, Homo sapiens
tacaggcaagtaaagaaataagggagaaagtgaaaaaggaggaaaaataggggtatgactaaagctagcaaggaaaatagctgccatacatacttaagaaaggagggctggttgctttattttggctgaaggccaagttgatttatccagactgctgatagacttttattttatatttcacttattaaatattaagtttaggtttttctaccctaccttcccagggatttgatggataaagtactaactggtattgtgacttgtatgttacaataaacaatctgtcaatttcaatttttttaataatcgagagagttttgaacatcacatgaagttttttggcaagtcagatataaaatacacgaaaagacaaaaaatgtggcagctatgctattcacctttcacattttgcctatctttttatctgaagtttatagaaaagg

SEQ ID NO: 26210 - DNA, 316 bp, Homo sapiens
gtccaaggaaacatatattctagatttagactcataggctgcccaatctaaaattttgatgataacttctattagatacacacttattttaatcctcctgttgtgatttggaaatgtattttgttaatatttcagaattatttatttgtaaaatgagtatactttttagaatgtattattttgaatcatagccattatttgatacagagatttttttctattgcttctattaacataaccatctaacacttttgaattccacaagcatcattttaagactagcttcagtaatataatttgataaatcttaagacca

SEQ ID NO: 26211 - DNA, 183 bp, Homo sapiens
agtaagcactaggccagtgagtccaatgcctgctacagcttactctctccactgctcggtctgggtatgaatttacagactacactgggtgcataaaaacagagcagaaacctgggtgattcttttactcccagagagagatgcccaactctgttttggaacaggcaatgtggtggattttca

SEQ ID NO: 26212 - DNA, 419 bp, Homo sapiens
atcagccaccatgtacataaataataatgaaaaagaatatatttgcggtaacaacatcaacaacaaaaaaattctgagcatcactgttttttttcttttcttttctttttgagacagttttgctctcgttgcccaggctggagtgcagtagcaccatcacggctcactgcaacctctgcctctcgggttcaaacgattctcctcctgcgacctcccaaagtgttgggattacaggcgtgagccaccgtgcctggccaagcattacttttttaagatatgtgcaaaatgttgaaacaactcaatacccaaaaagataaaattgcattcatttctcacactccaggacaaattccaaagaaattaaagttataataaatgtaaaatatgaaaccaagtactacaggaaaacatgggtgaat

SEQ ID NO: 26213 - DNA, 420 bp, Homo sapiens
caaatgaaatcttataggaaatcatagagaaatgaaacataaaacaagaatgattgggctgaaagaatagcccccagttacttactttgctcccattcccttacctttccttggggctttgagcaacatttaaggctccagggaaaaaaaatcgagccacttacctatgccaatttcccaaaacatgagaaagtaaagccttttgaaattgacttgttagaagtctcatggcagattggtttagtggcagacagaactcaaatccagagcttttgtttccaaatctattcatttttctgctttgccatgatgtctaataggattgtcactaacaaatattaaactatccagttgtaagagttttgaaatgttttaagaatagtcttaggttgatgttcagccaacagctagaaacttggg

SEQ ID NO: 26214 - DNA, 458 bp, Homo sapiens
tcatggaacatctaaagggttgcatctgagagcatctctatatagagtttaagtcagcatgaagtcattggatcctttaggaaattggtctactgagaaatgtagagtttatttattcctaagattcctattgaggtatatctcagttcattttatgctgctataacaaaatacttgagactgggtaatttataaagaacagaaatttatttcctcacagttctggaggctggaatctaagatcaaggcactggcagttctgttgtcaggtggaggctgcttccagggtggcgcctcatggctgcaccctccagaggagagaaacactgcatcctcacatggtggaagactaagggaaagccagctgaaagctgcctgaaacctcttttataacagctttgtattattctgttctcacactgctgataaagacatacctgagactgggtagtttattt

SEQ ID NO: 26215 - DNA, 598 bp, Homo sapiens
cggcacgagggcggggtgaggaaaacagcaagaaatctgaaatactgagatagttgagaaacaggctctctctctctctcctgggtttttctccacccccagcacatgaaagaattgtaaggaaatttagatgattgataataaactataaaatataaaatctggattatcattatatattttatggtgatgggtagatttccatactcgccacaattactagcctttcctaaattagggacattttctgggaatgttcttctaataaaaactaagtcattatcattatacttagattttataacccaagaattcccaaagtcatattacccagtctactacgctttccccaatgaatccatccttgaagtctaatttcctaaatacacttgttgtccacaaggtggccctagaagcaatagaatacagttcacctccagagcagcccgaccgctaaaaggactcaatcctttttgttttcccatttatgagcaattaacggagtgagaacagaaaaaaaaagagcacaattaaacattgtactaataaactgataacgcgtcttcagtgttgtttttaccaaacagagcagaactat

SEQ ID NO: 26216 - DNA, 664 bp, Homo sapiens
ggtctcgagctcctgatctcaggtgatccgcccgcctccgtctcccaaagtgctggaattataggtgtgagccaccgcacccggctagttttgagtgtttgttactttttattgttgttacctttgttttaatgtttaatcgtaaacttatataatttaaaaaatgttttttattttttattttttagtagagacagggtttcaccatgttgtccaggctggtctcaaactcctgacctcaaatgatacactcccctcagcctcccaaagtgctgggattataggtgtgagccactgagcctggccttaacttttaataatagttgtctttaacaactggctcaaaaaattcctgaaaatttaataatgtacttgcctctaacataccacatctgaggctcccccagggcaggccctgtctttcctcatcagagtgatttgggctgtgccatcaggctgggaccttctcacttgccaagagggggaggataatgtctgccccttgaccccagggcctttcccaggcttggaggtggcacagtgcccaacagctgctctgagaggcagactgtgttgaacaatcagaaaacaggcagcgtgcatgagccagggtcagtgatgggttcacccaacctgcagttaggggcagcagctgctcctgaga

SEQ ID NO: 26217 - DNA, 434 bp, Homo sapiens
aagcaccactcaaaaaacaaagcaagttaccattatataaaacatttaaaggttggtggcccaaaacttatctcaggttgttctgtcattaattgcaatgctggactggcatgctaactagtaatagtgccttcttctctgcaaataaatgatgtctttgaaaatatattcttccagaaaatcactaaagacagatcatttcagagattagaaaagaagcagtaccatgatgcaaaaaaaaaaaaaaaaaaaagtgaataggaagcaacttttgggtctaaaatgtcacaatgaaagatttatctttctatgtttctaaatcggaaaactaagccttttgttcactaaggagcaagtaaaactgtgagaggccccagtgctgaggagagtggctggtacatggtggaaagtcaataaattattctgcagtgaag

SEQ ID NO: 26218 - DNA, 184 bp, Homo sapiens
tatttcgagtgacttggatccagtagggcgggtgtgggcaggttttgtatgtattcacatgttagcataaagattctaaagcatgagggctttccattgaaaaaggagccccgagaagctcactggaagtgagttgcaatagaacgttgtttcctggttccttgctcctttctccatctgtccc

SEQ ID NO: 26219 - DNA, 441 bp, Homo sapiens
aaaaagcaaaaaattgaattagatcttttttggcagggtggtaggtgggaaagacattaattattactcatcccattctgcatcaactgtatcttatcaggtttaagatgctattgattgtaagatggatctctatttcagtgatgttgaagtataaaaagtggttgaaatacggtaaatatagattctcggtgtcccaggacctttagagaacattgttttctgtagagtaatagcacatgctgggttcatgttagcccctttcaactttatgtatcattaattaagtgttgatgttctagatatttaatggacactaacatcaagatgaccttgtggtatgtgtccagagcattctagtgaagcctagtgatttagcttcagattatgagaatttaacagtctaatgtagggttagaaaatattcatgaaactggaata

SEQ ID NO: 26220 - DNA, 499 bp, Homo sapiens
actccagcctgggtaacagagccgagaccctgtctctaaaaacaaaacaaaaaagtaatatttaatggatgagaaaagagtaaatgactaaggtgatatgtaagcattaaactctgtctaaaaggtatctacttggtttctttatcttgaataaaccaaatgtcagaataatattttgggctactttatagaacaaaaaggtcaacaacgtgaaagtaattaaactaatatcggaaggcatcaccagcatgtttgttttaaacaagtgtggtttactgctctccaaatgctatttacctaaaatgaataacacatatgagaacagtggaacagaaacagcagcacacaagttgaagacagcgttatattctttctaagaatggaaatgagtgggaggctgaggtaggagaatcgcttgaacctgggaggcggaggttgctgtgagccaagatcgcgccattgcactccagcctgggcaacaagactgaaactccgtctc

SEQ ID NO: 26221 - DNA, 629 bp, Homo sapiens
gaggcggaggttgcagtgagctgagctcatgctactgcattccagcctgggtgacacagcgagactccatctcaaaaaaaaaaaaaaaaaaaaaaaagatcctgaagcatttcttcaaataactgtaacgggaacaggagatgaaacagggcttttaccagtgcgatcctgaagacaaagcacaattaaagcaatggctaccaagaggtgaaagtcagagcaaaagtggaccagtcaagagtgaagatcagctgggggcagtggctcatgcctgtaatcccagcactctgggaggccaaggtgggtggatcgcttgagctcgggggttcgagaccagcctgggcaacatggcgaaatcccatctctacaaagaatacaaaaattagccaggcatggtggcatgtgcctgtagtcccagctactcgggaggctgaggtgggaggatcacttgagcctgggaagtcaaggctacagtgaaccatgttcgtgccactgcactccagcctgggtgacaaagtgagacattgtctcaaaaaataaaaataaaagagcagtcaggtgcggtggctcatgcctgtaatcccagcactttgggaggccgaggcgggcggatcatctgaggtcaggag

SEQ ID NO: 26222 - DNA, 338 bp, Homo sapiens
aaagattgagatgtgtcctcctgagctttaggctttagaaatttttaatgagattttattttaactaacaagagccttaaaagtttagaaatgaaacttaaaattttacagtagagttattctattttagcccctgattttgctttttgatagaactttataaaatgcattaaatattaaatgaaaaaatgtctaaatgctatccaagtttcaaattcttaaagtttgatgttgtttgactccctcttaaggaaatgtttggtctcctataaagaagccaggctccaacctttaactcagattgatctgctatcagtctatcagaagtatcctataat

SEQ ID NO: 26223 - DNA, 514 bp, Homo sapiens
tcacccaggctggagtgcagtggtgcgatctcacctcacttcagcctctgcctcccaggttcaagtgattctcctgtctcagcctcctgagtagctgaggcaggagaattgcttgaacctgtcggggggaggcttcagtgagccaagatcatgccacttcactcggcaaaatagcgagattctgtctcaaaaaaaaaacaaaaaagaaagacacttttatttcctacagagcagtggcttcagttcccacagggcaagagaccctatttgttttgttttattttaagttccaggatacatgtgcaggatgtgcagatttgttacacaggtaaacatgtgccatggtggtttgctgcaccaagcgaccctatttgtatttgttgattgtaagccagatgttataaagcaggagacagccctatatttcatttcccttcgttagaaggcctatagccacactgtttattatggtagcctctagcagcatgtgctacctaagcacttgaaatgtagc

SEQ ID NO: 26224 - DNA, 365 bp, Homo sapiens
tcacccaggctggagtgcagtggtgcgatctcacctcacttcagcctctgcctcccaggttcaagtgattctcctgtctcagcctcctgagtagctgggattacaggcgtgccaccacgcccagctatttttgtaatttcattaaagacagggtttccccatgttggtgaggctggtcttgaactcctggcctcaagtgatccacctgcttcagcctcccaaagtgcagggattacaggcatgagccactgtgcctggcctcagctatcttgaatgctggagaattaaatccttttctgtctagggtgtcagctccctaagggctgggccaaaacagttggatttataagacactagagtcttgc

SEQ ID NO: 26225 - DNA, 390 bp, Homo sapiens
acaaggatgtatttatatattctgagttaaaaaaaatgcttttaaagaaggtgtgagcaaagataaaaattatttcttacagctaaagaaaagtagtctcttcatctttatccatgagggaataactcattgacacttataaaagagcgtcctagcccaagatatcatgtggtgggaaatttgattggaagaatctcttccactaacttgtgcatgagaatatttgttccagctccaaagccttagaagctgttagagaaaggtgggagggtatttggctggccttgggaaatggtaacctaacactggaagccccttgcttttgttctccttattgtacataagaagatgagattttatttccagatttcaaaacacggaccaacttgc

SEQ ID NO: 26226 - DNA, 408 bp, Homo sapiens
ttttcagaatttgtggggcttagaaatagatactgagcttgctttgcctttttaaaaaagaagttaaaagtttaaatttaaaagtagctctggaattctggtgcttaataattacagatgctttgatatagctagcatcatcctgtggacacctagggcagggaaagaggaacttgattcacttcataaggtaccggtgaagagcctgtgcatctggcactgctgcggggggctggtggccggagtggaatattgttgctgtgttcctactttgaaaacaagtaagcagggtttgccagttcccaccctcattctgcacccccatctcacatgcacagtttttatcaccctccttgtccaataaagtttacacggatactaaaatgagaagaatccgcactttttggt

SEQ ID NO: 26227 - DNA, 390 bp, Homo sapiens
cctagcccagctgttctctctgctacttctgggccacttgggggcacatgaaaataccccacagctcctgcaccttgtggggtgggcactctctgccattctcttggatccaacagccaaccaggcaggggctgcgaacgcacatgtctgaaggggcgaggcgaggacataatgggtgaacgggcccgttgggggtggcagtgaactggcaggaaggtaccatgtaaagggacggccactccccaggtctggctaattgttatgtgaaggaagcaaggccctttgaaacttaattctttgcttttgcaagaaaccaggggttattctatgaagtctcctgatttttaagtattgctaaaagtccgttttaaaagcaccatgtgggccaaa

SEQ ID NO: 26228 - DNA, 529 bp, Homo sapiens
atttcttcagctgaccctcaatacctgtgatgggtgctggcaggaggcactcagacctctctccttagaaatgccctactattcacagtggcactgggaggggctggaagagctgtttagggggccctcgggcccagcccctgtgtttagggggccctcgcgcccagcccctgtgtttagtgggccctcgggctcatttcctgtatttagcaggcactcaggctcagcccctgggtttagtgggccctcgggctcagggcctgtgctgacactgaaagggagtgagtgtgctttccaaaagttagtgagtgagaatatccttgccaaggccctaagtgacaggcactattgttctgcaccacagatggtacatcaggagctgtttgtgcaggtcgcagagcggcagggctgcattaccttcacgccagcttttgtttttgtcagctggatcgcattgcgctccctccagagaccatgtgttatggagggaaggaaaagtgcaaggttttaataagtcccttgcaaagag

SEQ ID NO: 26229 - DNA, 972 bp, Homo sapiens
  misc_feature (291)..(291): n is a, c, g, or t
atgatgggacaaaatcaaaccagcatctcagacttcctgctcctgggcctgcccatccaaccagagcagcaaaacctgtgctatgccctgttcttggccatgtatcttaccaccctcctggggaacctcctcatcattgtcctcattcgactggactcccatctccacacgcctgtgtatttgtttctcagcaacttgtccttctctgacctctgcttttcctcagtcacaatgcccaaattgctgcagaacatgcagaaccaagacccatccatcccctatgcagactgnctgacccaaatgtacttcttcttgtatttttcggatctagagagcttcctccttgtggccatggcctatgaccgctatgtggccatctgcttccccatgcactacaccgccatctgcttcctcctgcactacaccgccatcatgagccccatgctctgtctctccgtggtggcgctgtcctgggtgctgaccaccttccatgccatgttacacactttactcatggccaggttgtgtttttgtgcagacaatgtgatcccccactttttctgtgatatgtctgctctgctgaagctggcctgctctgacactcgagttaatgaatgggtgatatttatcatgggagggctcattcttgtcatcccattcctactcatccttgggtcctatgcaagaattgtctcctccatcctcaaggtcccttcttctaagggtatctgcaaggccttctctacttgtggctcccacctctctgtggtgtcactgttctatgggaccgttattggtctctacttatgcccatcagctaatagttctactctaaaggacactgtcatggctatgatgtacactgtggtgacccctatgctgacccccttcatctacagcctgaggaacagagacatgaagggagccctggaaagggtcatttgtaaaaggaaaaatcccttccttctatga

SEQ ID NO: 26230 - DNA, 491 bp, Homo sapiens
  misc_feature (304)..(304): n is a, c, g, or t
aattgttaaggtccatccgcgttgttgcatctcattatagtttattcaggtttggagaattgaggtagaatttacaagcaatgaagtgcaggatttccgtgtgaaaattgtgtacaacatggataatgtgtgttttgaacagctcacacgcctgtgtaactcacaccccagtcaaggtgcagagacttctgtccctcggaacggcctgcatgctcccggctccggtccccacggcagccactgccctgacttggagccccagggcttctgttgccagctcttgaatttcatgcgtacgtgaaanccgacgctgtgccctcgtgtttctctttccactcagccggatggtcatgcgttacagcttgtgtattggtggctgtgtattggtggctccttactgtttgctcatccttctgtgactgcaccgagattgtttcgatgctgtagtttccagttcgggttactagaataaagacgtccattaacattct

SEQ ID NO: 26231 - DNA, 494 bp, Homo sapiens
attctcccacttcagcctccagagtagctggggttacaggcactcgtcaccatgcccagctaatttttttgtatttttagtagagatggggtttcaccatgttggccaggctggtctcgaactcctgacctgaagcgatctgcccaccttggcctcccaaagtgctggaattacaggcgtgagccaccgtgcccagcccaaaagagatagtcttataagtaaagtgcgtcaaaagacattagaagagtcacctaggttgtctaatttacctacaaaacctggtcacactaggaaaacgataaaccatgaacacatagttgtgagcacccagaataattctttaagtctacctaattatatctacatttctattaacacatagtttttttcttttatccccctctttaagagtaagataactcttcagctgtaatgagaccaaatgctagtgaacttatccatggtggcaaaagcttttagccatttttgcctgt

SEQ ID NO: 26232 - DNA, 167 bp, Homo sapiens
cagcctcttaagtagctggggctacaggtatgagccactgtgctaggcaacaataaagtattttttaaattaagttatatatattgttttttaagacataatgctactgtgcacttaatagactacagtataatataaacataacttgtatgcgctaggaaataaaa

SEQ ID NO: 26233 - DNA, 2712 bp, Homo sapiens
  misc_feature (1176)..(1176): n is a, c, g, or t
  misc_feature (1284)..(1284): n is a, c, g, or t
ggaacagcgcagggaggtgggtagccgggctcccaggcacgtgggtctctgcggctgcggcgggacccgggcactggcacccgggagcggcggcgacggcaccccgagaggagaagcgcagcgcagtggcgagaggagccccttgtggcagcagcactacctgcccagaaaaatgctggaggctgggcgtggccccaggcctggggacctgtttttcctgtttcccgcagagttccctgcagcccggtccaggtccaggcgtgtgcattcatgagtgaggaacccgtgcaggcgctgagcatcctgacctggagagcaggggctggtcaggttccagagcttggaggttccaggtccagatccaagtcagatggcaatgaaagccctggtcaggtggctgtgtcaggtcccctaggggcgctccggccacaaccctgatggccccacccctcccttccctgcagggcgatggcagcagacctgggcccctggaatgacaccatcaatggcacctgggatggggatgagctgggctacaggtgccgcttcaacgaggacttcaagtacgtgctgctgcctgtgtcctacggcgtggtgtgcgtgcttgggctgtgtctgaacgccgtggcgctctacatcttcttgtgccgcctcaagacctggaatgcgtccaccacatatatgttccacctggctgtgtctgatgcactgtatgcggcctccctgccgctgctggtctattactacgcccgcggcgaccactggcccttcagcacggtgctctgcaagctggtgcgcttcctcttctacaccaacctttactgcagcatcctcttcctcacctgcatcagcgtgcaccggtgtctgggcgtcttacgacctctgcgctccctgcgctggggccgggcccgctacgctcgccgggtggccggggccgtgtgggtgttggtgctggcctgccaggcccccgtgctctactttgtcaccaccagcgcgcgcgggggccgcgtaacctgccacgacacctcggcacccgagctcttcagccgcttcgtggcctacagctcagtcatgctgggcctgctcttcgcggtgccctttgccgtcatccttgtctgttacgtgctcatggctcggcgactgctaaagccagcctacgggacctcgggcggcctncctagggccaagcgcaagtccgtgcgcaccatcgccgtggtgctggctgtcttcgccctctgcttcctgccattccacgtcacccgcaccctctactactccttccgntcgctggacctcagctgccacaccctcaacgccatcaacatggcctacaaggttacccggccgctggccagtgctaacagttgccttgaccccgtgctctacttcctggctgggcagaggctcgtacgctttgcccgagatgccaagccacccactggccccagccctgccaccccggctcgccgcaggctgggcctgcgcagatccgacagaactgacatgcagaggatagaagatgtgttgggcagcagtgaggactctaggcggacagagtccacgccggctggtagcgagaacactaaggacattcggctgtaggagcagaacacttcagcctgtgcaggtttatattgggaagctgtagaggaccaggacttgtgcagacgccacagtctccccagatatggaccatcagtgactcatgctggatgaccccatgctccgtcatttgacaggggctcaggatattcactctgtggtccagagtcaactgttcccataacccctagtcatcgtttgtgtgtataagttgggggaattaagtttcaagaaaggcaagagctcaaggtcaatgacacccctggcctgactcccatgcaagtagctggctgtactgccaaggtacctaggttggagtccagcctaatcaagtcaaatggagaaacaggcccagagaggaaggtggcttaccaagatcacataccagagtctggagctgagctacctggggtgggggccaagtcacaggttggccagaaaaccctggtaagtaatgagggctgagtttgcacagtggtctggaatggactgggtgccacggtggacttagctctgaggagtacccccagcccaagagatgaacatctggggactaatatcatagacccatctggaggctcccatgggctaggagccagtgtgaggctgtaacttatactaaaggttgtgttgcctgctgaactgtgccctattgtgtggtcgggggatgaggatatggcagggaagctttcaccagccacacaagggtcctttctccaatccgttcccttctgccacctgccttctcactagctgtctcaggagtagtctcatatcagggatcctctctccaggccccaggtcatcccccactgtaaagccagttggcttctgtgcctgactctgtgctgagcacagagaaaagtcaggtgcagtcccagtccttgagatttcccagtttaggtgatggccagtcatgtgctggtaaatgttaagccatttaactggagctccgatttaactgggaaccccttctttgtagaactgcccatttccatggtgcaaaaactcttatggccaaattcaaactataaacatgatgtcaacttccttgtaaaattcctgaaaatttaacaattggttcttgcaagcaggtacaagtcactctag

SEQ ID NO: 26234 - DNA, 2578 bp, Homo sapiens
  misc_feature (1042)..(1042): n is a, c, g, or t
  misc_feature (1150)..(1150): n is a, c, g, or t
ggaacagcgcagggaggtgggtagccgggctcccaggcacgtgggtctctgcggctgcggcgggacccgggcactggcacccgggagcggcggcgacggcaccccgagaggagaagcgcagcgcagtggcgagaggagccccttgtggcagcagcactacctgcccagaaaaatgctggaggctgggcgtggccccaggcctggggacctgtttttcctgtttcccgcagagttccctgcagcccggtccaggtccaggcgtgtgcattcatgagtgaggaacccgtgcaggcgctgagcatcctgacctggagagcaggggctggtcagggcgatggcagcagacctgggcccctggaatgacaccatcaatggcacctgggatggggatgagctgggctacaggtgccgcttcaacgaggacttcaagtacgtgctgctgcctgtgtcctacggcgtggtgtgcgtgcttgggctgtgtctgaacgccgtggcgctctacatcttcttgtgccgcctcaagacctggaatgcgtccaccacatatatgttccacctggctgtgtctgatgcactgtatgcggcctccctgccgctgctggtctattactacgcccgcggcgaccactggcccttcagcacggtgctctgcaagctggtgcgcttcctcttctacaccaacctttactgcagcatcctcttcctcacctgcatcagcgtgcaccggtgtctgggcgtcttacgacctctgcgctccctgcgctggggccgggcccgctacgctcgccgggtggccggggccgtgtgggtgttggtgctggcctgccaggcccccgtgctctactttgtcaccaccagcgcgcgcgggggccgcgtaacctgccacgacacctcggcacccgagctcttcagccgcttcgtggcctacagctcagtcatgctgggcctgctcttcgcggtgccctttgccgtcatccttgtctgttacgtgctcatggctcggcgactgctaaagccagcctacgggacctcgggcggcctncctagggccaagcgcaagtccgtgcgcaccatcgccgtggtgctggctgtcttcgccctctgcttcctgccattccacgtcacccgcaccctctactactccttccgntcgctggacctcagctgccacaccctcaacgccatcaacatggcctacaaggttacccggccgctggccagtgctaacagttgccttgaccccgtgctctacttcctggctgggcagaggctcgtacgctttgcccgagatgccaagccacccactggccccagccctgccaccccggctcgccgcaggctgggcctgcgcagatccgacagaactgacatgcagaggatagaagatgtgttgggcagcagtgaggactctaggcggacagagtccacgccggctggtagcgagaacactaaggacattcggctgtaggagcagaacacttcagcctgtgcaggtttatattgggaagctgtagaggaccaggacttgtgcagacgccacagtctccccagatatggaccatcagtgactcatgctggatgaccccatgctccgtcatttgacaggggctcaggatattcactctgtggtccagagtcaactgttcccataacccctagtcatcgtttgtgtgtataagttgggggaattaagtttcaagaaaggcaagagctcaaggtcaatgacacccctggcctgactcccatgcaagtagctggctgtactgccaaggtacctaggttggagtccagcctaatcaagtcaaatggagaaacaggcccagagaggaaggtggcttaccaagatcacataccagagtctggagctgagctacctggggtgggggccaagtcacaggttggccagaaaaccctggtaagtaatgagggctgagtttgcacagtggtctggaatggactgggtgccacggtggacttagctctgaggagtacccccagcccaagagatgaacatctggggactaatatcatagacccatctggaggctcccatgggctaggagccagtgtgaggctgtaacttatactaaaggttgtgttgcctgctgaactgtgccctattgtgtggtcgggggatgaggatatggcagggaagctttcaccagccacacaagggtcctttctccaatccgttcccttctgccacctgccttctcactagctgtctcaggagtagtctcatatcagggatcctctctccaggccccaggtcatcccccactgtaaagccagttggcttctgtgcctgactctgtgctgagcacagagaaaagtcaggtgcagtcccagtccttgagatttcccagtttaggtgatggccagtcatgtgctggtaaatgttaagccatttaactggagctccgatttaactgggaaccccttctttgtagaactgcccatttccatggtgcaaaaactcttatggccaaattcaaactataaacatgatgtcaacttccttgtaaaattcctgaaaatttaacaattggttcttgcaagcaggtacaagtcactctag

SEQ ID NO: 26235 - DNA, 2548 bp, Homo sapiens
  misc_feature (1042)..(1042): n is a, c, g, or t
  misc_feature (1150)..(1150): n is a, c, g, or t
ggaacagcgcagggaggtgggtagccgggctcccaggcacgtgggtctctgcggctgcggcgggacccgggcactggcacccgggagcggcggcgacggcaccccgagaggagaagcgcagcgcagtggcgagaggagccccttgtggcagcagcactacctgcccagaaaaatgctggaggctgggcgtggccccaggcctggggacctgtttttcctgtttcccgcagagttccctgcagcccggtccaggtccaggcgtgtgcattcatgagtgaggaacccgtgcaggcgctgagcatcctgacctggagagcaggggctggtcagggcgatggcagcagacctgggcccctggaatgacaccatcaatggcacctgggatggggatgagctgggctacaggtgccgcttcaacgaggacttcaagtacgtgctgctgcctgtgtcctacggcgtggtgtgcgtgcttgggctgtgtctgaacgccgtggcgctctacatcttcttgtgccgcctcaagacctggaatgcgtccaccacatatatgttccacctggctgtgtctgatgcactgtatgcggcctccctgccgctgctggtctattactacgcccgcggcgaccactggcccttcagcacggtgctctgcaagctggtgcgcttcctcttctacaccaacctttactgcagcatcctcttcctcacctgcatcagcgtgcaccggtgtctgggcgtcttacgacctctgcgctccctgcgctggggccgggcccgctacgctcgccgggtggccggggccgtgtgggtgttggtgctggcctgccaggcccccgtgctctactttgtcaccaccagcgcgcgcgggggccgcgtaacctgccacgacacctcggcacccgagctcttcagccgcttcgtggcctacagctcagtcatgctgggcctgctcttcgcggtgccctttgccgtcatccttgtctgttacgtgctcatggctcggcgactgctaaagccagcctacgggacctcgggcggcctncctagggccaagcgcaagtccgtgcgcaccatcgccgtggtgctggctgtcttcgccctctgcttcctgccattccacgtcacccgcaccctctactactccttccgntcgctggacctcagctgccacaccctcaacgccatcaacatggcctacaaggttacccggccgctggccagtgctaacagttgccttgaccccgtgctctacttcctggctgggcagaggctcgtacgctttgcccgagatgccaagccacccactggccccagccctgccaccccggctcgccgcaggctgggcctgcgcagatccgacagaactgacatgcagaggatagaagatgtgttgggcagcagtgaggactctaggcggacagagtccacgccggctggtagcgagaacactaaggacattcggctgtaggagcagaacacttcagcctgtgcaggtttatattgggaagctgtagaggaccaggacttgtgcagacgccacagtctccccagatatggaccatcagtgactcatgctggatgaccccatgctccgtcatttgacaggggctcaggatattcactctgtggtccagagtcaactgttcccataacccctagtcatcgtttgtgtgtataagttgggggaattaagtttcaagaaaggcaagagctcaaggtcaatgacacccctggcctgactcccatgcaagtagctggctgtactgccaaggtacctaggttggagtccagcctaatcaagtcaaatggagaaacaggcccagagaggaaggtggcttaccaagatcacataccagagtctggagctgagctacctggggtgggggccaagtcacaggttggccagaaaaccctggtaagtaatgagggctgagtttgcacagtggtctggaatggactgggtgccacggtggacttagctctgaggagtacccccagcccaagagatgaacatctggggactaatatcatagacccatctggaggctcccatgggctaggagccagtgtgaggctgtaacttatactaaaggttgtgttgcctgctgaactgtgccctattgtgtggtcgggggatgaggatatggcagggaagctttcaccagccacacaagggtcctttctccaatccgttcccttctgccacctgccttctcactagctgtctcaggagtagtctcatatcagggatcctctctccaggccccaggtcatcccccactgtaaagccagttggcttctgtgcctgactctgtgctgagcacagagaaaagtcaggtgcagtcccagtccttgagatttcccagtttaggtgatggccagtcatgtgctggtaaatgttaagccatttaactggagctccgatttaactgggaaccccttctttgtagaactgcccatttccatggtgcaaaaactcttatggccaaattcaaactataaacatgatgtcaactggctttacagtgggggatgacctggggcctgg

SEQ ID NO: 26236 - DNA, 2643 bp, Homo sapiens
  misc_feature (1107)..(1107): n is a, c, g, or t
  misc_feature (1215)..(1215): n is a, c, g, or t
caaggcgctgggagaggcccggggaagcggcgggccagactggcgcaggtgcggactgggcgcggggcaggggagggcgctgtggagcggctgtcgccccggggcacagttgcgagccggcgtgtagcgcataactggacggcttgaacgcgcctgtgggtccgtggttgaactttgtctccacgggagcgtcggtctcggagccccttgtggcagcagcactacctgcccagaaaaatgctggaggctgggcgtggccccaggcctggggacctgtttttcctgtttcccgcagagttccctgcagcccggtccaggtccaggcgtgtgcattcatgagtgaggaacccgtgcaggcgctgagcatcctgacctggagagcaggggctggtcagggcgatggcagcagacctgggcccctggaatgacaccatcaatggcacctgggatggggatgagctgggctacaggtgccgcttcaacgaggacttcaagtacgtgctgctgcctgtgtcctacggcgtggtgtgcgtgcttgggctgtgtctgaacgccgtggcgctctacatcttcttgtgccgcctcaagacctggaatgcgtccaccacatatatgttccacctggctgtgtctgatgcactgtatgcggcctccctgccgctgctggtctattactacgcccgcggcgaccactggcccttcagcacggtgctctgcaagctggtgcgcttcctcttctacaccaacctttactgcagcatcctcttcctcacctgcatcagcgtgcaccggtgtctgggcgtcttacgacctctgcgctccctgcgctggggccgggcccgctacgctcgccgggtggccggggccgtgtgggtgttggtgctggcctgccaggcccccgtgctctactttgtcaccaccagcgcgcgcgggggccgcgtaacctgccacgacacctcggcacccgagctcttcagccgcttcgtggcctacagctcagtcatgctgggcctgctcttcgcggtgccctttgccgtcatccttgtctgttacgtgctcatggctcggcgactgctaaagccagcctacgggacctcgggcggcctncctagggccaagcgcaagtccgtgcgcaccatcgccgtggtgctggctgtcttcgccctctgcttcctgccattccacgtcacccgcaccctctactactccttccgntcgctggacctcagctgccacaccctcaacgccatcaacatggcctacaaggttacccggccgctggccagtgctaacagttgccttgaccccgtgctctacttcctggctgggcagaggctcgtacgctttgcccgagatgccaagccacccactggccccagccctgccaccccggctcgccgcaggctgggcctgcgcagatccgacagaactgacatgcagaggatagaagatgtgttgggcagcagtgaggactctaggcggacagagtccacgccggctggtagcgagaacactaaggacattcggctgtaggagcagaacacttcagcctgtgcaggtttatattgggaagctgtagaggaccaggacttgtgcagacgccacagtctccccagatatggaccatcagtgactcatgctggatgaccccatgctccgtcatttgacaggggctcaggatattcactctgtggtccagagtcaactgttcccataacccctagtcatcgtttgtgtgtataagttgggggaattaagtttcaagaaaggcaagagctcaaggtcaatgacacccctggcctgactcccatgcaagtagctggctgtactgccaaggtacctaggttggagtccagcctaatcaagtcaaatggagaaacaggcccagagaggaaggtggcttaccaagatcacataccagagtctggagctgagctacctggggtgggggccaagtcacaggttggccagaaaaccctggtaagtaatgagggctgagtttgcacagtggtctggaatggactgggtgccacggtggacttagctctgaggagtacccccagcccaagagatgaacatctggggactaatatcatagacccatctggaggctcccatgggctaggagccagtgtgaggctgtaacttatactaaaggttgtgttgcctgctgaactgtgccctattgtgtggtcgggggatgaggatatggcagggaagctttcaccagccacacaagggtcctttctccaatccgttcccttctgccacctgccttctcactagctgtctcaggagtagtctcatatcagggatcctctctccaggccccaggtcatcccccactgtaaagccagttggcttctgtgcctgactctgtgctgagcacagagaaaagtcaggtgcagtcccagtccttgagatttcccagtttaggtgatggccagtcatgtgctggtaaatgttaagccatttaactggagctccgatttaactgggaaccccttctttgtagaactgcccatttccatggtgcaaaaactcttatggccaaattcaaactataaacatgatgtcaacttccttgtaaaattcctgaaaatttaacaattggttcttgcaagcaggtacaagtcactctag

SEQ ID NO: 26237 - DNA, 494 bp, Homo sapiens
tacaaacaacaggaatataaaatgtgggacaccttctgtggcctggacatccctgctgcctcgagctccccgcagctgctgatgttcgctagcgcctctcgtcaccccagtaccacgctctgaccttctgttcctgctgcacctgttccccaccccagcatctttgcccgagggaaggcttcgtccaatcccgttcccgccctggatgaccacgccagctgtgggcctgcctggccgaacgcaggtctccatcagaggggcccgtctgcatgggggtgcctgcacacctgtcgtgtcgacatcactgaggaccccttgggggctcaggccagcttgagggcctctttgtctcctaaataactgggacagtatctggggcttagatgagcagtcagcatagcaataagtgaccggaaatacagagatgtgtggactaagactgttgaggttgactcggatgtgtgcaaaggccccaaagtgacctccctccacgg

SEQ ID NO: 26238 - DNA, 422 bp, Homo sapiens
agggagccatgagcctcgtgacataactgttgttaaaaaccctttttcagaatctcgttattatatgtgcttgccagaagcttacatattttagttcagtgaagtcatccacacagggctgtgtaccaccacacagttggtttggaacaccagtgctgaaggttgaaggcttttagggccggcagacctaagggaaaaatcgaaaccaaaagatgggattaacagtgaaaagctcagttgggttgagatcgaaccccctggaagctcagcttagattgacttaaaatcagttaacagggcctgtagtttatgtgtagccctgaggacttctagaaccacatacgtctttgactttgaaagtgcgtggcctctcttgcccccttcagttttggctgattcactttctagtaggtgctcttacc

SEQ ID NO: 26239 - DNA, 368 bp, Homo sapiens
atgaatgtcagaataatttctctttcacagtactttatacaaattatctccttttgtgcacaaaccctacaaggctgggacttgactttcctcatttcacagggggtcagactgaggcaccaagaggttgaggtggagcagggattccaacctgcatgggcttagccgtggcaccccagcacgtctgtgctctgtcctgttctcacacttaccctcctgggcttgtactccctgtgtctcagcttccacgggagttcctgttctctgggcagatgaggtctgcttgtctggagttggagaactgaatctgttttcagaaattgtatctgctaaagagttgttaagtgctttgttagcagcgaagaaga

SEQ ID NO: 26240 - DNA, 388 bp, Homo sapiens
acagaggggtcggaccctttccaagtacttcacatggattagctcgttgaatcttcacaggacctatgagatattataccaatttttcaggtgaagaaatagagacataagagacatcaagagtttaaataacttgcccaagatcacatggctagaaagtggcagagccaggatttgaattcaggaagtctggctgcaggcccacacccttagagaaactgtcagggctgggtgtggtagttcatgcctgtaatcctagcactttgagagactgaggttggcagatcacttgagctcaagagttctaaaccagcctgggcaacatggtgaaacctcatctctacaaaaattagctaggcgtggtggcatgtatctgtagtcccagcta

SEQ ID NO: 26241 - DNA, 385 bp, Homo sapiens
ttttttgagacacaatctcactctgttgcccaggctggagggcagtggcatgatcttggctcaatgcagtctcgacctcttcgggttcaggtgatcctcctgcctcagcctcctcacctcagtcttatgggtaactgagactataggtgcatgccaccacgcctagctaatttttgtatttcttgtagagacaggggttcaccatgttgtccaggttggtctggaactcctggactcaagcaatccacctgcctcggcttcccaaaatggtgagattacaggcatgagccaccgtacctggcaagcatcttttcatttacctgttggctatttgtgtgtcttctttggaaaagtgtctattaaggtcctttgccccacctccact

SEQ ID NO: 26242 - DNA, 558 bp, Homo sapiens
gactgttaagtgtgagccaccatgcccagctaatttttgtagtttttgtagagacagggttttaccatgttgtccaggctggttttgaactcctgggctcaagtgacctgtctgtcttggcctcccacagtgctgggattgcaggtgtgagccaccatgcctggcatagggggctgtatttcagtgaaattagaaaagttttgaggcatcgaatggataaatggatggatatatcaaattgtaaggtattaagtgggtgaatgtatggacatttgtagaatcccacagataatttatctttttgtgtaaaataaggcttttaaaactagactttctgaaccaatacagtttttttttttttgaggtgaactaggtttgcctagctttaagctagcaatatctgatagatacttgcatctaattttagggatttggtgccaaataagagaagggtagttgaagactagataaatttggatactatctaggagtctgtatttacttagcaggcttttgaaagccgttttgcttaggagttcaaattttaaggataatagg

SEQ ID NO: 26243 - DNA, 514 bp, Homo sapiens
ggtaaagatggtgtacatgcattttagagatttttgtggacattgaagaatttttaaatgtaaccctttgaccaggcagcttaagtggcacctattgtcaccccattgtgagtctgacgaagtatagctctttctttatttgaggtttctaggtattcagtttacttacccagatccatcctgcttgccaagtatgaaattattccttgtttcaaaggacagctaatgaagctctatgactttaaagggaaaaaagtattatacacacactaaaaatattattcatttttattttacatctttgcctctgtgaagctgctgttattgcaacttcttttttttttttcagatcagttgcaggattggacttggtagtttatgtaaaacaattaattggctgggcacagtggctcaagcctgtaatcccagcactttaggaggtcgaggtgagtggatcacctgaggtcaggagtttgagaccagtctggccaacatggtgaaacctcgtctgtac

SEQ ID NO: 26244 - DNA, 1100 bp, Homo sapiens
gtaaagggggctgctaattacgctggggcaggcggggcaaaccaggaccctgccaggcgagtctaggccatggccccacaccagaagatgagggctggagactcctggagaggaatctgagtggcgagaccacctgcattcattatgtgtcaactctgccaggtgacagtccccagtgagcccatcaaacatgaacctaggtgctgttgggaaggtctttggatgccattaacatctacaatcagttggttttcagtagaggagattatcctcaagaatgtgggcgggcctcatccagtgagctgaaaggccttgagagcagaactaggattttggaggaggatgaagtgttgcctccggaccgcagcgtcacctcttgcctgggaatttccagcttccttttcagacttcggacttgcctccaagctccctgaatcttttcatatatttatgtcctattgcagattgtgtttctctggctggactgtaactgatgaggaggactaaaattccaggcttggttgtatagcatataagtgaggtcatttgggtctggggagctgggggggggtccttcagctgcatgagtgtgacctgcaccaaggtgcctggctacctggggcgagggggctgccatctagcccacaccccactcctaggccgtgcaccctggcatgggtctatgtctggctcaaggaagggttccctcctccctccaatgtgcacagagaccttgagatcccatccacctaaccctgtgccctcagaagcctcctctgagagggggcaccttttcctaattctcacaaaggctagtggctaccttgtagatagccttggatgtgttaggacacttttctgaacatcagttccttatctgtaagatgggagttgtgtcctcaatgggtaattagagattattcatgggaaatcctatcacggtatctaccacggggagactcacaagtgctgatctttgctggtgttgctgcatttgttattgaatgcattcgttaggagtcttgttagtaagtgacaaaaatccaactcaaattggcttacactaaacaagtttcctgcatctgggagtataaagggtg

SEQ ID NO: 26245 - DNA, 421 bp, Homo sapiens
ttgggttctgagcagtgtagattctactgctaaggcttggactacaagccatcgatgcttacttgttcctggcattcataccatagggattcaaacacccaagctgagaatttaatttaggcatatcccaggctggttttgtgcccctgagcacccggtagaaacaaatacaagtcatctctggaaaagaagcttcattttacacctcaacaaattgccacagctaaaatatccccccaaaaatgcacaaggagcttcacaatctaaattaaacatcatgaaactagaagtatgactaatgaaaacaaaagcaacagacaatgggagctgggcgtggtggctaatgcctgtaatcccagcacttcgggaggctgaggctggaggattgcttgaggccaaaagtttgagatcctgtctctga

SEQ ID NO: 26246 - DNA, 506 bp, Homo sapiens
caaactcctgaccttgtgatccacccgccttggcctcccaaagtgttgggattacaggcgttgagccatggcgcctggcccacagctttttctagttgtgtttaggtgcttaggctcaggatatggggtttagtaaataagccttccatatgcatattgtcagacccaaatcagtccacagctatcttactggaagtggggtcacaaggcaatttctagaaagcaagttctgataaaggtaaattgattcactggaagatcttaagatatataaaatatctccaataccatgtgtttaattttagtgaataagaataatatagtttctttttaaagctagcacaaatcaagtaataaaacccagcaaagcacacacaaaaatataggctagccaggtgtggtggcacatgcctgtaatctcagctatatgggaggctaaggcaggaagattgctagagcccaagagttcaagaccagcctagtcaacatagcgagattccgtctca

SEQ ID NO: 26247 - DNA, 395 bp, Homo sapiens
aattctttttttaaaaaaagtattataatcaaacctaaaagaaaaatttaagaatagtgtcaatataatgagatatccaattaatgtttacattttcctgatttggtaatgtctggagatgtttgaacttgaaggaggtgtgttgatggcgtctagtgggtggaagccaaggatgttaaaaactatggtattcagaacagctttctgcaacaaataattacctggttgaaatgtcagtggtgctaatgttgagaaacattggtctgtaacctcaccactggttttagataccttagtattcttttaatttgctttttaaaattatgagtgaagtcaaacatcttttgggctttaaggatcatttacatatatatttctctgtactgcctctacat

SEQ ID NO: 26248 - DNA, 382 bp, Homo sapiens
ttttcctgcttccaccataacatgagcaggtcaaggggtcagactgtgtagaccagttccgagccatgcaggaaggcaggcaggaatatccagatctctatccccaagaaggggaggaagaggtagaggagaagccagcagaacatgtagaagaaacagctcccaatgaggctactgcaaccaaagaaaaggaagggtcaagttaatgaaggccacatggccctgggctccagtccttccacttcaaagtaatacaaatcttttgcaaaagaccttttagtcactctccaagagagcctctttccctctgttgtcctgtgcactgtaatatacaaaattgcttattttgatgatcagaggttttggcctcttgacatataca

SEQ ID NO: 26249 - DNA, 275 bp, Homo sapiens
gtcagggtttcatctgttgcccaggcttgagtgcagtagcacgatcacagctcgctgcagcctcagccttcctgggctcaggtgatcctcctacctcaggcccccgagtagttgggactacaggtgtgtgccaccatgcctggctaatttttgtatatttttgtagagacaaggttttgccatgttgcacaggttggaactgttttgaaggttgatatttttaatggtttaaaattttagatttgaaaatgaaaaatttattctctagtttatcc

SEQ ID NO: 26250 - DNA, 587 bp, Homo sapiens
ggttgatacttttgattgtcacaatgattggcttttgattgtcacaatgattgggagcgttattaccactcacatatagtaaatgaaggatgggatagtcctacacaaaaaattatctagctccaaatgtcctcagtgtctctgatgagaaacactgatctagtccatagtcagggctgccaggtatgggtgtgcaggttgcccactgtacaactcttaagggaaccattcacctggtggctaagtgtgtcaattctgaaaccatactgcctgagttccagtgccaactggaactgccccccaccccctacttctttttttttttttgagaccgagtctttctccaccacccaggctgcagtccagtggcacagtcacagctcactgcagactctacctcccgggctcaagtgattctcctacctcagcctcttgaatagctgggcgcctgtagtcgcagctactcgggaggatgaggcaggagaatggcatgaaaacccaggaggcggagcttgcagtgagccgagactgagccactgcactccagcttaggcgacagagccagactccacctcaaaaaaaaaaaa

SEQ ID NO: 26251 - DNA, 588 bp, Homo sapiens
agtttgtaaattacttgacaaatcctttgctttgccaattctacactaagaaaaggaagccagctgacatcggaaatgcagggggttaaatgctgccttcttcagtgtccagttcaatattagggcattaggaagaaaaattaagaattcttttttccttataaaatttcaaggtaaattgaaattttaccgtgcgtaaaaccctcactagcaatgcatgaaccagggtctcagatagcattggtgaagtgtaaagaggaaccccaagcagatgagcctaaagagaaatcagacaaggcttggtttgttttgggtcttgagtttcagctccacttctgtcctcaaggcccatttcctagcctggtgtggggtggttgcatgtgggcttgagagttcaactgcccaagtttgcagctctgccctgtctcttattagttgtgtattggtaccctattttgggcacattaactattctgcacctcagtttttctatcagtaaaaagggacaacagattctaatcaaaatcccagggaggctattgctttttaatttcgtgaaacttaggcggattctcaaatttatatgca

SEQ ID NO: 26252 - DNA, 171 bp, Homo sapiens
aaaacaaaaaagacacaaaataaatcgaagccagtcacacttaaaagttgggtacaccagactcccactgtagattcagaataaatagcagacaggaagaacagacagacagacacactcctgccacacatatgcacatatcaacatactgcaatgatgctttaataatgc

SEQ ID NO: 26253 - DNA, 642 bp, Homo sapiens
gcaaaggagaaatgcttgttaatatacaaactctagtcagttacctgtgaggatgagatgtgtcagaggactcagactttggtatagttagaaaaataatatttttctcacttgattctgtgtgaatgtctcttctgatactgttttttaatcagaaagttacagagcaactttcccacaaacaaaccaataaaacaaaaccccacaaaaaccaagagcatgaagaaaagtttaaatccctaattatatactcttttggtttttaggtagaaactggagctatcaatattttcatgtaagtatttcaaggagtagctctttaaaaatggtttctaaattagattttaaaaattcattgtcatctaaatgcatgtttagtcacaatgtatcagtattgtgtttaaaggtgctcagcatcactttttgaaaactatgtttacatatttaaaatgtttaattattttgaaatgtatagggtattaaatacaagcttctaaaattttcagtatctatattggctttctctaacagctctacagcaaagtttgacatgttttttgtgtgtgtcatgtattgtaagttgtaatatctgtaggagtgagttggacattctaaattagcagtaaaaaattcacaattaca

SEQ ID NO: 26254 - DNA, 376 bp, Homo sapiens
cgttaaattccactcaagacagtttctttactgaaaaggtatgaaattacgtgagaagaagtacaaatttcaggcccctagaatctgtctattaatataacatttgaatttctgggaaatctggggcacacattcacggtagaataacaaggaggcattgcttgcaggggagcgtactcagaacagtgctgtggatcctggcttgacacccttttctggaaaattggggtcactctctggctcagctacagaatggcctgtctttgtcaggagggacactaacttctcattaaggccatgctcttcaggaacagagaggatgatttggtttttggtttcaggtttttatttttatttttgttttgagacagtctca

SEQ ID NO: 26255 - DNA, 929 bp, Homo sapiens
ccggtgaggatgcgacgtgcaagggccatcgtggaagaggagaacccaaccttggcctccagacggggaggcaggaagtctctgttgataaactgctgtctgatgttctgttgtggcctcactcaaaccgtggcggggagcggttgctaacaggcacaggacgtcttctgcggatgatgaacgtgttccggagtgagatgagtggggatggttgcacaacttcgtgaacatgctaaaaaccactgaattgtacactgtaaagagtgacttgtgagcatgtgaatttcatctcaatgaagctgttttgcgggagccaggtgaagcactgtggaggccacggctcaagaaggcagcaccggcgtgagccaccgcacctggcctgatttttaatttttaaatgagggagcagaggcataactaggtttacaatcatgtcatcaacaaaataaattgtcttatttttctgatatttgtgccatttatttggtttttctattaagtttgccagaacctccgagaaaatgctggacaattatgacagcagcaggccccacgagtcgaccctggatttgtgacatttgtgttttccacgtagaacgatcttggccactattgtggacagagacttttgcacttttttctattttactagaaatagtgcttttattcataaagattgctgaatttggtcagttttcttttcagtacctgtcggtgaggttctctgaattttctgtgctaattggctaatgaaatgacgtctctgatgactgcgctgccctcgtaagcctggccttcatctgcttggccataacacgatgctgccgacgctgtgttgggtcctatttgctgttctcttgtgtagaatccgccgacgctgcgttggttcctatttgctgttctcttgtgtagaatccgctgatgctgca

SEQ ID NO: 26256 - DNA, 1002 bp, Homo sapiens
gaaactgcgcgcggacctcagtgtggcaggcactcccggggtgcagacggggtgaaggcagccttctctgtggtcacgtgcatgtaacggcaccttctctctcagggcctcctccctccctgcgtggtttgggggctgttcctgatagcacagatgccctgatcacaaacacctgcctgcattgctgaccacaggcctggcctggagaaacccacagcctcttcagggaagcgagcaaggggcttggaagtgcctgaagccagtgggctggggactcacggccgggacactcagggcaggccatgcgccgtttctcctggaataactggaggtgatttcatggaacctggaggctgggcttcaggctggggggagaggctccagactgggtcttctccgtggctctgccccccgctctccttgcttgagtggtgggggccctgcatcctctcatgcccacccccacctttctcgccaaattgtcggaggcttttgtcacctggagacactgttcctgccagctccggtcttggaaaacatggcctctcctctcctgccctggccccggcccctcctgccagctggacgtgggcatttctgcacccagtagaaccccacagccaggaaagatgcctggaaggctagagaagaggcgtgatggggggaccccatgtgtggcgacagagcagcacacccagctattctcagccaccatgtgggagagaaatgacgcctctgtcgagctccccatggccggagctgctccatacagcatcctaaccttcacccccaactactcagttgccatggcaaagggaatattttgactccctttttttaaaatttccaggtgattattgctagaggagtgggaagttactaatttttgtatatttatcttgtattaaaatgtttttactgatttttaattttaattttaatattttttgagatcacgccactgcactatagcctgggtgacagagcaagactctgtctcca

SEQ ID NO: 26257 - DNA, 956 bp, Homo sapiens
gaaactgcgcgcggacctcagtgtggcaggcactcccggggtgcagacggggtgaaggcagccttctctgtggtcacgtgcatgtaacggcaccttctctctcagggcctcctccctccctgcgtggtttgggggctgttcctgatagcacagatgccctgatcacaaacacctgcctgcattgctgaccacaggcctggcctggagaaacccacagcctcttcagggaagcgagcaaggggcttggaagtgcctgaagccagtgggctggggactcacggccgggacactcagggcaggccatgcgccgtttctcctggaataactggaggtgatttcatggaacctggaggctgggcttcaggctggggggagaggctccagactgggtcttctccgtggctctgccccccgctctccttgcttgagtggtgggggccctgcatcctctcatgcccacccccacctttctcgccaaattgtcggaggcttttgtcacctggagacactgttcctgccagctccggtcttggaaaacatggcctctcctctcctgccctggccccggcccctcctgccagctggacgtgggcatttctgcacccagtagaaccccacagccaggaaagatgcctggaaggctagagaagaggcgtgatggggggaccccatgtgtggcgacagagcagcacacccagctattctcagccaccatgtgggagagaaatgacgcctctgtcgagctccccatggccggagctgctccatacagcatcctaaccttcacccccaactactcagttgccatggcaaagggaatattttgactccctttttttaaaatttccaggtgattattgctagaggagtgggaagttactaatttttgtatatttatcttgtattaaaatgtttttactgatttttaatacggattgccagatacaagcagacaa

SEQ ID NO: 26258 - DNA, 1149 bp, Homo sapiens
ccggtgaggatgcgacgtgcaagggccatcgtggaagaggagaacccaaccttggcctccagacggggaggcaggaagtctctgttgataaactgctgtctgatgttctgttgtggcctcactcaaaccgtggcggggagcggttgctaacaggcacaggacgtcttctgcggatgatgaacgtgttccggagtgagatgagtggggatggttgcacaacttcgtgaacatgctaaaaaccactgaattgtacactgtaaagagtgacttgtgagcatgtgaatttcatctcaatgaagctgttttgcgggagccaggtgaagcactgtggaggccacggctcaagaaggcagcaccggctgggcgaggtggctcacgcctgtaatcccagcactttgggaggctgaggtggctggatcacgaggtcaggagatcgagaccatcctgactaacacagtgaaaccccgtctctactaaaaatacaaaaaaattagccgggcgtggcaaccggcgcctgtaatcccagctactcaggaggctgaggcaggaggatggcgtgaacccaggaggcggagcttgcagtgagccgagatcacgccactgcactatagcctgggtgacagagcaagactctgtctccaaaaaaaaaaaaaacaaaaaggtcggaccctcgacaaaacccgaaacaacgtgggccggggaatacctcacaccaaagctgtgccaggaacaacacctcccggggctacacacacgcggcgacaaaggagcacgccctatcgcacatgatgcgtcagcacagccgtctgtatacacgcgggaaaccccattctctacgcaccaaggagccaatctaccacttaccaagaggaagaatataagggaggaagatagacacgccgagataacagacaaaggaggcgcccggtagacacaacagaacaaccgcccggagaccacggccgcacgacggagtgacacgcacaggggcacgaggcgcacgcgggaagaaacaagccacaaacgagaccaatcgcagggagcaagcgacgaaacacagaggcggcacaatgcaaaccgtctgcccctgaaacaacacagaaccggatgtcgagagacatcaccacgagacacgcgaaacaacgacag

SEQ ID NO: 26259 - DNA, 1779 bp, Homo sapiens
gaaactgcgcgcggacctcagtgtggcaggcactcccggggtgcagacggggtgaaggcagccttctctgtggtcacgtgcatgtaacggcaccttctctctcagggcctcctccctccctgcgtggtttgggggctgttcctgatagcacagatgccctgatcacaaacacctgcctgcattgctgaccacaggcctggcctggagaaacccacagcctcttcagggaagcgagcaaggggcttggaagtgcctgaagccagtgggctggggactcacggccgggacactcagggcaggccatgcgccgtttctcctggaataactggaggtgatttcatggaacctggaggctgggcttcaggctggggggagaggctccagactgggtcttctccgtggctctgccccccgctctccttgcttgagtggtgggggccctgcatcctctcatgcccacccccacctttctcgccaaattgtcggaggcttttgtcacctggagacactgttcctgccagctccggtcttggaaaacatggcctctcctctcctgccctggccccggcccctcctgccagctggacgtgggcatttctgcacccagtagaaccccacagccaggaaagatgcctggaaggctagagaagaggcgtgatggggggaccccatgtgtggcgacagagcagcacacccagctattctcagccaccatgtgggagagaaatgacgcctctgtcgagctccccatggccggagctgctccatacagcatcctaaccttcacccccaactactcagttgccatggcaaagggaatattttgactccctttttttaaaatttccaggtgattattgctagaggagtgggaagttactaatttttgtatatttatcttgtattaaaatgtttttactgatttttaattttaattttaatattttttgagatggagtttcactcttctggcctaggctggagtgcagtggtgtgatttcggctcgctgcaacctccacccatgggttcaagcgattctcgtgcctcagacccccgagtagctgggattacaggcatgcaccaccacgcccggctaattttgtgtttttagtagagacaggatttcactatgttggtcaggctggtctcgaactcctgatctcaggtgatctgcccaccttggcctcccaaagtgctgggattacaggcgtgagccaccgcacctggcctgatttttaatttttaaatgagggagcagaggcataactaggtttacaatcatgtcatcaacaaaataaattgtcttatttttctgatatttgtgccatttatttggtttttctattaagtttgccagaacctccgagaaaatgctggacaattatgacagcagcaggccccacgagtcgaccctggatttgtgacatttgtgttttccacgtagaacgatcttggccactattgtggacagagacttttgcacttttttctattttactagaaatagtgcttttattcataaagattgctgaatttggtcagttttcttttcagtacctgtcggtgaggttctctgaattttctgtgctaattggctaatgaaatgacgtctctgatgactgcgctgccctcgtaagcctggccttcatctgcttggccataacacgatgctgccgacgctgtgttgggtcctatttgctgttctcttgtgtagaatccgccgacgctgcgttggttcctatttgctgttctcttgtgtagaatccgctgatgctgca

SEQ ID NO: 26260 - DNA, 507 bp, Homo sapiens
taaaaaaatgctttaaaatggaagtgaacagaaggcaagggcaacttagggtgacatactgttaaacacataaatcattttaaatggctgaattaatccataaaacaaatatacacctagaaaaaccagagctggaatttctagtaaactatttttaaacattgtaaaatatgtcttttaggctgggcacagtggctcacgcctataatcccagcactttgcggggctgaggagggcagatttcttgaggtcaggagttcgagaccagcctggccaacacggcaaaaccctgtctctactaaaaaaaacacaaaaattcgccaggtgtggtgacacacacctgcaatcccagctacttgggaggccaaggcacaagaactgtttgaacctgggaggtggaggctgcactgagctgagatcacgccactgcactccagcctgggcgacagagtaagactctgtctcaaaataagaataataataataaattacgttttttaaaggggt

SEQ ID NO: 26261 - DNA, 258 bp, Homo sapiens
aatatcggaaaaaccttctagagagtggcttaggcagagacttcaggactaagaacccaaaagcaaatgcaacaaaaacaaagatgaatagatggaacttaattaagctaaaaagcttctgcgtagcaagggaaataatcagtaaacagacaacccacagagtgggagaaaatattcacaaactatgcatctgacaaaggactaatatccagaatctatgaggaactcaagcaaatcatcaagaaaaaaacaaatata

SEQ ID NO: 26262 - DNA, 429 bp, Homo sapiens
  misc_feature (262)..(262): n is a, c, g, or t
  misc_feature (306)..(306): n is a, c, g, or t
  misc_feature (375)..(375): n is a, c, g, or t
  misc_feature (388)..(388): n is a, c, g, or t
  misc_feature (422)..(422): n is a, c, g, or t
aaaaaaaaaaaaaaatgcaataatgaaaaaaaaaagttatgcaacaatgtcttaacccaagcatgttctgcctcagggcctttgcacttgttggcctctgtctggaatatgcttttctcagatctgcctgcctcaacttcccaaagtgctgggaatacaggtatgagccactgcgctttaagtcttttttttttttttttttttgagatggattttcactcttgtcacctaggaatggagtgcaatggctcaatctcggctnactgctatctccacctcccagggttcaagcagttctcctgcctnagctactcagggaggctgaggcagggaggaatcacctggaacttagggagggtaggagacttgaagtgnagcttgaggatcnccagttttgggggtgacagagtgaggactctgtntccaaaa

SEQ ID NO: 26263 - DNA, 357 bp, Homo sapiens
ttagtagtgtttcataaaataaaggggcatattacaaaaatatagactgtagaaaaatttgaaaaaaactatttttacagggaggagtaatttcattaatataagatggtattcttagcaacagtcatcatggaaaccaggaaaataagccttaaattttatgactttgtcccttcctattgatttcaggttatgtttgtatggataatcataggctacactgccacactgtccaacatgatagccactcgccaattgtggttatttacattaattaaaattaaataggccaggtgcagtggcatgcacctatagtcccagctacttgggaggctgaggtgggaggatcgcttgagc

SEQ ID NO: 26264 - DNA, 1006 bp, Homo sapiens
gtgtggtcaacactttcgttactttagtatacatcaccccaattgtttgtcttcaccacacactttggagttaggtagtagtatctatttttacaaataagaaaacccaggcacaaaggggttgattagcaattatcttttgaaaagcctgtagttgctcatctgaagaagtgacggaccacctcttatttagtggacagacagtaactagttgagaagacaggggattttgttggcggaaaaaaaaatttatcaaaagtcgtcttctatcagggagttttatgagaaaccctagctcctcagttccacagtgggtaactgtaattcattctaggtctgcgatatttcctgcctatccattttgttaactcttcaatgcattccacaaatacctaagtattctttaataatggtgggttttttttttttttgcatctatgaagttttttcaaattctttttaagtgacaaaacttgtacatgtgtatcgctcaatatttctagtcgacagcactgctttcgagaatgtaaaccgtgcactcccaggaaaatgcagacacagcacgcctctttgggaccgcggtttatactttcgaagtgctcggagcccttcctccagaccgttctcccacaccccgctccagggtctctcccggagttacaagcctcgctgtaggccccgggaacccaacgcggtgtcagagaagtggggtcccctacgagggaccaggagctccgggcgggcagcagctgcggaagagccgcgcgaggcttcccagaacccggcaggggcgggaagacgcaggagtggggaggcggaaccgggaccccgcagagcccgggtccctgcgccccacaagccttggcttccctgctagggccgggcaaggccgggtgcagggcgcggctccagggaggaagctccggggcgagcccaagacgcctcccgggcggtcggggcccagcggcggcgttcgcagtggagccgggcaccgggcagcggccgc

SEQ ID NO: 26265 - DNA, 362 bp, Homo sapiens
tcattaaaaagtttacaaaaaattgtattactcgatatacatcttatttgaactagccttttccattcagtagctatgttgtttgatagctagagtctgttgattgatatttgggttctgaataactaatgttttcaagtatcctttaaaaactattatttttatattataggagatatttcaatgtgtatattaggaaaactctaactgcattctgaaaaaataagttcctgagatttccgttcagcaatacttttgaaacacagataaaattacttcctgtctcttagcttcctgtatccatggcaacctctgttttacacattgactgtaaaggaaccaatgtgaagagtggtgtttcc

SEQ ID NO: 26266 - DNA, 2133 bp, Homo sapiens
  misc_feature (1306)..(1306): n is a, c, g, or t
ggagcagtcgtgcattcccagcctcgcctcgggtgtagggattgcatagaaaagcaaaactacacagtcttgactgtgtagttttgtttttaggattagaggctcaccgattcatgtcggagatggtcagaaaaaccaactctccataggacgtcgtttcagaagcaaccttgggcttagtcccaccctttttaggcactcttgagaaatcagagtgcctagaaagatgacaactcaagcaccgacgtttacgcagccgttacaaagcgttgtggtactggagggtagtaccgcaacctttgaggctcacattagtggttttccagttcctgaggtgagctggtttagggatggccaggtgatttccacttccactctgcccggcgtgcagatctcctttagcgatggccgcgctaaactgacgatccccgccgtgactaaagccaacagtggacgatattccctgaaagccaccaatggatctggacaagcgactagtactgctgagcttctcgtgaaagctgagacagcaccacccaacttcgttcaacgactgcagagcatgaccgtgagacaaggaagccaagtgagactccaagtgagagtgactggaatccctacacctgtggtggaagttctaccggggatggagccgaaatccagagctcccttgatttccaaatttcacaagaaggcgacctctacagcttactgattgcagaagcataccctgaggactcagggacctattcagtaaatgccaccaatagcgttggaagagctacttcgactgctgaattactggttcaaggtgaagaagaagtacctgctaaaaagacaaagacaattgtttcgactgctcagatctcagaatcaagacaaacccgaattgaaaagaagattgaagcccactttgatgccagatcaattgcaacagttgagatggtcatagatggtgccgctgggcaacagctgccacataaaacacctcccaggattcctccgaagccaaagtcaagatccccaacaccaccgtctattgctgccaaagcacagctggctcggcagcagtccccatcgcccataagacactccccttccccggtcagacacgtgcgggcaccgaccccatctccggtcaggtaaagctgccatagagagagcagattattgcacattttggaactaggttttgaaacgagaaagattcccttgtccccctcgcagggcatgcgacgcggagagtggttcgcttcttcagtgtcccgctgctcaaacctctaggggagcatacaaacgggcaggntgtggggctccgtgttcctctggacatccagccgcttgtgtgtctgcctactagggtctcaggggtttttataggcatagggtgtgggcgtggcaggtcagggtgatcttgggaaatgcaacatttgggcgggaaggcaggagtgtttgtcctcacctaggtccatgggcacaggcctcgctagggaccacgcacttctcttcccagcacttccctgccctcctcccgtgtaagtttcatgcactcaaaaatgtagcaggtgacaaaggaggtaaaccaagaagttactgaatatgattttcacaaatcctcactgtccacaggtaaattgaagacccttataaacttctgaattcttatttatatttcatgtaataaatatctactttaggggccaaaatatggcacagtgaaaggagaagagcacagaagttagagttcaaagccctaaggacaaatcagcctgatcacttaacagtttgatttagggcaataagtataaataataaaataattgttattatatatggatcacttcctctatcagattggaactatacatacattatctcattaaatgttcacaacctgtaagaattattatcctcaatgttattgataggtaactggaattaaagaagttaagcagtttatttaaggtttcagttgtgtcatctgtaaattaaagagagtcacaataagaatgatctcaagctgcattttggggcttcaatgagataattagttgaaagtgccttgtaaatagaaaataattatgccaatattcttatattcagatggtaagtaaaaccttttaaatattttgc

SEQ ID NO: 26267 - DNA, 3359 bp, Homo sapiens
gccacccgggagcctgaggtgggaggattgcttgagtctgcgaggttggggctgccgtgagcccagattgcgccattgtgctccagcctgggtgacaaagcaaggccctgtctcaaaaaagaagaagagaaagggccaggggcttttgctttaaaaaactttttttaaaacagaagtgaaaccacgggtgctttgttcttccttctgcacctccttcttaaactagatagctaattagttattttaagaaaaaagaaatttaaaaaaaagcctgctttatttgttagtgggctagaatacacaagacatacccacccatgaagagtttatgaattgtaacttattgacattatcataggaatttactaccagttaaagagggagaacggaggaagagaaaaatacttcagataaaggaaaaagttttcttctcacaaaaacacagacacgtgattgttttcacaggttccattaattaactcaggtctggaagacataggacaaaatggagtttctgaagaagtccaggtgaattcagctttggagtcacttatgttcattttttttccttttcttttactattatcctaaaggttatttttcttgttgatatagagatttttgtaaaagattgctacattatttcaggattatatcctacatttcgattgctctcaaatgttttatccctaaagagtgagttttccacagactgtttggaagcaactagaaaaatctttgtgaaaaatctgaacaaattatcataatggctctcttgaaattttgcactttcacccttattaaggaaattataattagttactaacctttaaaaatagatatattctaataggatagaaagttaacttcctggcaaacaaaatactaagatctcaggggctactgcaggaaaatacctttttcgcacattaaaatgtttataaaattttcccctctcatttcaaatgcatggcaggaataacatttttggtggtctttaatgtgatggacagatttactgtcacttattgattttatggaaaataaattggctatcttatttttataacaatcttatttttctcaaaacaaaaatcctaaccaaaaagttgtcattaaaaaaaaaaaattcaggtagactgaatgtttttctgctctaaccttaaatgttattaggtttggtttttgtttctaagctacttcaagactacctgaggtaataatggtaaactttattattcagaattcgattaaactaacttcagcatttccacagttctattaaacaatgactgatgttcacaatgacaacctacctgagatggctgcaaggccctaatgttccattatacattatagtcttttcagcatagtttagtgttgagtgcaattctaatgcattctacgtttttgaaaatcgataatccatggaaggtccatgggttgatacctcaggtcaaaaatgtgtttactctgttgattgctgtttcactttacttgtatatcagatatataagctatgaacacaagtttgtagtaaaagtatcttctgtctgggcaatggctcacacctgtaattccaacactttggggggctcaggtgggaggatttctagtccccaggagtttgagaccagcctgggcaataaactagaccccatgtctctaaaaaatgtaaaaaacatcaagaggctgagtcaggaggatcatttgagcttaggagttcaaggctgcagtaagttatgattgtgccactgcattccagcctgggtgacaagagtgagaccctgacccaaaaaagtatcttctgataaagtggcatttgaaaattgcagaaattttaatattttttcttttaatattaagaactttattgatctctctaggacaccttggtgaggaaattaatggcacttttcttgacatccaacctgggactctggtgattctgtgttctggtgaatttaagtttcagacatttctttgtgtcaccttttacaaggtgtttgcccttggtacgttatgaccaggtcaaaggttcccaaacacaaggctcattgtgtaccctggacaggaaattgaactgatgttgacatgtatgcatgcccaggaggaagactgggaaagatttaatgagttgaagtatgctgagaaacaatgaaatatttgaaaactgtctacataaaagttactgatgcacatgcattaaaaaaaaaaatgttgttgcaaatctaacactaaaaaatttttgactgggtgcagtggctcacacctgtaatcccagcactttgggaggctgaggcgggtagatcacaaggacaggagttcaagaccagcctggccaacatggtgaaaccccgtctctactaaaaatacaaaaattagccaggcatggttgcgggtgcctataatcccaactaccccggaggctgaggcagggaattgcttgaagcaaggaggggcaggttgcagtgagccaagattgtgccaccacactccagcctgggtaacagcaagactccgtctcaaaaaaaaaaaaaattcccaaataggaagatattttctaaggaagaataaaatgctggacccctatattcagactattagtcttaactggtagtttatgtatatattttaatactttgtcatcatgtacatatcttaagatttattatgtgaatatctgcatgtgtgttattaaggattacaaagttgtgctcacacaggacaaatggaaagattttcctacttctgtaaagataagtttcattatacttttgtcttacaattttattcttaggtcaatggttatttattataagttcagattgcacaattttcataagaccctttggatttagcacatgaaattaacacatattttaaagtattaaatacatggaaagcatctggcattatgcctgataataggcacttagtaaaatgtacttttctttgaatcaacatttgaattcttacagtcttgtcactagagacttaaaaggaccattgagtgcctatttttatacattcatcttttctcaatttgtcacattatctcattttaaataatgcaagtgaaagtgaattcatcatactatctcaacaccaatacaaaattattccaataaaaatatttttcttaataaaaccagaaaaactgaactaaatgctatttagccccgccaacaaagctttgtggaaaaatatatgaatatatgaaatgttctcaaatattttgaataaactgttcatgaagccttatattttgcaagtgtttttactgttgattttagaaagtttataaatcttaaatgtttgtatatttttcatttgcaataaaatgttatttaattatg

SEQ ID NO: 26268 - DNA, 3231 bp, Homo sapiens
tctcccttctgcacctccttcttaaactagatagcttaattagttattttaagaaggaggtgcagaaggaagaacaaagcacctccttcttaaactagatagctaattagttattttaagaaaaaagaaatttaaaaaaaagcctgctttatttgttagtgggctagaatacacaagacatacccacccatgaagagtttatgaattgtaacttattgacattatcataggaatttactaccagttaaagagggagaacggaggaagagaaaaatacttcagataaaggaaaaagttttcttctcacaaaaacacagacacgtgattgttttcacaggttccattaattaactcaggtctggaagacataggacaaaatggagtttctgaagaagtccaggtgaattcagctttggagtcacttatgttcattttttttccttttcttttactattatcctaaaggttatttttcttgttgatatagagatttttgtaaaagattgctacattatttcaggattatatcctacatttcgattgctctcaaatgttttatccctaaagagtgagttttccacagactgtttggaagcaactagaaaaatctttgtgaaaaatctgaacaaattatcataatggctctcttgaaattttgcactttcacccttattaaggaaattataattagttactaacctttaaaaatagatatattctaataggatagaaagttaacttcctggcaaacaaaatactaagatctcaggggctactgcaggaaaatacctttttcgcacattaaaatgtttataaaattttcccctctcatttcaaatgcatggcaggaataacatttttggtggtctttaatgtgatggacagatttactgtcacttattgattttatggaaaataaattggctatcttatttttataacaatcttatttttctcaaaacaaaaatcctaaccaaaaagttgtcattaaaaaaaaaaaattcaggtagactgaatgtttttctgctctaaccttaaatgttattaggtttggtttttgtttctaagctacttcaagactacctgaggtaataatggtaaactttattattcagaattcgattaaactaacttcagcatttccacagttctattaaacaatgactgatgttcacaatgacaacctacctgagatggctgcaaggccctaatgttccattatacattatagtcttttcagcatagtttagtgttgagtgcaattctaatgcattctacgtttttgaaaatcgataatccatggaaggtccatgggttgatacctcaggtcaaaaatgtgtttactctgttgattgctgtttcactttacttgtatatcagatatataagctatgaacacaagtttgtagtaaaagtatcttctgtctgggcaatggctcacacctgtaattccaacactttggggggctcaggtgggaggatttctagtccccaggagtttgagaccagcctgggcaataaactagaccccatgtctctaaaaaatgtaaaaaacatcaagaggctgagtcaggaggatcatttgagcttaggagttcaaggctgcagtaagttatgattgtgccactgcattccagcctgggtgacaagagtgagaccctgacccaaaaaagtatcttctgataaagtggcatttgaaaattgcagaaattttaatattttttcttttaatattaagaactttattgatctctctaggacaccttggtgaggaaattaatggcacttttcttgacatccaacctgggactctggtgattctgtgttctggtgaatttaagtttcagacatttctttgtgtcaccttttacaaggtgtttgcccttggtacgttatgaccaggtcaaaggttcccaaacacaaggctcattgtgtaccctggacaggaaattgaactgatgttgacatgtatgcatgcccaggaggaagactgggaaagatttaatgagttgaagtatgctgagaaacaatgaaatatttgaaaactgtctacataaaagttactgatgcacatgcattaaaaaaaaaaatgttgttgcaaatctaacactaaaaaatttttgactgggtgcagtggctcacacctgtaatcccagcactttgggaggctgaggcgggtagatcacaaggacaggagttcaagaccagcctggccaacatggtgaaaccccgtctctactaaaaatacaaaaattagccaggcatggttgcgggtgcctataatcccaactaccccggaggctgaggcagggaattgcttgaagcaaggaggggcaggttgcagtgagccaagattgtgccaccacactccagcctgggtaacagcaagactccgtctcaaaaaaaaaaaaaattcccaaataggaagatattttctaaggaagaataaaatgctggacccctatattcagactattagtcttaactggtagtttatgtatatattttaatactttgtcatcatgtacatatcttaagatttattatgtgaatatctgcatgtgtgttattaaggattacaaagttgtgctcacacaggacaaatggaaagattttcctacttctgtaaagataagtttcattatacttttgtcttacaattttattcttaggtcaatggttatttattataagttcagattgcacaattttcataagaccctttggatttagcacatgaaattaacacatattttaaagtattaaatacatggaaagcatctggcattatgcctgataataggcacttagtaaaatgtacttttctttgaatcaacatttgaattcttacagtcttgtcactagagacttaaaaggaccattgagtgcctatttttatacattcatcttttctcaatttgtcacattatctcattttaaataatgcaagtgaaagtgaattcatcatactatctcaacaccaatacaaaattattccaataaaaatatttttcttaataaaaccagaaaaactgaactaaatgctatttagccccgccaacaaagctttgtggaaaaatatatgaatatatgaaatgttctcaaatattttgaataaactgttcatgaagccttatattttgcaagtgtttttactgttgattttagaaagtttataaatcttaaatgtttgtatatttttcatttgcaataaaatgttatttaattatg

SEQ ID NO: 26269 - DNA, 2900 bp, Homo sapiens
gccacccgggagcctgaggtgggaggattgcttgagtctgcgaggttggggctgccgtgagcccagattgcgccattgtgctccagcctgggtgacaaagcaaggccctgtctcaaaaaagaagaagagaaagggccaggggcttttgctttaaaaaactttttttaaaacagaagtgaaaccacgggtgctttgttcttccttctgcacctccttcttaaactagatagctaattagttattttaagaaaaaagaaatttaaaaaaaagcctgctttatttgttagtgggctagaatacacaagacatacccacccatgaagagtttatgaattgtaacttattgacattatcataggaatttactaccagttaaagagggagaacggaggaagagaaaaatacttcagataaaggaaaaagttttcttctcacaaaaacacagacacgtgattgttttcacaggttccattaattaactcaggtctggaagacataggacaaaatggagtttctgaagaagtccaggtgaattcagctttggagtcacttatgttcattttttttccttttcttttactattatcctaaaggttatttttcttgttgatatagagatttttgtaaaagattgctacattatttcaggattatatcctacatttcgattgctctcaaatgttttatccctaaagagtgagttttccacagactgtttggaagcaactagaaaaatctttgtgaaaaatctgaacaaattatcataatggctctcttgaaattttgcactttcacccttattaaggaaattataattagttactaacctttaaaaatagatatattctaataggatagaaagttaacttcctggcaaacaaaatactaagatctcaggggctactgcaggaaaatacctttttcgcacattaaaatgtttataaaattttcccctctcatttcaaatgcatggcaggaataacatttttggtggtctttaatgtgatggacagatttactgtcacttattgattttatggaaaataaattggctatcttatttttataacaatcttatttttctcaaaacaaaaatcctaaccaaaaagttgtcattaaaaaaaaaaaattcaggtagactgaatgtttttctgctctaaccttaaatgttattaggtttggtttttgtttctaagctacttcaagactacctgaggtaataatggtaaactttattattcagaattcgattaaactaacttcagcatttccacagttctattaaacaatgactgatgttcacaatgacaacctacctgagatggctgcaaggccctaatgttccattatacattatagtcttttcagcatagtttagtgttgagtgcaattctaatgcattctacgtttttgaaaatcgataatccatggaaggtccatgggttgatacctcaggtcaaaaatgtgtttactctgttgattgctgtttcactttacttgtatatcagatatataagctatgaacacaagtttgtagtaaaagtatcttctgtctgggcaatggctcacacctgtaattccaacactttggggggctcaggtgggaggatttctagtccccaggagtttgagaccagcctgggcaataaactagaccccatgtctctaaaaaatgtaaaaaacatcaagaggctgagtcaggaggatcatttgagcttaggagttcaaggctgcagtaagttatgattgtgccactgcattccagcctgggtgacaagagtgagaccctgacccaaaaaagtatcttctgataaagtggcatttgaaaattgcagaaattttaatattttttcttttaatattaagaactttattgatctctctaggacaccttggtgaggaaattaatggcacttttcttgacatccaacctgggactctggtgattctgtgttctggtgaatttaagtttcagacatttctttgtgtcaccttttacaaggtgtttgcccttggtacgttatgaccaggtcaaaggttcccaaacacaaggctcattgtgtaccctggacaggaaattgaactgatgttgacatgtatgcatgcccaggaggaagactgggaaagatttaatgagttgaagtatgctgagaaacaatgaaatatttgaaaactgtctacataaaagttactgatgcacatgcattatttattatgtgaatatctgcatgtgtgttattaaggattacaaagttgtgctcacacaggacaaatggaaagattttcctacttctgtaaagataagtttcattatacttttgtcttacaattttattcttaggtcaatggttatttattataagttcagattgcacaattttcataagaccctttggatttagcacatgaaattaacacatattttaaagtattaaatacatggaaagcatctggcattatgcctgataataggcacttagtaaaatgtacttttctttgaatcaacatttgaattcttacagtcttgtcactagagacttaaaaggaccattgagtgcctatttttatacattcatcttttctcaatttgtcacattatctcattttaaataatgcaagtgaaagtgaattcatcatactatctcaacaccaatacaaaattattccaataaaaatatttttcttaataaaaccagaaaaactgaactaaatgctatttagccccgccaacaaagctttgtggaaaaatatatgaatatatgaaatgttctcaaatattttgaataaactgttcatgaagccttatattttgcaagtgtttttactgttgattttagaaagtttataaatcttaaatgtttgtatatttttcatttgcaataaaatgttatttaattatg

SEQ ID NO: 26270 - DNA, 433 bp, Homo sapiens
tcagcatataggaccatagcttatacagagcgatagtgtcaggggagatagaaagaagtggatggatttgggaaattttctggaagttgtcttgacagcactcagtgatggattggatgtaaagaatgtgggagaaaaaatgtcaaaaatgactccaagttttctagcttgagcactcccagaaggagagattagtggagatttagggacgagagctgagagttcagttcagggcatgtttatatttcagatgcttaaggagacatccaaatagagatgtcaggtgggcaactggagaaagaagttgggagctcaaaagcagctggattgctcttaatttgcctgcagtacgattttctgggttttgtttattggtttgtgtgttttttgagacggagtctcgctctttcgccaggatggagtgcagtggtgc

SEQ ID NO: 26271 - DNA, 488 bp, Homo sapiens
atcttctcaattcgcatgtttaatgcttaatttttaaataagacattgcttcacaactttgtgtttgaattgataatttgtgcaaatcaggaaaatacgtatttaattaggttgagccatatgagtttgctgatattcgaccattttgtaaaaacaggagtggcaatttcatatggttcaataaaataaaattgagaccgggcacagtggcttatgcctgtaatcccaacactttgggaggctgaggcaggaggatcacttgagctcaggagttcaagaccagactgggcaacatggcaaaaccctgtctctacagaaatacaaaaatgagccaggcatgatggcacatgcctgtagttctagctacttgggaggctgaggtgggaggattgcttgagcccaagaggcagaggttgcgatgagctgagatcatgccactgcaatccagtctgggcaacagaatgagaccctgcctcaaaaaaaaaaaa

SEQ ID NO: 26272 - DNA, 207 bp, Homo sapiens
aggaggtcaaggctgcagtgagccacgattgcaccactgcactccagcttgggagacagagctagactctgtctttaaaaaaaaaaaaaaaaactgccacctggtagaacatggttaattaagtggtagtaataagaattgttagaactcaaaagaataaactagctccacagggctgggttgacctgggaaagcttctcagaagaa

SEQ ID NO: 26273 - DNA, 141 bp, Homo sapiens
gtgtatctgcatggtgatgtctccgtgtgacagtgttttgtgtatctgtgtgacagtgtctgtgtgtccttgtgtccacatggcagtgtgtgtggtggtgtgacggtatggaggtgtgtccatgtgacagtgtggcagtgt

SEQ ID NO: 26274 - DNA, 821 bp, Homo sapiens
aggaaacatacaatcatgacagaagatgaaggggaagcaagcatatcttaccatggtgatggaggagagaaagaaggagtgagtggggagatgccacacacttttaaaccatcagatctcatgagaactccctgactatcacaagaggagcaagaaggaagtccactcccacgatttaatcacctctcaccaggcccctcctccaacactggggattacaatttgacatgatatttgggtggagacacagagccaaaccatatcagtgactgtagttaataatatatcgtatatttttaaattgctctaaaaattgaatttcaaatgttctcaccataaagacatgacaaatatgtgaagtgatgattattttaattagcctgatttgttaatgccacaatgtataaatgtataaaaatcacgttttaacccataaatacatgtaattgttatttgtcaattaaaaataaaaataaattgaaaactaaaaatagtaaagggagttccctccatgaaggatcaatgagtacatgccatagatttaattttgacagcaagaaacaagaaggttgcaacagtccaaacattgtgtgataaatggttgctcttaaaaatatttttatagtttgcctcaataagctaagacataagttataatctattaggtaggagtatattcattcagtggcttactgttatactcataaacagcttcatcctacttacccaaggttagttttcatgaagactgatcatctgaataaatttggttgcaaatactaattattgaaattaatggatacctactgtggatgtctatt

SEQ ID NO: 26275 - DNA, 795 bp, Homo sapiens
ggcgtgatctcagctcactgcaacctccgccttccaggttcaagtgattttccagcgtcagcctcccgagtagctgggattacaggcacccgctaccacacctggctaatttttgtatttttttttttttagtagagatggggtttcacccatgttggacaggctggtctcgaactcccgacctcaggtgatccgcctgcctgggcctcccaaattgttggggttacaggcgtgagccaccgtgcccagcctgcattctactttaatagctaggagacctccacagctattggttgaagtcagtcagagctgaaattgaacgtttaccttgggtatctgggcaactttgggcaagtgacaatccctctggggtttagtttcctctctaaaaaaggttgataacacattcaatcctgaacaacctgaaaacgaggcaaggtgaaaacacctggtccaatccataagtgatcaatacttgttacatcccctacttttttcttgtgtaatcagaaataccctttgcgtcgaggatcattcagcctaacccagttaatgaatgacatgttggtctctaggcaaccttcccattggccttgacatgtactttccccagcaggaggagccccttctgaatgtccagccttcctcattctgttagacccacctatagcttccttgtaagctaataaatcagcaacatggtttatcagtgtcctgaggttttgcttagcacaacctttggaatatggttatagtttggttgagtgaataaaactatgtctctaaacctgtaaa

SEQ ID NO: 26276 - DNA, 489 bp, Homo sapiens
gagccaagattgcagcactgcactccagcctgggcgacagagccagactccatctcaaaaaataaataaataaataaataattagctgggcgtagtggcatgtgcctgtagtcccagctaattggaggactgaggtgggaggattgtgtgagcccaggagtttgaggctgcagtgagtcgtgtttgtgccactgcactccagcctgggcgaccgagtgagaccctgtctcaaaaaagaaaaaagaaagaaatgaaagaaaagggaggcatcctgtatgacacacagacgagaagtgaaagagtaggcatgatttcggttctttttttgtttgttttttgagacagtttccctctgttacccaggctggaatgcagtggcgctatctcggctcactgcaacctccacctcccaggctcaagtgattctcatgcaccagctgctcaagaggctgaggtaggaggatcactttgagccaggagggttgaggg

SEQ ID NO: 26277 - DNA, 260 bp, Homo sapiens
gccgccctgtctggaaagtgaggagcacctctgcccagccccctcaccatttgtaagggaggagtgcctctgcccagcccctgcaccgtctgggaagtgaggagtgcccccacccggccccctcaccatctgggaagtgaggagggtctctgcctggctgctgtgcaaccttccaagtgtgaagtgacagccttgtgtgtgatctttctgccctccccaggtttgcattttcgacattaaagtttactttttaatttaaa

SEQ ID NO: 26278 - DNA, 888 bp, Homo sapiens
ttccttacgagcagaacatgttgtcttactacttgagtcatagcctgagatgtctggaaactgaatgtttctctttatgactcagtttcaccttttgctaggcataactccccaaaaggttgtactttgaaggcttccatgaagattgaaagataatactgtagactcttaacaacaaagacacaatcatatttttttaatgtgaatattcttaattttatagctgtggccagtggctgtcttgtgattttcatctggtttcatctacgtgtttctgtcccaacccaacaaaagtaaatattttccttttctttctcaagccccctttattgggtgaaactattattggggtgttgctctccattcttctttttttatcctctgctaacttttccactagcttcatctcttgcttcttactcgaaacacttcaaagttttcttctgatgagtgctaattggactatactcctcattttttctcatgcatcctggggagagtaacatttttctccccaagggaaaatgaaaacacgacagaagactgaagtagctattatgtaaacaagagaggaatcacagaacagacttcagtggcctttgtgcaaaaggaaagcggaagggagatgagcaattcaagtccagggcctggccacgtggactaccctttttcaaggatagcacggcatgagaaaaaaggagggcctgtctcagaggaagtgcatgtgggatggctgtgcatgtccttgttgttacagtcttcaggagactcgaggatgaatgagaaaagccctaaagaatctgtacctaagaatttgtgtaaattcaagagaatttacacaaattgaaatgaaatttattttttgaaataaataaatgggattctcaa

SEQ ID NO: 26279 - DNA, 465 bp, Homo sapiens
aaaaatgagctgggtatggtagcacacacttgtggtcccagctacttgggaggctgaggtgggggggttgcttgtgcctgggagtttgaggctgcaatgagctgtgattgtgccactgcactccagccctggataacagaatgagacccctgttcccaaaaataaaaaataaaatcaaagacacttaaaaagatggggaaaaggaaggacaggcacttaagcaagttataagctactttcctaactacacaagtggaatcttaagctgaggttcccaggagttgactggagccagagaagacagacctataggagcacccaactggagtcgccctccatagtagcccatatgtcttacatggatcagctttcgtggggcccttctactccgtctggggaagggcgtcagatctgtggctctcatgtactgctcagtacactgccattcccagttctttttttcaa

SEQ ID NO: 26280 - DNA, 419 bp, Homo sapiens
aaaaaaatgatgtagtctccaggcaataagcaaagtaacgtaggcttgaaggatagaagccgccaacccagaaggaaaagcaggccagggaccaagaagaaaaacaggctgagcaaatcgagtttgggttggttgaagtagggcctcccgggggagctgtccttcagaacctgggaatgtgggagctgcagtgactacagaggttgcttcctgatgacaaggtctgggccatttctgccaactctgcacctcgagcccaaccagcatggcagctggtgtggtctggagggattgctcgagtgggcactagggggatggggaggagaatggaaatctgatggtgaaagactgagtttaaaaatacatttctggctgggcatggtgcctcacgcctaatcccagcactttgggaggctgag

SEQ ID NO: 26281 - DNA, 521 bp, Homo sapiens
gtttcctcataaggtgagaacaaggctgtatctcagtgctctgggcctgctcacacatcctgctcatatgaatgtgagagccacaccagccctctgggaagtagtccctcaaacagcagcccagtgcagggggaaggatgcaaacactacaggcagatcagtttaatccacttttgggcagggtgaccttaggaaagcccatttccttctgcctcaattgtcacctctgtaaaatggaaacaataatatttatttccgtggctgtttggaggattacataaaataacaaatacagtggcattccatttttctgaggcaattatgttctataaagtcactgcaaacactgaattactggaatagtgagccattgctcttactggaaatacaggattaggttcctgaaaaatctctggtcacaacatctttgtcaactgatcaatacataaccatgatgtatgtgtgtttctttttaaaggtaccttatttaatatcattgttgattcattaatattaaactc

SEQ ID NO: 26282 - DNA, 227 bp, Homo sapiens
tttcaacagtttcattaggatatgccctactgtggttttattgtgcttattttgcttgattttctttgtgcttactaatttttggagctacctttacatgttgcattggtattttttatgttcatgttattacaagtaaaaaaggcagttaacccttataaatataattttacagtaataataacaacacaggaaactatcataatatctgtagtgggttaaagacg

SEQ ID NO: 26283 - DNA, 591 bp, Homo sapiens
  misc_feature (585)..(585): n is a, c, g, or t
  misc_feature (588)..(590): n is a, c, g, or t
gtgtatgtatgtatacatctatctatctaatcccaaaaatgttttaacctagcattaataatataagaaaaaatacatatggagggttgagtaggagctctgtgtgtatgtgtatgtcactatacataatgtgtgtgtgtgtgtgtgtgtgtgtgtgtgtagtatttaatgtaaatcttgaaaaggaatacctcattgacaaataactataacagaaatatgggagtagccacgacttcattgggaagctgaagagtaagttaaagattagccccattctagtcgcctcaggcacactgaacacttaaccagctggtcaaagttctaaattaggtttaaatttatacattctctgtctcctataatcattattgaaatttctcttaaacctattttatgttaagccaagaaactttccaagatgttcagatgttaaggacaaagtttcctgtttggtctcctagaaatatcatttctaacaaagggctataatgataccaaagcttgcaaaacatgtttcttatagaaattgtatgttagaatatttgctatggaaaattaaatttgttcaatttagccataaanaannna

SEQ ID NO: 26284 - DNA, 308 bp, Homo sapiens
atcgaaagccccagcaacttctcaggtggcagtcacgttgttgcgagggtaacctgaaaacagctgtcagctgggagtaggagccagggtttttttctcagtattcaccttcgggggctgttggagaagtaagcaaaacattttatgtaaacggtccagaagacttttgaaaaatatgccatgaatatttagaggttttatagctgtagcaaagtgagaggcatgttgtagaaacaggaaaatgaccttatgtaacccttattatgtttgcagcctggctataaggattagttggaagtcatccctga

SEQ ID NO: 26285 - DNA, 417 bp, Homo sapiens
tgcatcgacgcttctaaaacatgaggttctatgagattttgaatagtcataaatgatatatgtccactataagctacatttttgtagtttttaaattgtgaaataatttcccacacaaaagtattatgagtaccgtaaagaacacccaaatatctttactcaaattcccgttagcattttgccacgtttgccatatcatcttcttctccctcgcagtagataactttggccctgagactaagttgcagatgtgatgcaccttacccctaaatacatcagcatgtgcttcctaagaacaagggtgttctctttcatgaccacagtattcgctggaaaatgaattgggtttttttgaggcagggtcttgctcaccctggctggaatgcagtggtgcaatcacagcacactggtcgagcc

SEQ ID NO: 26286 - DNA, 372 bp, Homo sapiens
tgccagatatttgcacaatgtttctttaatgagaaatgtgctattttgcatttctaataacaatgtattaaaactgattttctactatatcctctactcatcagctcattctcatgcctctaatcccagcactttgggaggccaaggcgggcggatcatgaggtcaggagatcgagaccattctggctaacctggtgaaaccccgtctctactaaatatacaaaaaattagccaggtgtggtggcacacgcctgtaatcccagctactcgggaggctgaggcagaagaatcgcttgaatctggaaggtggaggttgcagaatctggtcgccactgcactccagcctgggtgacagagcaagactacatctca

SEQ ID NO: 26287 - DNA, 3636 bp, Homo sapiens
atggatccgccggcgggagccgctcgccgcctgctctgccccgcgctgctgctgctgctgctgctgctgccgccgccgctcctgccgccgccgccgccgcccgcgaacgccaggctcgccgccgccgccgaccccccaggcgggcccctggggcacggagcggagcgcatcctggcggtgcccgtgcgcactgacgcccagggccgcttggtgtcccacgtggtgtcggcagctacgtccagagcaggggtacgagcccgcagggccgccccggtccggaccccgagcttccccggaggcaacgaggaggagcctggcagtcacctcttctacaatgtcacggtctttggccgagacctgcacctgcggctgcggcccaacgcccgcctcgtggcgcccggggccactatggagtggcagggcgagaagggcaccacccgcgtggagcccctgctcgggagctgtctctacgtcggagacgtggccggcctagccgaagcctcctctgtggcgctcagcaactgcgatgggctggctggtctgatccggatggaggaggaggagttcttcatcgaacccttggagaaggggctggcggcgcaggaggctgagcaaggccgtgtgcatgtggtgtatcgccggccacccacgtcccctcctctcggggggccacaggccctggacacaggggcctccctggacagcctggacagcctcagccgcgccctgggcgtcctagaggagcacgccaacagctcgaggcggagggcacgcaggcatgctgcagacgatgactacaacatcgaggtcctgctgggcgtggatgactctgtggtgcagttccacgggaaggagcacgtacagaagtacctgctgacactcatgaacattgtcaatgaaatctaccatgacgagtccttgggtgcccacatcaacgtggtcctggtgcggatcatcctcctgagctatggaaagtccatgagcctcatcgagatcgggaacccctctcagagcctggagaatgtctgccgctgggcctacctccagcagaagccagacacgggccacgatgaataccacgatcacgccatcttcctcacacggcaggactttgggccttccggcatgcaaggctatgctcctgtcaccggcatgtgccatccggtccgcagctgcaccctgaaccatgaggacggcttctcctcagcgtttgtggtggcccatgagactggccacgtgctgggcatggagcacgacgggcagggcaaccgctgtggcgacgaggtgcggctgggcagcatcatggcgcccctggtgcaggccgccttccaccgcttccactggtcccgctgcagccagcaggagctgagccgctacctgcactcctatgactgcctgctggatgaccccttcgcccacgactggccggcgctgccccagctcccgggactgcactactccatgaacgagcaatgccgctttgacttcggcctgggctacatgatgtgcacggcgttccggacctttgacccctgcaagcagctgtggtgcagccatcctgacaacccctacttttgcaagaccaagaaggggccccccttggacgggactatgtgtgcacctggcaagcattgttttaaaggacactgcatctggctgacacctgacatcctcaaacgggacggcagctggggcgcttggagtccgtttggctcctgctcacgtacctgtggcacgggcgtgaagttcaggacccgccagtgtgacaacccacacccggccaacgggggccgcacctgctcgggccttgcctacgacttccagctctgcagccgccaggactgccccgactccctggctgacttccgcgaggagcagtgccgccagtgggacctgtacttcgagcacggcgacgcccagcaccactggctgccccacgagcaccgggatgccaaggagagatgccacctgtactgcgagtccagggagaccggggaggtggtgtccatgaagcgcatggtgcatgatgggacgcgctgctcctacaaggacgccttcagcctctgtgtgcgcggggactgcaggaaggtgggctgtgacggtgtgatcggctccagcaagcaggaagacaagtgtggcgtgtgcggaggggacaacagccactgcaaagtggtcaagggcacgttcacacggtcacccaagaagcatggttacatcaagatgtttgagatccctgcaggagccagacacctgctcattcaggaggtagacgccaccagccaccatctggccgtcaagaacctggagacaggcaagttcatcttaaatgaagagaatgacgtggatgccagttccaaaaccttcattgccatgggcgtggagtgggagtacagagacgaggacggccgggagacgctgcagaccatgggccccctccacggcaccatcaccgttctggtcatcccggtgggagacacccgggtctcactgacgtacaaatacatgatccatgaggactcactgaatgtcgatgacaacaacgtcctggaagaggactctgtggtctacgagtgggccctgaagaagtggtctccgtgctccaagccctgtggcggagggtcccagttcaccaagtatggctgccgccggaggctggaccacaagatggtacaccgtggcttctgtgccgccctctcgaagcccaaagccatccgcagagcgtgcaacccacaggaatgctcccagccagtgtgggtcacaggcgaatgggagccatgtagccagacctgtgggcggacaggcatgcaggtgcgctccgtgcgctgcattcagccgctacacgacaacaccacccgctccgtgcacgccaagcactgcaatgacgcccggcccgagagccgccgggcctgcagccgcgagctctgccctggtcgttggcgagccgggccctggtcccagtgctcagtaacctgtggcaacggcacccaggagcggccagtgccctgccgcaccgcggacgacagcttcggcatctgccaggaggagcgtcctgagacagcgaggacctgcaggcttggcccctgtccccgaaacatctcagatccctccaagaagagctacgtagttcagtggctgtcccgcccggaccccgactcgcccatccggaagatctcgtcaaagggccactgccaaggcgacaagtcaatattctgtaggatggaagtcttgtcccgctattgctccatcccaggctacaacaagctgtcctgcaagtcctgtaacctgtacaacaacctcaccaacgtggagggcaggatagagccaccgcctgggaagcacaacgacattgacgtgttcatgcctaccctcccagtgcccactgtagccatggaggtgcggccatcaccaagcacccccctggaggtccctctcaatgcctccagcaccaatgccacagaggatcacccagaaaccaatgccgtagatgaaccctacaaaatccatggcctggaagatgaagtccagccacccaacctaatccctcgacgaccgagcccctatgaaaagaccagaaaccaaagaatccaagagctcattgatgagatgcggaagaaagagatgctcggaaagttctaa

SEQ ID NO: 26288 - DNA, 1701 bp, Homo sapiens
atggatccgccggcgggagccgctcgccgcctgctctgccccgcgctgctgctgctgctgctgctgctgccgccgccgctcctgccgccgccgccgccgcccgcgaacgccaggctcgccgccgccgccgaccccccaggcgggcccctggggcacggagcggagcgcatcctggcggtgcccgtgcgcactgacgcccagggccgcttggtgtcccacgtggtgtcggcagctacgtccagagcaggggtacgagcccgcagggccgccccggtccggaccccgagcttccccggaggcaacgaggaggagcctggcagtcacctcttctacaatgtcacggtctttggccgagacctgcacctgcggctgcggcccaacgcccgcctcgtggcgcccggggccactatggagtggcagggcgagaagggcaccacccgcgtggagcccctgctcgggagctgtctctacgtcggagacgtggccggcctagccgaagcctcctctgtggcgctcagcaactgcgatgggctggctggtctgatccggatggaggaggaggagttcttcatcgaacccttggagaaggggctggcggcgcaggaggctgagcaaggccgtgtgcatgtggtgtatcgccggccacccacgtcccctcctctcggggggccacaggccctggacacaggggcctccctggacagcctggacagcctcagccgcgccctgggcgtcctagaggagcacgccaacagctcgaggcggagggcacgcaggcatgctgcagacgatgactacaacatcgaggtcctgctgggcgtggatgactctgtggtgcagttccacgggaaggagcacgtacagaagtacctgctgacactcatgaacattgtcaatgaaatctaccatgacgagtccttgggtgcccacatcaacgtggtcctggtgcggatcatcctcctgagctatggaaagtccatgagcctcatcgagatcgggaacccctctcagagcctggagaatgtctgccgctgggcctacctccagcagaagccagacacgggccacgatgaataccacgatcacgccatcttcctcacacggcaggactttgggccttccggcatgcaaggctatgctcctgtcaccggcatgtgccatccggtccgcagctgcaccctgaaccatgaggacggcttctcctcagcgtttgtggtggcccatgagactggccacgtgctgggcatggagcacgacgggcagggcaaccgctgtggcgacgaggtgcggctgggcagcatcatggcgcccctggtgcaggccgccttccaccgcttccactggtcccgctgcagccagcaggagctgagccgctacctgcactcctatgactgcctgctggatgaccccttcgcccacgactggccggcgctgccccagctcccgggactgcactactccatgaacgagcaatgccgctttgacttcggcctgggctacatgatgtgcacggcgttccggacctttgacccctgcaagcagctgtggtgcagccatcctgacaacccctacttttgcaagaccaagaaggggccccccttggacgggactatgtgtgcacctggcaagttcaggccgggcgcggtggctcatgcctgttatcccagcactttgggaggccaaggtaggtggatcgcctga

SEQ ID NO: 26289 - DNA, 488 bp, Homo sapiens
cgcaccgcctgccaccgccacccgagccgcgcgcgccgcgcctccgcacatgaggggccagagggccccccgccccccgggaaaacttataaatattcccacagatagacaaagtcaagcataaaactggagcttgagaaggaaatgaaaggccgtggcaccttcttataccctagaagaagacctccatacaggaagacttgtgtgtggggttgggacattagaatcatccacaagtcaccccaaaccttggaactgtcagggtcagaggggaaccaccatttattaagcatttgccatgtgccaggcactaacccagatgcattataaataccacgttgtttcacctgtgtgtggcatctacagaccttagatcatagctgtgagaacaacgtaagcactgccaaagttatcagctacccatatctcatgtttttgatgttatctactcttcctagaatcaaatattaaaataattttaaaaccaa

SEQ ID NO: 26290 - DNA, 603 bp, Homo sapiens
gctctgaaaaaatgacaatctgtgtctctgtcagtgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgggctcacttatggaaccttgggcattaggagcatgcacatttgttcatctcttgccaaagtttgacccactggttattctaaaggtctttagataaactcaaccaattgtcaaccagaaaaatttaaatctacctataagctggaagcccccgcttcaagttgccccacctttctggaccaaaccaatgtattttttaaatgtgtttgattgatgtcttatgtctccctaaaatgtataaaaccaaggtgcaccctgaccaatttgggcacgtgttctcaggacctcctgagggctctgtcatggccatggtcactcatgtttggctcagaataaatctcttcaaatgttttaca

SEQ ID NO: 26291 - DNA, 2533 bp, Homo sapiens
cacacaaattataaatactcaaggtgatggacaccccaagtatcctaacttgataattaccatatttgcgtgtaacaaaatgtcacttgtacccaatacatatgtacaaatattatgaaatgataaaaacttttagaaagtaaagtgcttggttgggaggctgaggcagatggatcacgaggtcaggagtccaagaccagcctggccaagatggtgaaaccccatctctactaaaaatacaaaaattggccaggcacggtggcaggcatctgtaatcccagctactcaagaggctgcggcaggagaatcacatgaacccggggggcggagtttgcagtgagccgagatcgtgcccctgcactctagcctgggtgacagagtgagactctgtctcaaaaaaaaaaaaaaaaaaaaagaaagaaagaaaaagaaaaaaagaaagtgaagtgcttggaacaaggcctagcacatagtaagtactatataatgtctattttgatgaggctggaaggattctatcctgctgtttggtatttgaatcagagtctgattcccgaccagaagaacagaggagggatttgagccaaaggacagagcccgtgtgccacagagttcgcagtgaaaataaagggaaaaagaaagacccctataaagccaggcttatagaaataggctcagatggggtctagtggactttgatgtgtgtgtaggaaaatattaaggtgggatgtgtggatcagtgtcctagcacattcccgcagggtgtaagcctggcactatcatacctctggtacgtacagaatacatcatacagaaaattatgggaaccactgagcagtgaggccatgggggatcccctgctgagaaaatcctgtgtgcccagctctgagctagccctgctgtatatgatttcattttatttaccgtaagttaaatttggcaattttatccccactttacagatgggaacactgaagtttggagaagttaacacattgtttagggttatggttttcagtctatttttctcttttctccccctgtatcttctttctccttatctgtctctattgttattggagtatgaggtgagcctagtctcaatcttttgtccacctgctcctccaataaatgacttcagagagagctgtaacctcattcatgtccccagttttctccttttcccttgacctggatcaccgggggtgcaaatgaggagatacaagggtgatggaagtcttaatgccaatttcacattattccaggagatgactacacactctaatcccttctctctggccttcatctttattgcaggtggtgaaggcatttgtggtcctggcctcgcagttcctgtcccatgacccagaacagctcaccaaggagctgcagcagcatgtgaagtcagtgacagccccatacaagtacccaagaaagatagagtttgtcttgaacctgcccaagactgtcacagggaaaattcaacgaaccaaacttcgagacaaggagtggaagatgtccggaaaagcccgtgcgcagtgagacatctaagagacattcatttggattcccctcttctttctctttcttttccctttgggcccttggccttcctatgatgatatgagattctttatggaagaacatgaatataagttttgtcttgccttggttattagcacaaaactttaccatgttagatgttgaaagaagaaagggaaggaatgagagagagtgaaaaggagagggtaacagaaaaaaaggaaagaaaagtaagtcagggaaatattaaaactgcaagggaaagcaattgaaaaagaaataaagtagggaaagaaggagagaggaagcaagggaaggaggaagaaaggaaagaggagatgaaagggggagaaaagatagaagaaaaataattgaagggagaatcagaaaaataaagagaagaaaggaaagaaataaagagagaaagagaaagaagaaagagcaaaagaacacaagaaagaaagagagggagaaagagagggagaaagggagagaaaaaaattgtaaaaataaaaatagtaaaagaaactgataaagaaaagtaatggaagacaggaagaaaagaagagaaggaagtaaagaggaaaacttataaatattcccacagatagacaaagtcaagcataaaactggagcttgagaaggaaatgaaaggccgtggcaccttcttataccctagaagaagacctccatacaggaagacttgtgtgtggggttgggacattagaatcatccacaagtcaccccaaaccttggaactgtcagggtcagaggggaaccaccatttattaagcatttgccatgtgccaggcactaacccagatgcattataaataccacgttgtttcacctgtgtgtggcatctacagaccttagatcatagctgtgagaacaacgtaagcactgccaaagttatcagctacccatatctcatgtttttgatgttatctactcttcctagaatcaaatattaaaataattttaaaaccaa

SEQ ID NO: 26292 - DNA, 2507 bp, Homo sapiens
gctctgaaaaaatgacaatctgtgtctctgtcagtgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgggctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacgggattaacttgcatggtttccaagacaatgaaaatcaaaccaggatacatgggaacggctgcttcctgttatgatgtacaggttatagatgataagggcaacgtcctgccccccggcacagaaggagacattggcatcagggtcaaacccatcaggcctataggcatcttctctggctatgtggaaaatcccgacaagacagcagccaacattcgaggagacttttggctccttggagaccggggaatcaaagatgaagatgggtatttccagtttatgggacgggcagatgatatcattaactccagcgggtaccggattggaccctcggaggtagagaatgcactgatgaagcaccctgctgtggttgagacggctgtgatcagcagcccagaccccgtccgaggagaggtggtgaaggcatttgtggtcctggcctcgcagttcctgtcccatgacccagaacagctcaccaaggagctgcagcagcatgtgaagtcagtgacagccccatacaagtacccaagaaagatagagtttgtcttgaacctgcccaagactgtcacagggaaaattcaacgaaccaaacttcgagacaaggagtggaagatgtccggaaaagcccgtgcgcagtgagacatctaagagacattcatttggattcccctcttctttctctttcttttccctttgggcccttggccttcctatgatgatatgagattctttatggaagaacatgaatataagttttgtcttgccttggttattagcacaaaactttaccatgttagatgttgaaagaagaaagggaaggaatgagagagagtgaaaaggagagggtaacagaaaaaaaggaaagaaaagtaagtcagggaaatattaaaactgcaagggaaagcaattgaaaaagaaataaagtagggaaagaaggagagaggaagcaagggaaggaggaagaaaggaaagaggagatgaaagggggagaaaagatagaagaaaaataattgaagggagaatcagaaaaataaagagaagaaaggaaagaaataaagagagaaagagaaagaagaaagagcaaaagaacacaagaaagaaagagagggagaaagagagggagaaagggagagaaaaaaattgtaaaaataaaaatagtaaaagaaactgataaagaaaagtaatggaagacaggaagaaaagaagagaaggaagtaaagaggaaaacttataaatattcccacagatagacaaagtcaagcataaaactggagcttgagaaggaaatgaaaggccgtggcaccttcttataccctagaagaagacctccatacaggaagacttgtgtgtggggttgggacattagaatcatccacaagtcaccccaaaccttggaactgtcagggtcagaggggaaccaccatttattaagcatttgccatgtgccaggcactaacccagatgcattataaataccacgttgtttcacctgtgtgtggcatctacagaccttagatcatagctgtgagaacaacgtaagcactgccaaagttatcagctacccatatctcatgtttttgatgttatctactcttcctagaatcaaatattaaaataattttaaaaccaaaaaaaaaaatacacaaaacaaaaaaacaaattttttggggccccttgggccccaaaaaatcttttaaaaaaacattgttggcgaccgggagccccacaaagaggatacagttgaaccaagtggtggacatgagggcgtgtccccggaggaggaaagcccagcgggacaaggaccaacaggggcgctgagagaagcgccgcgcccaatatgtaaaaacaaccccgcggggggaaaaaacggagagcgtcgtagaaaaaactcaccggaagagatctcgaggagccactaagacgagaggctacacaggaggggagccacaaagaggagctcgaaaagaataagcc

SEQ ID NO: 26293 - DNA, 2109 bp, Homo sapiens
gctctgaaaaaatgacaatctgtgtctctgtcagtgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgggctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacgggattaacttgcatggtttccaagacaatgaaaatcaaaccaggatacatgggaacggctgcttcctgttatgatgtacaggttatagatgataagggcaacgtcctgccccccggcacagaaggagacattggcatcagggtcaaacccatcaggcctataggcatcttctctggctatgtggaaaatcccgacaagacagcagccaacattcgaggagacttttggctccttggagaccggggaatcaaagatgaagatgggtatttccagtttatgggacgggcagatgatatcattaactccagcgggtaccggattggaccctcggaggtagagaatgcactgatgaagcaccctgctgtggttgagacggctgtgatcagcagcccagaccccgtccgaggagaggtggtgaaggcatttgtggtcctggcctcgcagttcctgtcccatgacccagaacagctcaccaaggagctgcagcagcatgtgaagtcagtgacagccccatacaagtacccaagaaagatagagtttgtcttgaacctgcccaagactgtcacagggaaaattcaacgaaccaaacttcgagacaaggagtggaagatgtccggaaaagcccgtgcgcagtgagacatctaagagacattcatttggattcccctcttctttctctttcttttccctttgggcccttggccttcctatgatgatatgagattctttatggaagaacatgaatataagttttgtcttgccttggttattagcacaaaactttaccatgttagatgttgaaagaagaaagggaaggaatgagagagagtgaaaaggagagggtaacagaaaaaaaggaaagaaaagtaagtcagggaaatattaaaactgcaagggaaagcaattgaaaaagaaataaagtagggaaagaaggagagaggaagcaagggaaggaggaagaaaggaaagaggagatgaaagggggagaaaagatagaagaaaaataattgaagggagaatcagaaaaataaagagaagaaaggaaagaaataaagagagaaagagaaagaagaaagagcaaaagaacacaagaaagaaagagagggagaaagagagggagaaagggagagaaaaaaattgtaaaaataaaaatagtaaaagaaactgataaagaaaagtaatggaagacaggaagaaaagaagagaaggaagtaaagaggaaaacttataaatattcccacagatagacaaagtcaagcataagaagacctccatacaggaagacttgtgtgtggggttgggacattagaatcatccacaagtcaccccaaaccttggaactgtcagggtcagaggggaaccaccatttattaagcatttgccatgtgccaggcactaacccagatgcattataaataccacgttgtttcacctgtgtgtggcatctacagaccttagatcatagctgtgagaacaacgtaagcactgccaaagttatcagctacccatatctcatgtttttgatgttatctactcttcctagaatcaaatattaaaataattttaaaaccaa

SEQ ID NO: 26294 - DNA, 1418 bp, Homo sapiens
taaagccagatgattggcagaggaggagctggggtccagagagtctgatgtcaaggctcagctggctgactgttgtgccatgtgtgtctgttatgctgctcctcctctgtctgaaaatatgtcaaatacctttatgcccaattctagccatcctcttattgtcctcatcccagagcaccttctgaagcttcttattgcacagggcggctaccctgaagtggctccagcctgaagaacttcccctcaccctacagcagttctgaaaaatgcaacccactgtcatcacagatcacccaccctggactgatttgtttttcaacagatagagtttgtcttgaacctgcccaagactgtcacagggaaaattcaacgaaccaaacttcgagacaaggagtggaagatgtccggaaaagcccgtgcgcagtgagacatctaagagacattcatttggattcccctcttctttctctttcttttccctttgggcccttggccttcctatgatgatatgagattctttatggaagaacatgaatataagttttgtcttgccttggttattagcacaaaactttaccatgttagatgttgaaagaagaaagggaaggaatgagagagagtgaaaaggagagggtaacagaaaaaaaggaaagaaaagtaagtcagggaaatattaaaactgcaagggaaagcaattgaaaaagaaataaagtagggaaagaaggagagaggaagcaagggaaggaggaagaaaggaaagaggagatgaaagggggagaaaagatagaagaaaaataattgaagggagaatcagaaaaataaagagaagaaaggaaagaaataaagagagaaagagaaagaagaaagagcaaaagaacacaagaaagaaagagagggagaaagagagggagaaagggagagaaaaaaattgtaaaaataaaaatagtaaaagaaactgataaagaaaagtaatggaagacaggaagaaaagaagagaaggaagtaaagaggaaaacttataaatattcccacagatagacaaagtcaagcataaaactggagcttgagaaggaaatgaaaggccgtggcaccttcttataccctagaagaagacctccatacaggaagacttgtgtgtggggttgggacattagaatcatccacaagtcaccccaaaccttggaactgtcagggtcagaggggaaccaccatttattaagcatttgccatgtgccaggcactaacccagatgcattataaataccacgttgtttcacctgtgtgtggcatctacagaccttagatcatagctgtgagaacaacgtaagcactgccaaagttatcagctacccatatctcatgtttttgatgttatctactcttcctagaatcaaatattaaaataattttaaaaccaa

SEQ ID NO: 26295 - DNA, 1973 bp, Homo sapiens
  misc_feature (1608)..(1608): n is a, c, g, or t
gctctgaaaaaatgacaatctgtgtctctgtcagtgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgggctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacgggattaacttgcatggtttccaagacaatgaaaatcaaaccaggatacatgggaacggctgcttcctgttatgatgtacaggttatagatgataagggcaacgtcctgccccccggcacagaaggagacattggcatcagggtcaaacccatcaggcctataggcatcttctctggctatgtggaaaatcccgacaagacagcagccaacattcgaggagacttttggctccttggagaccggggaatcaaagatgaagatgggtatttccagtttatgggacgggcagatgatatcattaactccagcgggtaccggattggaccctcggaggtagagaatgcactgatgaagcaccctgctgtggttgagacggctgtgatcagcagcccagaccccgtccgaggagaggtggtgaaggcatttgtggtcctggcctcgcagttcctgtcccatgacccagaacagctcaccaaggagctgcagcagcatgtgaagtcagtgacagccccatacaagtacccaagaaagatagagtttgtcttgaacctgcccaagactgtcacagggaaaattcaacgaaccaaacttcgagacaaggagtggaagatgtccggaaaagcccgtgcgcagtgagacatctaagagacattcatttggattcccctcttctttctctttcttttccctttgggcccttggccttcctatgatgatatgagattctttatggaagaacatgaatataagttttgtcttgccttggttattagcacaaaactttaccatgttagatgttgaaagaagaaagggaaggaatgagagagagtgaaaaggagagggtaacagaaaaaaaggaaagaaaagtaagtcagggaaatattaaaactgcaagggaaagcaattgaaaaagaaataaagtagggaaagaaggagagaggaagcaagggaaggaggaagaaaggaaagaggagatgaaagggggagaaaagatagaagaaaaataattgaagggagaatcagaaaaataaagagaagaaaggaaagaaataaaaaaaaaaaaaaaacttgnggccttgtatccagaaggtccgaagctctgtgggacctctctggtggcccgaggggtgaggacagggagtaagaaggtcaggcggattctgtgcccacagagcaggagaggtgccagatatgtccatttaccatgttgcttgggccccgtagcccacgggtctggggatgccataatagcccccaccgttgggcctagggctgcagcaggtactcggcctctgggaggcttacctcgcccgcccttgggcccccacattagacctccctttctgcagcctaacttggaaccttggcctgcggattttggggccctgttgacggggctgggatgaccccgggggggggttcattccagaccccctt

SEQ ID NO: 26296 - DNA, 1624 bp, Homo sapiens
cacacaaattataaatactcaaggtgatggacaccccaagtatcctaacttgataattaccatatttgcgtgtaacaaaatgtcacttgtacccaatacatatgtacaaatattatgaaatgataaaaacttttagaaagtaaagtgcttggttgggaggctgaggcagatggatcacgaggtcaggagtccaagaccagcctggccaagatggtgaaaccccatctctactaaaaatacaaaaattggccaggcacggtggcaggcatctgtaatcccagctactcaagaggctgcggcaggagaatcacatgaacccggggggcggagtttgcagtgagccgagatcgtgcccctgcactctagcctgggtgacagagtgagactctgtctcaaaaaaaaaaaaaaaaaaaaagaaagaaagaaaaagaaaaaaagaaagtgaagtgcttggaacaaggcctagcacatagtaagtactatataatgtctattttgatgaggctggaaggattctatcctgctgtttggtatttgaatcagagtctgattcccgaccagaagaacagaggagggatttgagccaaaggacagagcccgtgtgccacagagttcgcagtgaaaataaagggaaaaagaaagacccctataaagccaggcttatagaaataggctcagatggggtctagtggactttgatgtgtgtgtaggaaaatattaaggtgggatgtgtggatcagtgtcctagcacattcccgcagggtgtaagcctggcactatcatacctctggtacgtacagaatacatcatacagaaaattatgggaaccactgagcagtgaggccatgggggatcccctgctgagaaaatcctgtgtgcccagctctgagctagccctgctgtatatgatttcattttatttaccgtaagttaaatttggcaattttatccccactttacagatgggaacactgaagtttggagaaaagatagaagaaaaataattgaagggagaatcagaaaaataaagagaagaaaggaaagaaataaagagagaaagagaaagaagaaagagcaaaagaacacaagaaagaaagagagggagaaagagagggagaaagggagagaaaaaaattgtaaaaataaaaatagtaaaagaaactgataaagaaaagtaatggaagacaggaagaaaagaagagaaggaagtaaagaggaaaacttataaatattcccacagatagacaaagtcaagcataaaactggagcttgagaaggaaatgaaaggccgtggcaccttcttataccctagaagaagacctccatacaggaagacttgtgtgtggggttgggacattagaatcatccacaagtcaccccaaaccttggaactgtcagggtcagaggggaaccaccatttattaagcatttgccatgtgccaggcactaacccagatgcattataaataccacgttgtttcacctgtgtgtggcatctacagaccttagatcatagctgtgagaacaacgtaagcactgccaaagttatcagctacccatatctcatgtttttgatgttatctactcttcctagaatcaaatattaaaataattttaaaaccaa

SEQ ID NO: 26297 - DNA, 1134 bp, Homo sapiens
gctctgaaaaaatgacaatctgtgtctctgtcagtgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgggctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacgggattaacttgcatggtttccaagacaatgaaaatcaaaccaggatacatgggaacggctgcttcctgttatgatgtacaggttatagatgataagggcaacgtcctgccccccggcacagaaggagacattggcatcagggtcaaacccatcaggcctataggcatcttctctggctatgtggtatcatccccatgatctatgccgttgatcttctttagagccatgccaggcactttacgttgagacttcaccatctagttggaggaatccctatcttcagatcttgggaaggtaaagacagataatccttgaatctggccacctcacttgacaggtgaggatggtggagccagagattacaagacttgctcaagctcacaaccattagaaagtggacagagaagaccccaagggcatgccttctgatccctgagagaattgattaataaactaaataaataataaatcaaataataatagtttctaccatttattgaatgcataccatgaggcaagcattgtcctataaacacatttaatctttaaactttaaactcatttaaactttaaactcgtttaatcctcccagccaccc

SEQ ID NO: 26298 - DNA, 763 bp, Homo sapiens
gctctgaaaaaatgacaatctgtgtctctgtcagtgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgggctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacggtacctgttcccaggggaaccatgggctgggtgcactttttgggcttcaaaattctctttgacaataaaaattgttagccaccatgtatcattcatctattcgagaagtatttattgagcctctatgaagggacaggtactgagtattgagaaattccgcacagaacaaaaaaggcaaaggtcctgttttctgggagattacattccagtgagaattggggagagag

SEQ ID NO: 26299 - DNA, 447 bp, Homo sapiens
gatgttgctacagcaggatctttccaggtgatggggctttgaggattggtaagagagtctggccccatccccctgactccctcacatacattcatgcctatctatctgaatctctcgcacacagagagccccatgaagccatttgcatcatcaaagcacccagaaacccagtctagtcctgagtggactttggttccagggaggctgagggcaaacatttatttctcttcttcagttacaagttcccccatctacagaactgcgtcactgtaggggagtcccttcttccagaaactctggagaactggagggcccagacaggactggacatccgagaatcctatggccagacagaaacggtacctgttcccaggggaaccatgggctgggtgcactttttgggcttcaaaattctctttgacaataaaaattgttagccaccatgta

SEQ ID NO: 26300 - DNA, 2163 bp, Homo sapiens
gctctgaaaaaatgacaatctgtgtctctgtcagtgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgggctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacgggattaacttgcatggtttccaagacaatgaaaatcaaaccaggatacatgggaacggctgcttcctgttatgatgtacaggttatagatgataagggcaacgtcctgccccccggcacagaaggagacattggcatcagggtcaaacccatcaggcctataggcatcttctctggctatgtggaaaatcccgacaagacagcagccaacattcgaggagacttttggctccttggagaccggggaatcaaagatgaagatgggtatttccagtttatgggacgggcagatgatatcattaactccagcgggtaccggattggaccctcggaggtagagaatgcactgatgaagcaccctgctgtggttgagacggctgtgatcagcagcccagaccccgtccgaggagaggtggtgaaggcatttgtggtcctggcctcgcagttcctgtcccatgacccagaacagctcaccaaggagctgcagcagcatgtgaagtcagtgacagccccatacaagtacccaagaaagatagagtttgtcttgaacctgcccaagactgtcacagggaaaattcaacgaaccaaacttcgagacaaggagtggaagatgtccggaaaagcccgtgcgcagtgagacatctaagagacattcatttggattcccctcttctttctctttcttttccctttgggcccttggccttcctatgatgatatgagattctttatggaagaacatgaatataagttttgtcttgccttggttattagcacaaaactttaccatgttagatgttgaaagaagaaagggaaggaatgagagagagtgaaaaggagagggtaacagaaaaaaaggaaagaaaagtaagtcagggaaatattaaaactgcaagggaaagcaattgaaaaagaaataaagtagggaaagaaggagagaggaagcaagggaaggaggaagaaaggaaagaggagatgaaagggggagaaaagatagaagaaaaataattgaagggagaatcagaaaaataaagagaagaaaggaaagaaataaagagagaaagagaaagaagaaagagcaaaagaacacaagaaagaaagagagggagaaagagagggagaaagggagagaaaaaaattgtaaaaataaaaatagtaaaagaaactgataaagaaaagtaatggaagacaggaagaaaagaagagaaggaagtaaagaggaaaacttataaatattcccacagatagacaaagtcaagcataaaactggagcttgagaaggaaatgaaaggccgtggcaccttcttataccctagaagaagacctccatacaggaagacttgtgtgtggggttgggacattagaatcatccacaagtcaccccaaaccttggaactgtcagggtcagaggggaaccaccatttattaagcatttgccatgtgccaggcactaacccagatgcattataaataccacgttgtttcacctgtgtgtggcatctacagaccttagatcatagctgtgagaacaacgtaagcactgccaaagttatcagctacccatatctcatgtttttgatgttatctactcttcctagaatcaaatattaaaataattttaaaaccaa

SEQ ID NO: 26301 - DNA, 1803 bp, Homo sapiens
gctctgaaaaaatgacaatctgtgtctctgtcagtgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgggctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacgggattaacttgcatggtttccaagacaatgaaaatcaaaccaggatacatgggaacggctgcttcctgttatgatgtacaggttatagatgataagggcaacgtcctgccccccggcacagaaggagacattggcatcagggtcaaacccatcaggcctataggcatcttctctggctatgtggaaaatcccgacaagacagcagccaacattcgaggagacttttggctccttggagaccggggaatcaaagatgaagatgggtatttccagtttatgggacgggcagatgatatcattaactccagcgggtaccggattggaccctcggaggtagagaatgcactgatgaagcaccctgctgtggttgagacggctgtgatcagcagcccagaccccgtccgaggagaggtggtgaaggcatttgtggtcctggcctcgcagttcctgtcccatgacccagaacagctcaccaaggagctgcagcagcatgtgaagtcagtgacagccccatacaagtacccaagaaagatagagtttgtcttgaacctgcccaagactgtcacagggaaaattcaacgaaccaaacttcgagacaaggagtggaagatgtccggaaaagcccgtgcgcagtgagacatctaagagacattcatttggattcccctcttctttctctttcttttccctttgggcccttggccttcctatgatgatatgagattctttatggaagaacatgaatataagttttgtcttgccttggttattagcacaaaactttaccatgttagatgttgaaagaagaaagggaaggaatgagagagagtgaaaaggagagggtaacagaaaaaaaggaaagaaaagtaagtcagggaaatattaaaactgcaagggaaagcaattgaaaaagaaataaagtagggaaagaaggagagaggaagcaagggaaggaggaagaaaggaaagaggagatgaaagggggagaaaagatagaagaaaaataattgaagggagaatcagaaaaataaagagaagaaaggaaagaaataaagagagaaagagaaagaagaaagagcaaaagaacacaagaaagaaagagagggagaaagagagggagaaagggagagaaaaaaattgtaaaaataaaaatagtaaaagaaactgataaagaaaagtaatggaagacaggaagaaaagatagaagaaaaataattgaagggagaatcagaaaaataaagagaagaaaggaaagaaataaagagag

SEQ ID NO: 26302 - DNA, 1468 bp, Homo sapiens
gctctgaaaaaatgacaatctgtgtctctgtcagtgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgggctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacgggattaacttgcatggtttccaagacaatgaaaatcaaaccaggatacatgggaacggctgcttcctgttatgatgtacaggttatagatgataagggcaacgtcctgccccccggcacagaaggagacattggcatcagggtcaaacccatcaggcctataggcatcttctctggctatgtggtgagaaactgtgctcctcctcctctgttccccagtgaggatgggagcactaaacgggatgagggaggccaaatgttctgaaacttccaagaggcactagatgtggagacaaagactgtccagttttcaagaatgtatgctttgccagtggaagaaaagtggctattcagccttgccatcctcagcctatcactgtgatctcattggaagacttatttttcttcagttagcccttagactcctcaagaactctctgtttcatgcccaaaatattattgaccctgaactatacacagcaccattcccccaagggctgcctttccctctcccctaggtatcatccccatgatctatgccgttgatcttctttagagccatgccaggcactttacgttgagacttcaccatctagttggaggaatccctatcttcagatcttgggaaggtaaagacagataatccttgaatctggccacctcacttgacaggtgaggatggtggagccagagattacaagacttgctcaagctcacaaccattagaaagtggacagagaagaccccaagggcatgccttctgatccctgagagaattgattaataaactaaataaataataaatcaaataataatagtttctaccatttattgaatgcataccatgaggcaagcattgtcctataaacacatttaatctttaaactttaaactcatttaaactttaaactcgtttaatcctcccagccaccc

SEQ ID NO: 26303 - DNA, 815 bp, Homo sapiens
gcggatggcttcaggcgcatcacgacaccggcgcgtcacgcgacccgccctacgggcacctcccgcgcttttcttagcgccgcagacggtggccgagcgggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtgctccgtatgtggatgtgatctgtttgaacagctactactcttggtatcacgactacgggcacctggagttgattcagctgcagctggccacccagtttgagaactggtataagaagtatcagaagcccattattcagagcgagtatggagcagaaacgattgcaggttttcaccaggatccacctctgatgttcactgaaggagtaccagaaaagtctgctagagcaggtaccatctgggtctggatcaaaaaccgccggaaaatatgtggttggggagctcatttggaatttgccgatttcatgc

SEQ ID NO: 26304 - DNA, 860 bp, Homo sapiens
  misc_feature (777)..(777): n is a, c, g, or t
gcgatctcggggcagggccgggaggcgcccgaaagcccggcggtgggagtaggggagcccgggccccccgcagacttcttcccctgggcgtctccgagctggggcccgcaggaggttaaagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtgtgggtgaatggggtcgacacgctagagcatgaggggggctacctccccttcgaggccgacatcagcaacctggtccaggtatcccaagggttactttgtccagaacacatattttgactttttcaactacgctggactgcagcggtctgtacttctgtacacgacacccaccacctacatcgatgacatcaccgtcaccaccagcgtggagcaagacagtgggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcatcggaggtgcagctgactgccaagacgtcactggggcctgtgtctgacttctacacactccctgtgngatccggacttgtgctgtcaccaagaagcagttcctcatcaattgggaaaccttctatttttcccgtgtcccaaagcatgagg

SEQ ID NO: 26305 - DNA, 422 bp, Homo sapiens
gcgatctcggggcagggccgggaggcgcccgaaagcccggcggtgggagtaggggagcccgggccccccgcagacttcttcccctgggcgtctccgagctggggcccgcaggaggttaaaggtcaacgggcttgggggcgccggcttgggggacgggggaacaggagcaccctggagggccggggcggattaggcaggaggagaaaaggctcttgccgagccctttcccgaggtaaaggctgagtctgtgcagtatccttcctttcaatatttatttttaatttttaaaaatttttttgagactgggtttgcacctgtttcccaggctggggcggagtggcgccagcctaacttctgagctcaagcgattctcccgccccagccttgcaatttagggggtgccaacacgcctggctaattga

SEQ ID NO: 26306 - DNA, 1168 bp, Homo sapiens
  misc_feature (1085)..(1085): n is a, c, g, or t
gcggatggcttcaggcgcatcacgacaccggcgcgtcacgcgacccgccctacgggcacctcccgcgcttttcttagcgccgcagacggtggccgagcgggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtgtgggtgaatggggtcgacacgctagagcatgaggggggctacctccccttcgaggccgacatcagcaacctggtccaggtggggcccctgcctcccggctccgaatcactatcgccatcaacaacacactcacccccaccaccctgccaccagggaccatccaatacctgactgacacctccaagtatcccaagggttactttgtccagaacacatattttgactttttcaactacgctggactgcagcggtctgtacttctgtacacgacacccaccacctacatcgatgacatcaccgtcaccaccagcgtggagcaagacagtgggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcatcggaggtgcagctgactgccaagacgtcactggggcctgtgtctgacttctacacactccctgtgngatccggacttgtgctgtcaccaagaagcagttcctcatcaattgggaaaccttctatttttcccgtgtcccaaagcatgagg

SEQ ID NO: 26307 - DNA, 984 bp, Homo sapiens
  misc_feature (901)..(901): n is a, c, g, or t
gcggatggcttcaggcgcatcacgacaccggcgcgtcacgcgacccgccctacgggcacctcccgcgcttttcttagcgccgcagacggtggccgagcgggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtggtatcccaagggttactttgtccagaacacatattttgactttttcaactacgctggactgcagcggtctgtacttctgtacacgacacccaccacctacatcgatgacatcaccgtcaccaccagcgtggagcaagacagtgggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcatcggaggtgcagctgactgccaagacgtcactggggcctgtgtctgacttctacacactccctgtgngatccggacttgtgctgtcaccaagaagcagttcctcatcaattgggaaaccttctatttttcccgtgtcccaaagcatgagg

SEQ ID NO: 26308 - DNA, 1062 bp, Homo sapiens
  misc_feature (979)..(979): n is a, c, g, or t
gcggatggcttcaggcgcatcacgacaccggcgcgtcacgcgacccgccctacgggcacctcccgcgcttttcttagcgccgcagacggtggccgagcgggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtgtgggtgaatggggtcgacacgctagagcatgaggggggctacctccccttcgaggccgacatcagcaacctggtccaggtatcccaagggttactttgtccagaacacatattttgactttttcaactacgctggactgcagcggtctgtacttctgtacacgacacccaccacctacatcgatgacatcaccgtcaccaccagcgtggagcaagacagtgggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcatcggaggtgcagctgactgccaagacgtcactggggcctgtgtctgacttctacacactccctgtgngatccggacttgtgctgtcaccaagaagcagttcctcatcaattgggaaaccttctatttttcccgtgtcccaaagcatgagg

SEQ ID NO: 26309 - DNA, 591 bp, Homo sapiens
tatcccaagggttactttgtccagaacacatattttgactttttcaactacgctggactgcagcggtctgtacttctgtacacgacacccaccacctacatcgatgacatcaccgtcaccaccagcgtggagcaagacagtggtgagggcttctggtaggatcctctcagcggggcccagggtggctctgtttgttccctgtttggaaagctctcccaggaaaaaggtgctcccagcatctctacaccctcacagattcccttccacctatgaagctaaaattcagcctgtgtgagcggatacgggctcccaaaatcacccgtgtggttgacctcgctaggagaagaggggtctggcctaacgtcacacagctcggggtggcaatcctgtcccttctctatggtgctactctcactccatctccccttgctacacatcgtgctcaaggaacaggcagcttcggtggggggggcgccgggcatggtggcttatgcctgtcatccagcactttgcaaggaggccctggtataaggatcacttgaggccagtagttcaagagcagcctgggcaacatagtgaggccatcaccac

SEQ ID NO: 26310 - DNA, 437 bp, Homo sapiens
agtcttcaactcatctctcttcactcctccccaacagcttcttatccaccaaaacatctgcacacaagactgactgaactactttcagtttctttgatggcccatgttctctctgtttcccctgccacatcctctcaattctccaaccccatcccatatatccctgcacctggataatgtttacgcattcttcaggctctggaaagccttcctgccaaacacacacacatacatacacacacacacacacacgcatgtgtgcgcatggctcaggtcatgccacgcttcctccatagcatcctctacatccccggcacagtgcttatctcctttggtgtaaatgatatcatctattttcctcaatagactctaagcaagctctgtatgtacatggaccaagacagccctgctcacagttatatccctggaatctagta

SEQ ID NO: 26311 - DNA, 749 bp, Homo sapiens
agccgaggtgggtgggtcacttgaggtcaggagttcgagaccagcctggccaacgtggtgaaaccccatcactactaaaaatacaaaaaatagccaggcatcatggtgcgtgcttgtattcccagctactcggaaagctgaggcaggagaattgcttgaactcgggaggcggaggttgcaatgagccaagattgcaccactgcactccagcctgggcgacagagtgactccacctcaaagaaagaagaacgttttagacctggcccaccagagatctacttcctatttcttcagtgatcaagaagctgctggggtcgggtactggctccaggattactccagtattgtattacagcaggagtaagggggtataaaggaagatagcgagctagtgtttgtattcttgatgaaataaagatgtcatagaaatcaacaataagaaaaagaccaatagaaaaaaaatacaaaagtagtaaagtatatgtacaaaagatgaacaataggatgatgattgctgacttttattgagttttactctgcatccaggaactaagtacttaatatgtactaactcactcactcctttcaataaccttataaagtagaaagtatcctaatactcattttacagatgagaaaacagacaaagggaggttaaatatcttgctcaaggtcagagctattgagaggtgggcatttatgcctaaactcatggaccacagtagacctgaaaaaagaaaattagatga

SEQ ID NO: 26312 - DNA, 337 bp, Homo sapiens
attttgttttcttttcccatacagtcatactgtgcttttttccccttttaaaacatcacatttaattatccttgaataacctcatagattttaatgcattagagacatttttaaaaaacaagcattggattgttcactgtaagtcttgttacatcttagattgatggcttaaacttccaagacttgaaaaatagtgaaaaaaatttactagaaaaatattttgcatatatatttagggcaataataataaatacaataattcattttttaaaaatgattgagtctaaagataagtaacacaagttccctttaatttcctaatatttgttcttccttc

SEQ ID NO: 26313 - DNA, 701 bp, Homo sapiens
tactcatcctccctatgcatccctaaaatgtcagcacctcactggtctgtgctttttgcccaatgggttcaatgcctaatcagaaaaatatctgtatacaatgtacagtagtttggggttaagagcatgcattctggggacagacccatgcctggttctgaaccccaactctcacttgggcacattatttagcatctctgtactaaagtttcttcatctgtgaagtagaataataatagcacctacctatgctattattggagttgtcatgagggttgaagaaaggaatatacatactgcacctagcacagtgtttggcacacaggaagtatatgtaaaattcaagctggtatcagccaggcgcagtggctcacacctggctaacacagtgaaaccccgtctccagcctgggcaacagagcgagactctgtctcaaaaaaaaaaaaaaaaaaaaaaattcaagctggtatcattgtagtgaatgggatagttttgtatctaagaacacgtgtgttcttcacagtagccctgtaaggcaaatgttttacagaggcaagtgtatcgattggcagatgtgagaaccaagctaggacaagtgcttgggaactgcatagcaaagagacagactgcctcaaaacaggagaatgtttttggtgcttagaaacccattcctggccgggcgtggtggctcacgcctgtaa

SEQ ID NO: 26314 - DNA, 355 bp, Homo sapiens
tttggttttggtgagtgaagttgtgtagatataactcattctccttccttgccttctctgtattatcagtgttctaacccatcctggacttatctcagctttatcctttcctttattcccgttccttttgactgtagaccatgataactcatttgtgacagattgacattttgggatgggtaattctttcttgttggaggactggagtctatatagtaggatgctgagcatcatttctgtcttctacctacatcacatcatgctggtagtagcctcctctttccagttgtgacaatcagatgtctttagaagttgtcaaatttcccttaagaggcaaaaattgcccccggtttaa

SEQ ID NO: 26315 - DNA, 488 bp, Homo sapiens
aatcagaagctaaaacacccagaggctgctgcaaacctgtctctaaaacctgcagtaacccaagcccacaccctaatactaccatttatgaaacacactcaggctgcccagccataacccttccttagtcctttcctttacctacccgattgggcgctgtctcactcagctgagagtcactatttttcatcactaaaggagtcagaggccgggcgtgcgtggctcacgcctgtaatcccagcactttgggaggccgaggtgggtggatcgcgaggtcaggagatcgagatcatcctggctaacatggtgaaaccccgtttctactaaaaatacaaaaaattagccaggcgtggtggcgggtgcctgtagtgccagctactccggaggctaaggtgggagaatggcgtgaatccaggaggtggagcttgcagtgagccgagattgcgccactgcactccagcctgggccacagagcaagatccgtctca

SEQ ID NO: 26316 - DNA, 436 bp, Homo sapiens
ttcaaatacttgatggatacatgtggctagtggctaacataagggatagcacagatataaaacatttgctcgtcatataaagttctattggatagtgctggtctgtagcttataggatggtatcttagtctgcttcagctgctaaaacagaataccataaattaggtagcttaaacagtagatattttgaccaggcgtggtggcttatgcctgtattcccaaagtgctgggattacaggcatgagccaccgcgccgggcctatcatatgaattttgagggaacacaaacatgcagtctgtagcagatggtaataggctgacatattacacttgttgatgtaaatctgataggtttctttctctccaaggacagctttttaaatatttaacagtatcaataatttttcaggttctgtgagaattttataatttataa

SEQ ID NO: 26317 - DNA, 445 bp, Homo sapiens
agtgagctgagatcataccactgtactccagcctgggtgatagagcaagactctgtctcaaaataataataataaataaataaatggcatgcataagtatttattgctatgaattagtggctgatcaacagcattatttgtgttttcattaaatctaggtggcactgtattttctttttggttatataggtgagaggtttctatgttgcccaggctggcctcaaacgcctagcctcgcctccttatgtgcaaggacaacagttctgagccaccgcagctcccggtggcactgtattttcaaatgcaagtttagtgggggtagtttgagatcttctgttcgtttgttgaccaaagaaaatttaagtttcatttttgaaatctctacttgtgttacagattggagacttataagaccataaaatatgaagccttctaatagatagtt

SEQ ID NO: 26318 - DNA, 438 bp, Homo sapiens
gtctacttcctctgtttatttttcccctaccacccactactgtttctctttgacacacagcctcttcttattgcagaatctcagaggagcaaacactaggcccttttcacagaatcagtttaatatagactagtatgaatgatgattcatactattcaaagaactattaatgaaaactttctatatctggtggttcatgggttaaactcagttgtcacccgacatctccaaactgatttttgacctggatttgttccttacatatatgaccatctccttccattaactcaggttaagcagaagctaaaacagaatagagtaaaccaggggtagaggaccaatctgattaaatctaacaatttgtacatctgtgcctgactttcatcacttcttatgattgcgtataaagtacctgctgttgaatgagggattaagccc

SEQ ID NO: 26319 - DNA, 602 bp, Homo sapiens
atgagcatcacggacgtgctcagtgctgatgacattgcagcagcgctccaggaatgccaagacccagacacttttgaaccccaaaaattcttccagacgtcaggcctctccaagatgtcagccagtcaggtgaaggatgttttccggttcatagacaacgaccagagcgggtatctggatgaagaagagcttaagtttttcctccagaagtttgagagtggtgccagagaactgaccgagtcagaaaccaagtccttgatggctgcggcggataatgatggagatgggaaaattggagcagaggaattccaggaaatggtgcattcttaaaagccccagtctctggagaaaagagagaaagggataatcacctggaaggattccaaagccctgggaatggggaaccccacatcccatccctacctaatttgttaattttccctgaaaaccttctgcagtttgctcattgttttagcgaggtcacgagagagtcactcatgactttcttggtggtgggtatatgccctgacaacttctgtaagccccccttcccccaacaggcaatgcctctaaaaatcacccaataaagacaggcttctcaa

SEQ ID NO: 26320 - DNA, 119 bp, Homo sapiens
ctcaaggattggagaaattgaagctaaacaggggattacacaacatgaacaaaatggaaagagcataaatgaaatcttggatttaaaagcagagaattaaagaaaatcaaaccaaagag

SEQ ID NO: 26321 - DNA, 584 bp, Homo sapiens
  misc_feature (22)..(22): n is a, c, g, or t
  misc_feature (52)..(52): n is a, c, g, or t
aaagctgtcgcctgaagtaccngccggattccgggtcactactactactaanttgccgccgctcgacagagaaataaggctgaactttcataatgagagttcattacacttatttcacagaaaattaagaaatttgaacagtgtgagtgccatcaagtgacaaagcagaaacccgggctagtgggagaaggggtagaccagggaaggcatgtgtcctggtgtcttgctgtcttccccagctcctgaatcatccttgtgctgtgtatggccattacattgtgaaccctctggagaaactgagctaggtcctcaggagtccacctgcaatggaaatttctcttgctagatgtaagctatgagaaggagagattgctttgggaagggaagtagttggagcaagatggctctcaacaaggtgcctagaagacgatgacccatcatataggcaagtatactttagatatccctcacatacccaagtcccagcctggcccaagacaccatcgtcgtcgtctagagaagcagtaatcttctaactggtctccctaattctatccttgttttgtaacatatattattcacac

SEQ ID NO: 26322 - DNA, 344 bp, Homo sapiens
cagtgtgtgtttaatgaacttcctaactctgaatgaatgaattgacaaatggaaaaaaagaaagaacaggcactttccatcaaaagataccagtcaacagacgtgaggattaatataattttatattgaacctgacacagaaaactggtctttgaagattcactttgatactgaaagtaatctacagtgaggagaatttccccattgctctgttctcatattaagtaataaactgtgcagttctcccctctctttcctcaagggattcagaaaaccttccagaaaacagaagcatttgacttgaaggaaaggcaactaatatggcatatagaaacaaactcttc

SEQ ID NO: 26323 - DNA, 629 bp, Homo sapiens
tgcagtggctcatgcctgtaatcccaacactttgagaggccaaggcaggtggattacttgagctcaggagttcaacaccagcctgggcaacatggctggtacaaaaaaaatacaaaaattagctgggcgtggtggtgcaggactgtagtcccagatacttggtgggctgaggcaggaggattgcttgagcccaggaggtggaggttgcagtgagccaagatcgtgccactgcacaaagtgaggccctgtctaaaaaaaaaaaaagaattaaaagaattaaaaagtcaaattttaaaaaagtattaaaaaacaattatgatagttgagaaccttaacttttcaaatattttaaactataaaattgatcatagaatgccctgaagttaagagaaagccgtagaaacttgaaccaaaagcatacctgctaaaataaataaataaccttttttcactttctagggcaaaatgttcctctatgtattcaacaatcatttaataagcatctattatgtgctgggatatgaggtttgatggatgaaatgagtttcctatactcacttaggaaactcacaaagccaatctttaattttttctgaaatatgtaaaatattatcaggtaattgagaaga

SEQ ID NO: 26324 - DNA, 363 bp, Homo sapiens
atttgagaattgacatccttacagtattgagtattctaacctgtgaatatggtagaaaccattgtgtattcagttatttgatttctttcagttatgttttataattttctgtgtagaggtcttgtatatgtttcattagatttattctttggtatttgttttttgatactattataaatggtattgttttaaatttttattttctaattatagcaacttgtatgtagagtcatgtgccactttatgatggggatatgagaaatgcattgttaggcagtttcatcatgcaaacatcatagagtgtacttacgcaaatcatgcaaacatcatagagtgtacttacacaaacctaaatggtacatg

SEQ ID NO: 26325 - DNA, 519 bp, Homo sapiens
tcagtccccaattctgatgtttttatacgcaacactaggggtccttctgaagttatcccggcccctgggaaactcacgtggcatggggcccccttctgccctggtctctttcatcccatctgtcccggccccagagcctgtccagtctggtcctctctgtcctgcttggtttgtcaccatgtgatgttgggatggcttgtctttgccgcctcacttcctaagctgacagacgtgtctgctagggaccatcagctcccaagccgcatgacggtgctttccttcaaggttcagaggcttccctttcagtctggcccatctcccacatcctaatggctctgctgtctcaggggcagctctcctttttaacttattggcagagctgggatgacttataggtccctggctcagtgagtaagcaagttcagagacttggctttggccattttgttctcttaggctcatccttggatgccaacagggaaattacctgccagatttcagtcactactttttagaagt

SEQ ID NO: 26326 - DNA, 734 bp, Homo sapiens
ctgtattgagctaagattgcaccactgcactccagcctgggcaacagagccagactatctcaattaaaaataaataaataaaatgaagcaacaatccaatcaatcaaaccaacaaattctggaaaggtagagaagagaagggctgacccagtggtgagttcccagggtggtttgatggtttgttctttggcctcctatataccctgtcttatctgttagagcggagtctacaaccaggaaatcccagtgcccccttcatcccccaacccccacaaaaggagcctcatctttcgagccaaatgacagcgaagagggcggccctgcgggacagtgcccttttgactacacacaccctactctaggaaaacagcctgaaaaaagctgcaccttcccctgccccagatactgtagacactgtggaacaaagacctgttgaccctccccaccttgggccaacacaagcagaggtggcatctctcccctctccaccaagcactggcaagactgtgtggaagggccctgctgaccatccacaacctgcacaagactgaaccacagtaacaaggtggcaccccatcctctctcaaagacagtgaggagctagaagcaaggattctccaacccatttcccgttccccgtcccacccaccgcagaatactcctctctaatcctaatataacgtcatgtacatttctgttacattcggattaaagacaagttctgtttaataata

SEQ ID NO: 26327 - DNA, 311 bp, Homo sapiens
gtggaggttgcagtgagctgagacggcgccattgcactccagcctggacgacaagagcaaaactccatctccaagagcactgtttaattgatggtcagaaaaaaactgttcagcttccacttttaagctgtttctggaattgcctgaaaagatctttgcctaacagctgcttcatgtagaaacaagtgttgagatgatttctatctttgagcagctgccatttggacagtaatggtgaaaagaaagcatccccaaatcttttacttgtcagctgctactttgcccagccttggcagatagaaacttgaggg

SEQ ID NO: 26328 - DNA, 501 bp, Homo sapiens
taaattagtataaggcatcttagaaaaagaaaaagaagaatagcgtgtgggacggttgctctacccaagattaaaattgactgtcaagttaaaatggtgggtattggcatcagaatatgtagataagtggaaacacaatagaaagtctagaaatcaaggctggtattcacaaactctcaactgatgcaggccagccaaaagagaaagttaagaatgtttcacattttcttttcttttcttttgagacttagtttcattcttgttgcccaggctggagtgcagtggcactgtcttgactcactgcaatctctgcctcccgggttcaagcaattctgcctcagctttccgagcagctgggattataggcgcctgccaccatgcccagctaagttttatattttttagtagagatgggatttcaccatgttggccaggctggtgtcaaactcctgacctcaggtgatctgcccgtctcggcctcccaaagtgctgggattacag

SEQ ID NO: 26329 - DNA, 513 bp, Homo sapiens
gcaccactgcactccaggttgggcgacaaagccagaccttgtctcaaaaacaaccaaacaaaaatcttatttgagttcgaaacgcatgtcaattagcagtcacgcccattcttcccatccctcacagccctgagacaaccacctgtctctttagatttgtctatgctggatgcctcatataaatggagtaatacagtattggctctttgcccctggcttcttccacttagcatgttttcaaggttcatcatgttgtagcacgtgtcagcacttcctttctattttgtatattattccattgtatggctataccacatttcgtttacccattcatcaatcaatgcatatttagtttgtttccatttggggggctgatacgaataatgctgttatgaacattagtgtacaggtttttgtggaggcatatgttttcatttctcctggggatataccgagaagcagaattactgtgccacacaggaactctctgattaaccatttaaagaactgcca

SEQ ID NO: 26330 - DNA, 576 bp, Homo sapiens
tatagctaaggggtgaccacgccgtggctgctcgtctgtttcggtcaacagtgtctactcttcggattggaaccctgctaggggatccctcctcccatttcaaacagaaactagccattaagtaaacacccgttcctgttggcttattttggtccacagttaggagggatccaacaggagtttcttgatgaaattgcgctttcaaagaccagatgctgtttggctgacttgaagaaacgcatgccccctcctctggttctagttttcgcgtggttacgtcctgttgttttgaagcaaacgaactgtcacatgccacacaatgagacttcccccgtcactttaaaaaaaggaaagaaaagccctaaacgtaaataagcctagcagagacagcgcccgggtctgcctccagtctgggctctgtgctgtttttgttcggtaacctcggtggagatcccggcagaagaaactctgtggaaataagattaaacccgaggagtactaagacggccaagggataactaactcgacttcggagcgtctgtttcaggaactagagccagcctgccaccctccctc

SEQ ID NO: 26331 - DNA, 221 bp, Homo sapiens
acgtttattctctcacagttctggaggctagaactccaaaattaaggtgtcagcagagccaagctccccatgaaggctttagagaagaatccttctttgcctcttcctagcttctggtggccccagcactccgcaacttgtggcagcctccctctgatctctgcctttctcttcgcatggcttccttcgctgtccatgtctgtctgtgtcttcttctcttg

SEQ ID NO: 26332 - DNA, 635 bp, Homo sapiens
agtcaccttgctctatccatactgaccatcctctttttgtttgtgctgtcagcagcatcttccatgaatgtcccttagatgtcctcatgttttagtttcctcttcacaagcacttttctgctcttctctgctttatttttcacttttcaacattctaaatattgtattcattcaaaatacttaattatcttgtttgtctctattactagaacataaaatagtgtctggcatatagtaggcactcaataaatatttgttgaatgaataaatgttcacactgattgtgatggtgtactttttttaaaaaacagaatcatgcaaacatattactctaatacttgctttcccctctcttagtaactgatggatattgtcatttgatagtgattttaaataactgcagaatagtccataataagtttgtttccagttttttgtcacgacaaataatattgtaataaacacccttatacatattttttaaatattttgctccttttatttttatgaaataagttccttcatgtgggtcaacatatagtagtccctttatttgtggttttgctttccctatggtctgaaaatattaaatggaaaattccagaaataaacaattcataagtttcatgttgcat

SEQ ID NO: 26333 - DNA, 470 bp, Homo sapiens
tttttcttggaaccttttagatgaaggtagctttgcccaagaacccatcaccaataggggaagaaaaggttgggttaaataagacaaaaacatcactgcagataggaggctgagaagctttcactgtatcatgtttaaagacttgatgcaaagtacttcagagaggtagtccaccggaaaaggaaaatcaaacacaaatttcttttcccaagaatgtaatcttctcggcatggcgttttgttgctcactaaaaactccctgctaaagaaaacattttcaggtcgctccactgaatctgctgcaactggtctattttcagctctatttctctgagcctcgcagcagaagttcttaaatgatcctgggaccaggtttggttaaagttgccaagagcatttaagatcgtgttgtttttgcttttgttttccaataatctacagctgggggtatgagaggctacagtggatgtt

SEQ ID NO: 26334 - DNA, 905 bp, Homo sapiens
gcagtcatcacaacgaattgtgattgcctatttactcatctgcatctcccactgaattctgatccatggtggctggcccatgcctgtcttgtgtacatttgcatgtaaaccacttaacccaagtgccaggaagcaaacagtacacgcaggtgtgtggagtgattgaaagctaatttgctacctaagaatgtacagtgattcctcagtgtttattagatcaggcccagactcttcatttcagttttcaactcctctgatttttcttttatacaagctttcagatctcctcttggttctcatctagctcttgcatctttatgccgtgggttgattcctctgcctgcctatctgtagtagcttgtctcctaggatggctgccatcaatttcttctcttctgtatacacatgccactcccgcattgagagatggagtcttctttccccctggaatctggtctggcctgtgactaatttcaataatagaatcttgcatttctattgaaactaccaaaaaaaaaaaattgtgtcagctactacagctactaagttttgggatggtttgttatatggcaatagatatcctcaataccattcttcaaagtcccaaacctacattttctgtgaagccttaccttgctagtctagttaacactgatctcctccttctctgaagttctgtgggaatagaactttgttgatgccacacattttgttatccaactgtatgtattattacttttcctttcctgaatgccagtatgaactccatgaccaaattatatggtctttgaagataccaaatagtggaaataggtcttttgtaatcccttcaacaagtcctagtactgaataaaaatgtaatggctgttgaattggattaaaagtaaaaatattcttggccattt

SEQ ID NO: 26335 - DNA, 660 bp, Homo sapiens
aggaatctgggttttaacaaggcttgtgggtgactgagacgcagacgggagtttgagaagccctcgtctatgccagtgctacacaacttgtggtctgccgtgtgaactgttactggaccatggcaagataacacagaagttgagagtgagcacttagaaatgtttatattaacttgacataactgtgacatccaagcatgggagccttggaaaagagttttattatatttcacaaatatatcagtccacagtcgagttgactgtgactttaaaaaaaaaaactttaaaaaaaaaaaaaaggaaaaagtgaaatttatgatagttggtgcctgtggggacagatgaggggaggagcacatgcgactttattttctttatttaaaaagaatatccaggttgggcgcagtggctcacacctgtaatcccagcactttgggaggccagggtgagaggaccacttggggccaggagttcaagaccagcctggacaacatagtgataccctgtccctacaaaaaccaaaacttagttgcgcccgtggtcccagctgcttggcaggctgaggcagaaggattgcttgagcccaggagttgaaggctgtagtgaactgtgattttgccactgcactccagtgtgggcaacatagtgagacctgtctca

SEQ ID NO: 26336 - DNA, 559 bp, Homo sapiens
cagtgctaggattacaggcatgagcaaccgtgctcagcccatacatgcagtttataaacagcaaatacacacacaaatatatacatattaaaggtacatggccagttagataggactatgcagtttaaaaaggttaatgacttcttcagtaaacagatcattttcttcttagtactttgaaaattagctctaaggattagcattagacccattattatgtggtttagtaagtgaagacctcagtgattgattaatcagtcaccatttgtatttcaagcaattactgttttgatcaggtgaagggtattgtcatattttagaggtgggcagcagtgtagagtggttggtctacaactatcaaaatgagagaggcagctcttttttaagaaattgttttgtgatcactgtgagtctacgaagcagattgcaaaaagtagctgtagtagcaaatgaaagatcagtttgtctttgtgagatagatgggaaagacttttctttatatgatggcttttagccagacagaattattaacagttaaactcattgtaatctttagatt

SEQ ID NO: 26337 - DNA, 593 bp, Homo sapiens
gaccattaattaaggaagttgttatgaagacactggaagcagtcgttactgagttaccagatgaccgcattggctggaatgtgatcagtcaattcagttaagcattgaaatgctccctgatcccccgtacacacatacagtacactcatgcctgggttgtaaccgtcagggtaaagactaggctggtgtaacaaagagaccccagcgtaaaatggcttaaataaaatagaagtctacttctctcgtgaaacaaccagaccaatgtagcttgtctgggcagatctttccgtctgtgctctcctcccttggggctttgtctttatcatatggttgaagctatgttgttgccgcactatggagatgtccaaagcaagcaattttcttttgatcaaaagagttaaacattgtatacatcccactcattgtcacttaactggtaagattgtggtcataaggcccagcaaactttgagggctgctgggaagtgtctctacctaggtggccaggagcctggggagaattgacaaacagatttaaggggacaagtagaatacaagtacttcattgattcagttgctccaatctagtaattt

SEQ ID NO: 26338 - DNA, 231 bp, Homo sapiens
cgatcagtaccattaagttaaactaagtttaccttagaatgttacgtatatggcggcagaatgaacctgcaacttcaaagtcttcacaaaagacctgttaaaacaggaaaaaatacattaaagcaaaaataaagttttaaaaattgaatacaaaaacactaattggtctgtcatgtgcctacagtcaaccctaggaattttggttggtaggtagccatgaaaacaacaaca

SEQ ID NO: 26339 - DNA, 317 bp, Homo sapiens
caacaacagaagcaaaagtacctacatttgaacagccccacaagggttcaaggaaacataaccttgaccaattatttaacaatttttttttcaagacagagtctcactttgtcgcccaggctggagcgcagtggtgcaatcttggctcactgcaacctctgtctcctgggttcaagtgattctcctgcctcagcctcccgagtagctgggattacaggcccccaccaccacacccggctacttttttgtatttttagtagagacgaggtctcaccatgttgcccaggctggtctcaaactcctgacctgaagtgatc

SEQ ID NO: 26340 - DNA, 790 bp, Homo sapiens
tgtaaatattagagatcggtgttgaacaacaacagacattatttaaagctaaagactaaattcacagaataggaccctaaagttgaagatacccagaagataatttcagctagttttgtcaaactctttgactgcaatccctagtattttacatagcatcccagtacatgcttatccatctgtacatctaattgaaacaaaagtttcacaaaacagtaggttccattactatgtggaatgcattctgattttcccattgctgattgcaaaccactaaatggattagactacccactaatgagttgcaggtgacaagtttgaaaaaacaatgctctcgggcaacctgacctgatgcgttaatttatgagattttattttttgtagacagactagattgtccaaatgagtattattactttaactactatagtgctgtgttacagttgtttcagtgattattgcatttttcaaaaccatttttaaaattctgtttgaaatagttggaataacctgaaaacatttaatatcctgttttggtaaattttcatctccaagattaaatttttttaaccagccaacagatgtttgaaggcaagttaggagatatgatggatactggatacagtatccatccatgtactagatacagtatccatccatgtactggatacagtcatactgttagcaaattttagatacataaagtaaaacaaacaaaatgcagtataaaaagttaatattggaatctagtgttgattttatgattaatctcaatgaggttactgtatat

SEQ ID NO: 26341 - DNA, 676 bp, Homo sapiens
cccttgctctgtatctgaaaatcagtcctcagccttcaggaatgcagcttctgagtggaagggggtggggacaggccctccaaggccagctgctgtaccaaagtcagaccatgacttgtgacctttccttcatttcccttattgcctctggtttaatgcaaaaggttcagtgaggtgatggcctagctctgcccccagcaggcctgaggggttcactgggaaggttgtagggggcagcaggagtagaggggaagggagctgcaagtgaatgagtgaggcaggaactgccacccctgcggggttagaggatttggagtgggggacctcaggcttctggaggaaagtacttaaagtgtccaaaagaagaaggcaagcagcatgcaccaagtggctccttggccctctggcccattcaccgggtgtctcagtatgttttctgcagctataacagaataccacagacttaatttataaaaaaaagaaatttcttacagttctagaggctgggaagtccaatatcaggtgccagcatttggcgacggccttcttgccacatcatcccatggtagaatgcgaaagggcaagacagagcaagagggaacagaactcactcttataacaaagtcactctcaccatcattgagccacacctgcaataacaacattactccattca

SEQ ID NO: 26342 - DNA, 595 bp, Homo sapiens
gcattttgatattgattcatcagtgtcaagaattaagaatttaaattcttaaataaatattattcttgatatttattctaagatttaattaaacttgcctggggccaggaaaaatgaaaaagactcaaatttacccctacttgtaatggggaaaatataaatggaggatcatgtcaaattaagccccagggtacagatagttcacccagatataaaaaagtgaggcacacacgacttaaaatgtaaccagttaactatcaacaggttcaacggattatctagtacctccagagataggacttaaagtaagtgaataggaagtcagaatttcggagacaagggagacttcaaaaattgaacatattggccaggtgagatggctcatgcctataatcccataactttgggaggctgaggcaggaggattgtttgagactagcctgggcaacatgttgggactccatctctacaaaaacaaaaaacaaaaaactccaaaagttagccagacatagtggcttgcacctgctgagatgagaggattgcttgagcccaggagtttgaggctgcagtgagctatgatcatgccactgcactc

SEQ ID NO: 26343 - DNA, 441 bp, Homo sapiens
agtgaacaaggctgcaatctactaaaaggtgtactatagtttttcttttgcaacataatttttctgtctataatcacccccatttctaccaaagataatcagagtaagactaatttgtttgcaaaataagtttcgtctcattaaacttcacctgattatttgtatataagtacagcaagaataaccacacagttctttttaaatttgatttgctggaaattttgacaaacaatctcagattatacttttaaaaacctctcatcactaggaagccaaaccaaggccgacatcagactttgtctactttgtctatggttatctagtgtcttgaggttcctaggcctgccaggaagtgacaactttttactcactcactgtaatgctgtgtgtaagtccactttgtgttgctatgaaggaatatgtgagactgggtaatttatg

SEQ ID NO: 26344 - DNA, 368 bp, Homo sapiens
agaaacagcaaccacaattttaagtcttctagtcagtgtaggacagtgttttatacataggtgcttaatataaatatttgatttaaaaccaatcttgtatttttttaattgttttctttcttcccttccactggtcttctttaattttaacttttggccgggcttggtggctcacgcctgtaatcccagcactttgggaggccaaggcgggcagatcacctgaggtcaagagtttgagaccagcctggccaacgtggtgaaaccctgtctctactaaaaatacaaaaataagccgagagttgtggtgggtgcctgtaatcccagctactcgggaggctgaggcaggagaattgcttgaacccgttacg

SEQ ID NO: 26345 - DNA, 415 bp, Homo sapiens
cacacacacacacacacacacacacacacacacaaactctctctctctctcatgctcacaaacagacacgtggtgcttgattctaaatatcttcttttaggcttcaatatcctcaaagtaaaggcatttccttattcatgttttaatttattctactatagctacatgttttcttgtcttactaaatgtttgctgaactgaataacacaccttaactacatatatctggaatttctgttgtgaactttaatggcaaatggaaacgatttgtgggttttgtggggctatcattttcaaactcctgatttttgtgatttttcggggctggccataatgctatagagttctctgattttatttctttggtacaaaaaaagcaaaatgaatgaattgtgattgagccatggaacccagt

SEQ ID NO: 26346 - DNA, 930 bp, Homo sapiens
  misc_feature (94)..(94): n is a, c, g, or t
  misc_feature (135)..(135): n is a, c, g, or t
  misc_feature (383)..(383): n is a, c, g, or t
atgagggaaaataaccagtcctctacactggaattcatcctcctgggagttactggtcagcaggaacaggaagatttcttctacatcctcttcntgttcatttaccccatcacattgattggaaacctgctcatngtcctagccatttgctctgatgttcgccttcacaaccccatgtattttctccttgccaacctctccttggttgacatcttcttctcatcggtaaccatccctaagatgctggccaaccatctcttgggcagcaaatccatctcttttgggggatgcctaacgcagatgtatttcatgatagccttgggtaacacagacagctatattttggctgcaatggcatatgatcgagctgtggccatcagccncccacttcactacacaacaattatgagtccacggtcttgtatctggcttattgctgggtcttgggtgattggaaatgccaatgccctcccccacactctgctcacagctagtctgtccttctgtggcaaccaggaagtggccaacttctactgtgacattacccccttgctgaagttatcctgttctgacatccactttcatgtgaagatgatgtacctaggggttggcattttctctgtgccattactatgcatcattgtctcctatattcgagtcttctccacagtcttccaggttccttccaccaagggcgtgctcaaggccttctccacctgtggttcccacctcacggttgtctctttgtattatggtacagtcatgggcacgtatttccgccctttgaccaattatagcctaaaagacgcagtgatcactgtaatgtacacggcagtgaccccaatgttaaatcctttcatctacagtctgagaaatcgggacatgaaggctgccctgcggaaactcttcaacaagagaatctcctcgtaa

SEQ ID NO: 26347 - DNA, 340 bp, Homo sapiens
gatggagtctcctccaggctggagcgcaatggcgcaagctcggctcactgcaacctccgcctcctgggttcaagcaattctcctgcctcagcctcctgagtagctgggattataggcacccaccaccacgcccagctaattttttgtatttttttgtagagatggggtttcatcacgtcagcctcccagagtgctgggattacagacatgagccaccacgcctggccaataatagtattttacaaactgtatactctagcattctaagaatgaaaaagttctaagagttccgtaaccattttaatttcattgctcatatgaagaaaaaacaaggttaagt

SEQ ID NO: 26348 - DNA, 672 bp, Homo sapiens
catctttaaagtactggaaggaagaaaccaaaccaaaccattcacctagagttttgtacccaaccacaaatgaagatgtaaagacttttcagacattcgaaggttgaaaaaatatgagctaattataatgactagcagtttaatattgtagtattacctttcttagtatccaataccaacattttcaaaacttttgagattataaagtctgaatcagtgaaattttgaaagaagcatacaaagtgaaagaagcaataaagagtggaatgggctagtgcaattgtttagccttgttagagtatcaaaaggaagtatagttttaaaaattgtgcatgatttttactggtgacaattaaaatttgctttgagtgttttaatggttgttaataagaatttgtattttatctttttccagcttaaatagagtttataaatataagccattgctgatcagtagtgttacgtatgtgagcacatgcattcacattgggttgcatttcatagctactgaaccaaatgatgaatgatttggcacttggagaaaataaatttggcatttggagagatatataaattcttcttggttggatactcattacttcctcagttcagaatgaaaaaattttagacccttgaaattcctggataattctgggccaactgagtcagtga

SEQ ID NO: 26349 - DNA, 379 bp, Homo sapiens
taaaatgtatttgtagcccccaaatcaatactcacggcacctttgaagacatgtgcagggtggggaaacatttgagttgcctgaagtgcctgttcccagctgaggtcaaacaaggtgaccttggccgggcgcggtggctcacacctgtaatcttagcacttcgggaggccgaggcgggcggatcatgggatcaggagatcgaaaccatcctggctaacacagtgaaactccatctctactaaaaatacaaaaaattagccgagcatggtggcaggtgcctgtagtcccagctactcgggaggctgaggcaggacaatggggtgaacccgggaggcggagcttgcagtgagccgaggtcgtgccactgcactccagcctg

SEQ ID NO: 26350 - DNA, 810 bp, Homo sapiens
acaggctgttgaacaaaggcaaatctcttgatctctttgctctttggtctctgtttatctatgagataacgttatttttacgctgtcttctgtgaaagttttgagaatgaaatgagacagagcctccaataaaatttagggaagtgctacataaatgcaaggagttattatgataacagattgaaaactcctccaaggaggagtttctcttttgccccatgttataaactcaagaatatcttccattttgcctacatattccaaaagcttttaaattaagctatatgtcattcttacaggagtctcctctatttcagcaatgtgtatacttggtcagttttaattatcttaaaggagaagaatacagtttctctaaactcaagcacttttgtggactaatccttgcaattattctttcttctttcccatacttgacatttaaagtgatatctcccaggctcctacactgttagtcacagaggtaccattcgaccccttgtgcctcttaccatatgtgaatgcttgtcagttgagagtaaactttcttcataaatttcacagttgtgggattgataaaaacagagaactctggttcctcattccttcctgctttctttcttggaaatgccattcatgatgggtcccttatatcactataggggctgctatcatccttcatccttatggccactggcaaataggcaaccaacagtgtccttaggtgccagcactcccggggcatggccccttttccaaggcaggcaggggtcaaggccgctccctttcctgagctgtgggcatctggtctct

SEQ ID NO: 26351 - DNA, 242 bp, Homo sapiens
actgaaaggcataggaaagaagaaactgggaaaagagggtacatgagggaataaaaatttggaaaaccttctgcataataactggagaatctagaagtccacatgcatgcccagagatgtacacatactcagaaatgacccaagaaatcctaagctctcacctctggctgatgtttaggctcatgcaagcctatgttaaaaaaaaaaatcccaaatcaataacctacttttacaatttaaag

SEQ ID NO: 26352 - DNA, 393 bp, Homo sapiens
caataactttccaaaaggaagttttattttctattttaaaggaaaagatgatacatatacaacagagtattagattcaacactttcccacttgaaaattcagtggcacaggggctagacacagtgtgtcacagctgtaatcccagcactttgggaggccaaggcagttggatcacttgaggccaggagttcgagaccagcctggccaacatgctgaaaccctgtctctactaaaaatacacaaattagcctgatgtggtggcaggcacctgtagttccagctactcaggaggctgaggcacaagaatcgcttgaacgcaggaggcagaggttgcagtgagccgagattgagccactgcactctggcctgggcgacagagcaagactctgtctc

SEQ ID NO: 26353 - DNA, 710 bp, Homo sapiens
ccggagcggggctcgcccctcgtcggcttccgccgcccagcccgtgatcgctctccggccgtccccggcaccctcggccccccacggcggttggtcccggcgggggaaggagaaagtgagactcggtgtcatcaccaatccgtcgccagaaggggaggaaactggaatccagcagcggcgagcagcagctgggcggtcacatctggaaatggaaagccgacctccccctcctcctccaccacctcttcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgctgatccagaacgctccagagctgaggactgcctgtctgcaggagtgaaggcaatcttgaaggcatgactacgacctgctctggccacaagagctaagagttgccaggtgtacgtggcctcaaacacttcgagatgccaatcccaacacttcgagaggccaaggcaggcaggatcgctgaggctaggagctgaaaccagcctgggcaacacagcgagacccatctctacaacaaacaaaaaaaa

SEQ ID NO: 26354 - DNA, 297 bp, Homo sapiens
atgtctgttcggggcaaggccggaaaaggccttgggaaaggcggtgccaagtgccatcgcaaggtactgagcgataatattcagggcattaccaagtgcactatccggcgcttggcccggcatggcggtgtcaagcgcatcttgggcctcatttatgaggagacccgccgggtgttcaaggtgttcctggaaaatgtgatctggtacgccgtgaccaacacggagcacgccaagcgcaagacggtcaccgccatggccgtggtctacgtgctcaaacgccagggaagaaccctgtaa

SEQ ID NO: 26355 - DNA, 1764 bp, Homo sapiens
ggcttaccacagcctcaacttctcaggctccagccatcctctcacctcagcctcccaagtagctaggactacaggcgtgtgccactgtgcctggcctaattttataattttaaatgtctgtaaagtaagcaaaatgactagttgaattgtacattaaatatatctaatccctaagagtttataatggaaagggatcaaaactttttcaattgcgataaaactcacataacaaaattaaccattttaaagtgaacaatttagtggtatttagtgcattcacagtgtcgtgcagccaacacctgtatctagttccaagacattttcatctccccaaaaggagaccccatacacgtgaagcagtccctctcccatccccctcctcccatccgctagcaactgctaatttgctttttgtctctatggatttacctgttctggatatttcacataaatggaattatacaataaaggaccgtttgtttctaacttctttcactaagcatccatgttatagcatatatcagacttcattcctttatgactgaataatactttgctgaatggatatatcagtgttttatttgtcctttcatcagttggtggacatttgggttctttctaccttttggctattgtgactagtggtgttgcaaacattcatgtacaagtttttgtttgaatgcctgttgtcagttcttctagatttatacttagaagtggaattgctgggtcatatggtaatttctctgtttcaactttttgagagaccacgaaaccgttttccacagtggtggcaccatttgacatgcccactagaaatatatgagagttccattttcttcacatcttctgacagctttttggggtgttgggatgattcgtctaattgggaaaataagtaccttatttgggcctatatggtatttttaattctgtgtgtctgctcccaaactctgtagccctgccctcccttatattgtgtatcctgtttcagattgtttccgtttcttctgagacactgcatatacccctacatgtatctgtgctaggcatacatccctgtaacttcatggcatttttgtaattgctgtgtacctgttacgtatactgagtgggagtgtctcatttgctgtagaactctctgcattagtgtagtgtctggcacacagtagctgctcaggcattttttaagtatatgattattgggaaaactacagagctagggagagatctgaagaaatactagaaatttttttctgcaaagaaaactttagaaaattgttgacatcatctgtggcatgcagcaaaagttgatgtaaaaggaacagaaagacctatggagataatgggatgtaataacagaaaacatacagaaacaattggttctgaaatcagttaagagcagaactggaattcatactctgtggaatgaatcagcaatgtggaaggagtaacaagattttttaaaaagattttgaatttaggctgggtgcagtggctcacgcctgtaaccccatcactttgggaggccagagtaggtggattgcttcaacccaggcattcgagactagcctggacagcatggcaaaaccctatctctacaaaaaataaaaaattagccaggtgtggtggcatgcgcctgtagtcccatctacttgggaggctgaggtggatggatcacctgagcctgggaagtggaggttgcagtaggctgaagtcatgccactgcactcaaacctggcggacagagtgagaccctatctc

SEQ ID NO: 26356 - DNA, 536 bp, Homo sapiens
gagaaaagaaaacttttattagagataataagttcaaaatataaacaggtaaggtagaaatggtacacacgaataacaaacataaaagtacagatggaactgtgttaggaggcaggactcaactctggaggtggagctcagataccagacaaaattgaggactaagacaaggactgggcggaagtagctttcctgaagacatgctcactagtgtgccatgtcagtttaccattgcaatggcagcacctgcgagcgaccaccgcctttccaggcaataacccgatgacccagaagttactacccttttccgggaaatttctacctaaatcaccccttgatctgtattaaagtaagtaggccaggcttcacacctgtaatcctagccctttggaaggccaaggcaggcagatcacttgaggccaggagttggagaacaggctggcaaacatggggaaacccatctctactaaaaacacaaaattagccagcccaggcctgtaatcccagctactcgggaggctgaagcatgagaatcg

SEQ ID NO: 26357 - DNA, 389 bp, Homo sapiens
gagtgtgtgtattaagttgaatttccaaaattgctgatctccaacagttttggcccacaaaaatgacagtctcatactatttagctcaatatatcagtcgatgattttccccgagcctgaaatcttcatataataataagtaatattttaaacactaaaattaaatataagacatgaatacattatttttcttttctatatgtaccctgtagccactttttatctcttggtggcaacaattctattatttgctttctgaacttatcatgggattgcacttggaaacaaatgtagtctctactgaggagatgagacggtaatttggagacagatgaaaaagaagctggattgagaaataatgtttgtggaaaaattcagtaatttaacca

SEQ ID NO: 26358 - DNA, 280 bp, Homo sapiens
gattacccctgttgcccacgctggtctcaaactcctgggctcaagcgatcctcctgccttggcctcccaaagtgctgggattacaggtctgagccaccacgccaggccaggaaaatttttaaatcagcatctagatgacaggtaaagtatactgtttttctctggcatagataacaccctaacagcttatttcccaacactgtctaactcaaaccatcaaattaacttgggcattttacattttcattcccacataggcctttgctcaatactcttcttc

SEQ ID NO: 26359 - DNA, 963 bp, Homo sapiens
gctgcagagagaacaagacctgagactaattaatgaaggagatgttccacatttaccagttaatagagcatactctgttaatggtgctctgagaagtccaaacatggacatatcttcttccccaaacatcaggcttcgaagacatagtagtcaaattgaaggtgttagacaaatgcataacaatgctcctcggagccagatggccactgaaagagatctcatggcgtggagcagaagagtggtggtcaatgaactaaataatggggttagtaggtgagtcaataaggtaacatttagaaaaaaatttaaagctttattcttaggaagtgaattgaaatgtactatgttagcctagtaaatgaggaattttaaaatatagtttagtcatgcattagtttttccatattattccagtgagttcacttcgtaacaaataatgatcatcttcagctttgtgctgaatgctttggggaatattgaaaatgcaaaacattatctctgttctgagtttatagcctagattagaagaaaagaatacaagtagtattaagaactcatgaggtcttacataattaaatatgtgagtgatatatggaccctaacattggagcagcctgggagtacaattatttgttagatgctagtgcttagagtatctttagaaatgtcatttaggtaggcttcattgggtgaaagaatttcattaggattaatttcaaacttataatccctattcatatttgtaaaccctgacatttgctgtaataataactttcagatactccacagcaactggaaatagatttagaaaagagaaaggacatttacagagaatatgtacaattcattttaatcaagtatcttcctaaccaagccttttaccagatcaaccaacaaatagcaaaattaatttggtttctccttttcttctgctttctgctataagaaggcagcagtgataag

SEQ ID NO: 26360 - DNA, 544 bp, Homo sapiens
caggtctttcttcgcatggcagcagcaaggagaagtgccaaatgaaagggggaaaaactccttataaaaccatcagatcttgtgagaactcactcactatcacgagaacagcatgggggtaaccacctccatgattcaattacctcccaccgggtccctttcagaacacatggggattatgggaattacgattcaagatgagatgtcggtggggaaacagccaaaccgtatcaattactcctgtgttttgtgcaatgctggtgtaagtaaacctgccgtgctaccagtcatataaaaatctggcacatatatttatgcacagcacacagtacttgacaatgataacaaacaactacgttactcgtttatgtatttactatactttttatttagagtgtactccttctacttatatataaaacaagttaaatgtaaaacaacctcaggcagtttcttcaggaggtatccagaagaaggcattgctataacgtaagatgacagttgcatgcatgtcactgcccataagaccttccggtcacaaaac

SEQ ID NO: 26361 - DNA, 1674 bp, Homo sapiens
aaacattaatctgaaacttaagccttagaaattaatcgcaggtatgatagaatgaggcttggtggttccatagctttcttggtcctttgaaatgggaaataacctgaaccaaaaatcctagtttgaaagttacacttcagtgatttggcctataaacagtggtcctatgattatacattttttccttcactgatttgcataattttgttttcatggccacagcaaaacaatgtgaaatatatttttgctatacccactttttttatcaaattcagatgtctactctcaccattttatattcatttccccagaaaaatgtgctgttttcataatgtctttatttagcaggtctttcaaaccaaatggaagccttacctgtctttgtccttaatagtgtaaatatcttgcacagagtgttgaggcctatggttttggacttgcaccttacagctgcctttgttttatctatctagctttaactgtgagtgttcagatcagctgatcacattgatcaggagccaaagccaaatgctttgtagtttgttatgtatgtatcccttaaaaaatcatgaggttttgatttttatattttaactaagggtacattcctgccttctcttagtttgtcatatgactagaacaagagaagtcttaagctgcatttactccaattccagatctccatttgtttttgttttataaatttataatcttaatgaagagactagtgccctctcttcctgccacaactctcaatctgccaagactgttgaagcagttaacgctcagtgcaaacttttgccaaatagtaagtttcaacaaaatatctttatagtgaaagattttgagaattagtaaatccagtacatgattccataaaagcttattaaagttaataattctaatttactccaaatgattactttcaatatgatctttggggagaaaaagcctttagtgaattttcttgagggtgataaatcacatcattgcgatctatatcacctccttgagaatctctcccaggctgaaaatgtgatggtaatcatgggtgtttttaagaacaaatctaatttttatcaagtgttctttcctctacaaaaaaggaaggaggagaaaaagcttccttaaaactgattattttgattcaattttaagtttctaaaaaaggtgatattaaagtatatgtattccttcagcattaccttaaaggctagaaaaacgggataaatcttcagaaaagtgtcaaaagtgtcacagtacatgttcaaatttaaacttgaatcctggttcatctttgacttttgttgtgcatttttaatgcttctttatttttgatacacagaatgcagttgaacttgatcttttaaaattgagacatgtaagctaatcagcaaaagacagaaacaaaactgcacatctgtaataatcagatagcaattctactgcacaattcattgattgtaaggtatcctgtaacaagcaatgtttgtctcctattttttgatacctcttaaacttatgtcttttagaaagacagtgcctctgtatgctttttgtatttttactgagtgtaaatatttgttatatttttggttaagagaatgtaaaaataccatttattattatcatatctactaatacattggtggaatcaataaagaatctacatta

SEQ ID NO: 26362 - DNA, 1701 bp, Homo sapiens
aaacattaatctgaaacttaagccttagaaattaatcgcaggtatgatagaatgaggcttggtggttccatagctttcttggtcctttgaaatgggaaataacctgaaccaaaaatcctagtttgaaagttacacttcagtgatttggcctataaacagtggtcctatgattatacattttttccttcactgatttgcataattttgttttcatggccacagcaaaacaatgtgaaatatatttttgctatacccactttttttatcaaattcagatgtctactctcaccattttatattcatttccccagaaaaatgtgctgttttcataatgtctttatttagcaggtctttcaaaccaaatggaagccttacctgtctttgtccttaatagtgtaaatatcttgcacagagtgttgaggcctatggttttggacttgcaccttacagctgcctttgttttatctatctagctttaactgtgagtgttcagatcagctgatcacattgatcaggagccaaagccaaatgctttgtagtttgttatgtatgtatcccttaaaaaatcatgaggttttgatttttatattttaactaagggtacattcctgccttctcttagtttgtcatatgactagaacaagagaagtcttaagctgcatttactccaattccagatctccatttgtttttgttttataaatttataatcttaatgaagagactagtgccctctcttcctgccacaactctcaatctgccaagactgttgaagcagttaacgctcagtgcaaacttttgccaaatagtaagtttcaacaaaatatctttatagtgaaagattttgagaattagtaaatccagtacatgattccataaaagcttattaaagttaataattctaatttactccaaatgattactttcaatatgatctttggggagaaaaagcctttagtgaattttcttgagggtgataaatcacatcattgcgatctatatcacctccttgagaatctctcccaggctgaaaatgtgatggtaatcatgggtgtttttaagaacaaatctaatttttatcaagtgttctttcctctacaaaaaaggaaggaggagaaaaagcttccttaaaactgattattttgattcaattttaagtttctaaaaaaggtgatattaaagtatatgtattccttcagcattaccttaaaggctagaaaaacgggataaatcttcagaaaagtgtcaaaagtgtcacagtacatgttcaaatttaaacttgaatcctggttcatctttgacttttgttgtgcatttttaatgcttctttatttttgatacacagaatgcagttgaacttgatcttttaaaattgagacatgtaagctaatcagcaaaagacagaaacaaaactgcacatctgtaataatcagatagcaattctactgcacaattcattgattgtaaggtatcctgtaacaagcaatgtttgtctcctattttttgatacctcttaaacttatgtcttttagaaagacagtgcctctgtatgctttttgtatttttactgagtgtaaatatttgttatatttttggttaagagaatgtaaaaataccatttattattatcatatctactaatacattggtggaatcaataaagaatctacattaaaaaaaaaaatatttgttatatttttg

SEQ ID NO: 26363 - DNA, 216 bp, Homo sapiens
tttttttttgaagattaatgtagattctttattgattccaccaatgtattagtagatatgataataataaatggtatttttactgagtgtaaatatttgttatatttttggttaagagaatgtaaaaataccatttattattatcatatctactaatacattggtggaatcaataaagaatctacattaaaaaaaaaaatatttgttatatttttg

SEQ ID NO: 26364 - DNA, 526 bp, Homo sapiens
agctatctctagacagctaactacttttgagatatgtaactttatgactgacactttaggggcctccaggtctactataggcttacttctggcaaaagagttcctggcttccctagatgacgtacccactgtgccctagcctggtctgccaaattttaatgaccaagtatgtaatgcaaatataaatggtccccaccttaggatggttctacttaaaaattttcagtgtattgtactcctcatcataagtcgaggagtacaattatcctcctcaaccatgtcaataaatactcagacttgtggaaggttctgggccaggctctgggaaagcaaagaggtgacaaagtctttgccagaaaatttctgcccttcagaggaagagagcagaagaggtcaaggaaaaatttaagtccccagagggcagaaaccatacctacccgggcacagttaacgaacacataataaacagcctagaaatgtttgttattactcataattgttacggcaaacactttgggtttcgggt

SEQ ID NO: 26365 - DNA, 344 bp, Homo sapiens
aattacgaattgggaagccacagttaccaccagtgtgcttgtaaacagtttttaagataaacattcatgtggtgactctacttggagttgccaaattccacatattttctcaaagcagaagctttgcataagtctatacaagtgaccagcctcctctttttcagggttgtactctctcaccaacagcttttctaggtcacccatgcttatttttctggttcaacctctcctactcattatatattttttttctggtataatatatacacatttttagtgtgattcttttgtactagtcaatatgcattacataagttttctctgaccttcctatttctctcgat

SEQ ID NO: 26366 - DNA, 381 bp, Homo sapiens
gaggtcgaggtaggaggatcacttgggcctaggagctggaggctgcagtgagccatgatctcaccactatactccagcctcggtgacacagtgagaccccaactctaaaaagaaatactaataataagaaaaataagaaaagcctaagaggtaatgagacctttaatagtttaggccagacttttaacacgacttaaattttacaaactgataataataaagcttacctggaaaatagatttgtacttgtaggcaatacatttttgaaaaagaatattgaggagaggcttgttcagccagctatcaaaatatatcaggtaggtaggacgtggtggcacgcctgtaatcttagtgctttgggaggctgaagctgaggattgc

SEQ ID NO: 26367 - DNA, 231 bp, Homo sapiens
gcctgaagccacagggatgctgatgaccacagaaggaagggcttttaaaaagtgttcttttctgattataaaagtaacataggtcatagtagaaatttaaaaactacagatgagctggatgtggtggctcacatctgtaatcccagtgctttgggaggctgaattgggaggattgcttgaggccaggagttcaaaaccaacctgggcaacatagcaagattctgtctctac

SEQ ID NO: 26368 - DNA, 2447 bp, Homo sapiens
gacagtggaagtcccacctgcgcccgacggcggaagttccgggagtgccaagtacccgcgtgcatacggctgccggcatggcacattacaacttcaagaaaattacggtggtgccgtccgccaaggacttcatagacctcacgttgtcgaagactcaacgaaagactccaaccgttattcataaacattaccaaatacatcgcattagacatttttacatgagaaaagtcaaatttactcaacagaattaccatgatagactttcacaaattctaacagatttccccaaattggatgatattcatccgttctatgctgatttgatgaatattctctacgacaaggatcattacaagttggctctggggcaaataaatattgccaaaaatttagtggacaatgttgctaaagattatgtgcgactgatgaagtatggcgactctctctaccgctgcaaacagctgaagcgtgcggccctgggacggatgtgcacagtgatcaagaggcagaagcagagtttggagtatttggagcaagtgcgtcagcatttatcccgtttgccaaccattgatccgaataccaggaccctgcttttgtgtgggtacccaaatgttgggaagtccagcttcatcaacaaggtgacgagagcagacgtggatgtccagccctatgcgttcacaaccaagtctctgtttgttgggcacatggattataagtatctacgttggcaggttgtagacactcctgggatcctggaccaccctctggaggataggaacaccatcgagatgcaggccatcactgccctggcccacctccgtgctgcggtcctgtatgtgatggatttgtctgagcagtgtgggcatgggctgagggagcagctagaactcttccagaacatcagacctctcttcatcaacaagcctctcatagttgtagccaacaaatgtgatgtgaagagaatagctgaactttctgaagatgatcagaaaatatttacagatttgcagtctgaaggattccctgtaatagagaccagcaccctgactgaggaaggtgttattaaagttaaaacagaggcttgcgataggcttttggctcatcgagtggaaaccaaaatgaagggaaataaagtgaatgaggtgctgaatagactgcacctggctatcccaaccaggagggacgataaggagaggccccctttcatccctgaaggagtggtggctcgcaggaagaggatggaaactgaggagtccaggaagaagagggaacgagatcttgagctggaaatgggagatgattatattttggatcttcagaagtactgggatttaatgaatttgtctgaaaaacatgataagataccagaaatctgggaaggccataatatagctgattatattgatccagccatcatgaagaaattggaagaattagaaaaagaagaagagctgagaacagctgctggagagtatgacagtgtatctgagagtgaagacgaagagatgctggaaatccgacagctggcaaagcaaattcgagagaaaaagaagttgaaaattctggagtccaaagaaaagaatacacagggacccaggatgccgcgaactgctaagaaggttcagaggacagttttggagaaggagatgcgtagtcttggtgttgacatggacgataaagacgatgcccattacgcagtccaggcaagaagatcccggagcatcactaggaaaagaaagcgggaagactctgctcccccgtcctctgtggcccggagtgggagttgctctcgaactccacgtgacgtttctggtcttagggatgtcaagatggtgaagaaagccaagactatgatgaagaatgctcagaagaagatgaatcggttggggaagaaaggggaggcggatagacacgtgtttgatatgaagcccaagcacttgctgtctgggaagaggaaagctggtaaaaaggacaggagatagtatccgtttggttggcgtggcttcgctagagtgttgctgtttatttcctggtttggcacagtatggtttcatgaaattggagctctgtataaactgaaaaagacaaaataagtaaagcacttgttgctttgctgaaaactatggttaaccctatataggtgtgggaaatttttgtcactgcataatattacaaatattttgagtagacagtgtttccacatttaatggagtatcagttgcttcagattttcagaactgggaagatttactggtgtaactgggttgtttttgatggagaaaaaccttattttcttttgtaagagctgggagcaaacacgtttatgagtgtgtcggaatcccgtgcttaaaatacgctcttaaattattttctagtcttattttacaatgtctcattgtagtctgtcttcaactattttatccaaaataaacctccagaagaaagta

SEQ ID NO: 26369 - DNA, 2523 bp, Homo sapiens
gacagtggaagtcccacctgcgcccgacggcggaagttccgggagtgccaagtacccgcgtgcatacggctgccggcatggcacattacaacttcaagaaaattacggtggtgccgtccgccaaggacttcatagacctcacgttgtcgaagactcaacgaaagactccaaccgttattcataaacattaccaaatacatcgcattagacatttttacatgagaaaagtcaaatttactcaacagaattaccatgatagactttcacaaattctaacagatttccccaaattggatgatattcatccgttctatgctgatttgatgaatattctctacgacaaggatcattacaagttggctctggggcaaataaatattgccaaaaatttagtggacaatgttgctaaagattatgtgcgactgatgaagtatggcgactctctctaccgctgcaaacagctgaagcgtgcggccctgggacggatgtgcacagtgatcaagaggcagaagcagagtttggagtatttggagcaagtgcgtcagcatttatcccgtttgccaaccattgatccgaataccaggaccctgcttttgtgtgggtacccaaatgttgggaagtccagcttcatcaacaaggtgacgagagcagacgtggatgtccagccctatgcgttcacaaccaagtctctgtttgttgggcacatggattataagtatctacgttggcaggttgtagacactcctgggatcctggaccaccctctggaggataggaacaccatcgagatgcaggccatcactgccctggcccacctccgtgctgcggtcctgtatgtgatggatttgtctgagcagtgtgggcatgggctgagggagcagctagaactcttccagaacatcagacctctcttcatcaacaagcctctcatagttgtagccaacaaatgtgatgtgaagagaatagctgaactttctgaagatgatcagaaaatatttacagatttgcagtctgaaggattccctgtaatagagaccagcaccctgactgaggaaggtgttattaaagttaaaacagaggcttgcgataggcttttggctcatcgagtggaaaccaaaatgaagggaaataaagtgaatgaggtgctgaatagactgcacctggctatcccaaccaggagggacgataaggagaggccccctttcatccctgaaggagtggtggctcgcaggaagaggatggaaactgaggagtccaggaagaagagggaacgagatcttgagctggaaatgggagatgattatattttggatcttcagaagtactgggatttaatgaatttgtctgaaaaacatgataagataccagaaatctgggaaggccataatatagctgattatattgatccagccatcatgaagaaattggaagaattagaaaaagaagaagagctgagaacagctgctggagagtatgacagtgtatctgagagtgaagacgaagagatgctggaaatccgacagctggcaaagcaaattcgagagaaaaagaagttgaaaattctggagtccaaagaaaagaatacacagggacccaggatgccgcgaactgctaagaaggttcagaggacagttttggagaaggagatgcgtagtcttggtgttgacatggacgataaagacgatgcccattacgcagtccaggcaagaagatcccggagcatcactaggaaaagaaagcgggaagactctgctcccccgtcctctgtggcccggagtgggagttgctctcgaactccacgtgacgtttctggtcttagggatgtcaagatggtgaagaaagccaagactatgatgaagaatgctcagaagaagatgaatcggttggggaagaaaggggaggcggatagacacgtgtttgatatgaagcccaagcacttgctgtctgggaagaggaaagctggtaaaaaggacaggagatagtatccgtttggttggcgtggcttcgctagagtgttgctgtttatttcctggtttggcacagtatggtttcatgaaattggagctctgtataaactgaaaaagacaaaataagtaaagcacttgttgctttgctgaaaactatggttaaccctatataggtgtgggaaatttttgtcactgcataatattacaaatattttgagtagacagtgtttccacatttaatggagtatcagttgcttcagattttcagaactgggaagatttactggtgtaactgggttgtttttgatggagaaaaaccttattttcttttgtaagagctgggagcaaacacgtttatgagtgtgtcggaatcccgtgcttaaaatacgctcttaaattattttctagtcttattttacaatgtctcattgtagtctgtcttcaactattttatccaaaataaacctccagaagaaagtagttttcatttacttagctcatgttttggtttagttatagtcgctatggatttggccaaataaaaaggcaaacaaca

SEQ ID NO: 26370 - DNA, 1402 bp, Homo sapiens
gtgtttccacatttaatggagtatcactgtctactcaaaatattgaaatattttgagtagacagtgtttccacatttaatggagtatcagttgcttcagattttcagaactgggaagatttactggtgtaactgggttgtttttgatggagaaaaaccttattttcttttgtaagagctgggagcaaacacgtttatgagtgtgtcggaatcccgtgcttaaaatacgctcttaaattattttctagtcttattttacaatgtctcattgtagtctgtcttcaactattttatccaaaataaacctccagaagaaagtagttttcatttacttagctcatgttttggtttagttatagtcgctatggatttggccaaataaaaaggcaaacaacatgacatttctattttgttttaaagcaaaaatacttttgggggagtaaaatgttgctggaggcattaggcaattaaatatgggcattctcctatttctgtggcccgtccctgaagttacatgttcagtaaaacacaaaaacaccgccaatgccacctcaaaagcacctgctggggagcgttggggtgaagagctgtggggtcggagggacctgcccaggggtccgtgtgctcctggagctccaaagacacacaggggtccaagagccaccacggataagttatcaagtcacacaatcaacattatagctgaggaaaggactttagttaatcacacttctggattacatgtggcaattttaaaaatttaccagggctgggctgggcgcaggggctcaagcctgtagttccagcactttgggaggccgaggtgggcagatcaggaggtcaggagttcgagaccagcctggccaacatggtgaaaccccatctctactaaaaatacaaaaattagccatgcgtggtggtgggcatctgtaatcctagctgctcgggaggctaaggcaggagaattgcttgagcccagaggcggaggttgcagtgagccgagatcgtgccactgcactccagcctgggtgacagagagagactccgtgtgaaaaaaaaaaaaaaaataccaggtctggtttttgaaattctttctccgtattaaacaccaaaacttaacatatagtttactttgtgttaaacaacaacagtatggccgggcgcggcagctcatgcctgtaatcccagcactttgggaggccgaggcaggcggatcacgaggtcaggagatcgagaccatcctggctaacacggtgaaaccccgtctctactaaaaatacaaaaaattagctgggtgtggtggcgggcgcctgtattcccaactacttgggaggctgaggcaggtagaatggcttgaacccgggaggcggagcttgcagtgagccaatatcgcaccactgctc

SEQ ID NO: 26371 - DNA, 3530 bp, Homo sapiens
gacagtggaagtcccacctgcgcccgacggcggaagttccgggagtgccaagtacccgcgtgcatacggctgccggcatggcacattacaacttcaagaaaattacggtggtgccgtccgccaaggacttcatagacctcacgttgtcgaagactcaacgaaagactccaaccgttattcataaacattaccaaatacatcgcattagacatttttacatgagaaaagtcaaatttactcaacagaattaccatgatagactttcacaaattctaacagatttccccaaattggatgatattcatccgttctatgctgatttgatgaatattctctacgacaaggatcattacaagttggctctggggcaaataaatattgccaaaaatttagtggacaatgttgctaaagattatgtgcgactgatgaagtatggcgactctctctaccgctgcaaacagctgaagcgtgcggccctgggacggatgtgcacagtgatcaagaggcagaagcagagtttggagtatttggagcaagtgcgtcagcatttatcccgtttgccaaccattgatccgaataccaggaccctgcttttgtgtgggtacccaaatgttgggaagtccagcttcatcaacaaggtgacgagagcagacgtggatgtccagccctatgcgttcacaaccaagtctctgtttgttgggcacatggattataagtatctacgttggcaggttgtagacactcctgggatcctggaccaccctctggaggataggaacaccatcgagatgcaggccatcactgccctggcccacctccgtgctgcggtcctgtatgtgatggatttgtctgagcagtgtgggcatgggctgagggagcagctagaactcttccagaacatcagacctctcttcatcaacaagcctctcatagttgtagccaacaaatgtgatgtgaagagaatagctgaactttctgaagatgatcagaaaatatttacagatttgcagtctgaaggattccctgtaatagagaccagcaccctgactgaggaaggtgttattaaagttaaaacagaggcttgcgataggcttttggctcatcgagtggaaaccaaaatgaagggaaataaagtgaatgaggtgctgaatagactgcacctggctatcccaaccaggagggacgataaggagaggccccctttcatccctgaaggagtggtggctcgcaggaagaggatggaaactgaggagtccaggaagaagagggaacgagatcttgagctggaaatgggagatgattatattttggatcttcagaagtactgggatttaatgaatttgtctgaaaaacatgataagataccagaaatctgggaaggccataatatagctgattatattgatccagccatcatgaagaaattggaagaattagaaaaagaagaagagctgagaacagctgctggagagtatgacagtgtatctgagagtgaagacgaagagatgctggaaatccgacagctggcaaagcaaattcgagagaaaaagaagttgaaaattctggagtccaaagaaaagaatacacagggacccaggatgccgcgaactgctaagaaggttcagaggacagttttggagaaggagatgcgtagtcttggtgttgacatggacgataaagacgatgcccattacgcagtccaggcaagaagatcccggagcatcactaggaaaagaaagcgggaagactctgctcccccgtcctctgtggcccggagtgggagttgctctcgaactccacgtgacgtttctggtcttagggatgtcaagatggtgaagaaagccaagactatgatgaagaatgctcagaagaagatgaatcggttggggaagaaaggggaggcggatagacacgtgtttgatatgaagcccaagcacttgctgtctgggaagaggaaagctggtaaaaaggacaggagatagtatccgtttggttggcgtggcttcgctagagtgttgctgtttatttcctggtttggcacagtatggtttcatgaaattggagctctgtataaactgaaaaagacaaaataagtaaagcacttgttgctttgctgaaaactatggttaaccctatataggtgtgggaaatttttgtcactgcataatattacaaatattttgagtagacagtgtttccacatttaatggagtatcagttgcttcagattttcagaactgggaagatttactggtgtaactgggttgtttttgatggagaaaaaccttattttcttttgtaagagctgggagcaaacacgtttatgagtgtgtcggaatcccgtgcttaaaatacgctcttaaattattttctagtcttattttacaatgtctcattgtagtctgtcttcaactattttatccaaaataaacctccagaagaaagtagttttcatttacttagctcatgttttggtttagttatagtcgctatggatttggccaaataaaaaggcaaacaacatgacatttctattttgttttaaagcaaaaatacttttgggggagtaaaatgttgctggaggcattaggcaattaaatatgggcattctcctatttctgtggcccgtccctgaagttacatgttcagtaaaacacaaaaacaccgccaatgccacctcaaaagcacctgctggggagcgttggggtgaagagctgtggggtcggagggacctgcccaggggtccgtgtgctcctggagctccaaagacacacaggggtccaagagccaccacggataagttatcaagtcacacaatcaacattatagctgaggaaaggactttagttaatcacacttctggattacatgtggcaattttaaaaatttaccagggctgggctgggcgcaggggctcaagcctgtagttccagcactttgggaggccgaggtgggcagatcaggaggtcaggagttcgagaccagcctggccaacatggtgaaaccccatctctactaaaaatacaaaaattagccatgcgtggtggtgggcatctgtaatcctagctgctcgggaggctaaggcaggagaattgcttgagcccagaggcggaggttgcagtgagccgagatcgtgccactgcactccagcctgggtgacagagagagactccgtgtgaaaaaaaaaaaaaaaataccaggtctggtttttgaaattctttctccgtattaaacaccaaaacttaacatatagtttactttgtgttaaacaacaacagtatggccgggcgcggcagctcatgcctgtaatcccagcactttgggaggccgaggcaggcggatcacgaggtcaggagatcgagaccatcctggctaacacggtgaaaccccgtctctactaaaaatacaaaaaattagctgggtgtggtggcgggcgcctgtattcccaactacttgggaggctgaggcaggtagaatggcttgaacccgggaggcggagcttgcagtgagccaatatcgcaccactgctc

SEQ ID NO: 26372 - DNA, 2405 bp, Homo sapiens
gacagtggaagtcccacctgcgcccgacggcggaagttccgggagtgccaagtacccgcgtgcatacggctgccggcatggcacattacaacttcaagaaaattacggtggtgccgtccgccaaggacttcatagacctcacgttgtcgaagactcaacgaaagactccaaccgttattcataaacattaccaaatacatcgcattagacatttttacatgagaaaagtcaaatttactcaacagaattaccatgatagactttcacaaattctaacagatttccccaaattggatgatattcatccgttctatgctgatttgatgaatattctctacgacaaggatcattacaagttggctctggggcaaataaatattgccaaaaatttagtggacaatgttgctaaagattatgtgcgactgatgaagtatggcgactctctctaccgctgcaaacagctgaagcgtgcggccctgggacggatgtgcacagtgatcaagaggcagaagcagagtttggagtatttggagcaagtgcgtcagcatttatcccgtttgccaaccattgatccgaataccaggaccctgcttttgtgtgggtacccaaatgttgggaagtccagcttcatcaacaaggtgacgagagcagacgtggatgtccagccctatgcgttcacaaccaagtctctgtttgttgggcacatggattataagtatctacgttggcaggttgtagacactcctgggatcctggaccaccctctggaggataggaacaccatcgagatgcaggccatcactgccctggcccacctccgtgctgcggtcctgtatgtgatggatttgtctgagcagtgtgggcatgggctgagggagcagctagaactcttccagaacatcagacctctcttcatcaacaagcctctcatagttgtagccaacaaatgtgatgtgaagagaatagctgaactttctgaagatgatcagaaaatatttacagatttgcagtctgaaggattccctgtaatagagaccagcaccctgactgaggaaggtgttattaaagttaaaacagaggcttgcgataggcttttggctcatcgagtggaaaccaaaatgaagggaaataaagtgaatgaggtgctgaatagactgcacctggctatcccaaccaggagggacgataaggagaggccccctttcatccctgaaggagtggtggctcgcaggaagaggatggaaactgaggagtccaggaagaagagggaacgagatcttgagctggaaatgggagatgattatattttggatcttcagaagtactgggatttaatgaatttgtctgaaaaacatgataagataccagaaatctgggaaggccataatatagctgattatattgatccagccatcatgaagaaattggaagaattagaaaaagaagaagagctgagaacagctgctggagagtatgacagtgtatctgagagtgaagacgaagagatgctggaaatccgacagctggcaaagcaaattcgagagaaaaagaagttgaaaattctggagtccaaagaaaagaatacacagggacccaggatgccgcgaactgctaagaaggttcagaggacagttttggagaaggagatgcgtagtcttggtgttgacatggacgataaagacgatgcccattacgcagtccaggcaagaagatccccgtcctctgtggcccggagtgggagttgctctcgaactccacgtgacgtttctggtcttagggatgtcaagatggtgaagaaagccaagactatgatgaagaatgctcagaagaagatgaatcggttggggaagaaaggggaggcggatagacacgtgtttgatatgaagcccaagcacttgctgtctgggaagaggaaagctggtaaaaaggacaggagatagtatccgtttggttggcgtggcttcgctagagtgttgctgtttatttcctggtttggcacagtatggtttcatgaaattggagctctgtataaactgaaaaagacaaaataagtaaagcacttgttgctttgctgaaaactatggttaaccctatataggtgtgggaaatttttgtcactgcataatattacaaatattttgagtagacagtgtttccacatttaatggagtatcagttgcttcagattttcagaactgggaagatttactggtgtaactgggttgtttttgatggagaaaaaccttattttcttttgtaagagctgggagcaaacacgtttatgagtgtgtcggaatcccgtgcttaaaatacgctcttaaattattttctagtcttattttacaatgtctcattgtagtctgtcttcaactattttatccaaaataaacctccagaagaaagta

SEQ ID NO: 26373 - DNA, 2567 bp, Homo sapiens
cggggtccaccagagatcggatcccccagagaccggggtccacctaagaccgtggtccacccaaagactgagggcccccagagatgggggtacacccagagttgggttccctggaggggccccgggtgacgatgtgggcgagtggagggggaccccgacatgtgagggaggaagcgttccgtggtccgtgatgagccttcggattctgggtttggcgtagccccctcccctctcaggaatcctgggacttcatagacctcacgttgtcgaagactcaacgaaagactccaaccgttattcataaacattaccaaatacatcgcattagacatttttacatgagaaaagtcaaatttactcaacagaattaccatgatagactttcacaaattctaacagatttccccaaattggatgatattcatccgttctatgctgatttgatgaatattctctacgacaaggatcattacaagttggctctggggcaaataaatattgccaaaaatttagtggacaatgttgctaaagattatgtgcgactgatgaagtatggcgactctctctaccgctgcaaacagctgaagcgtgcggccctgggacggatgtgcacagtgatcaagaggcagaagcagagtttggagtatttggagcaagtgcgtcagcatttatcccgtttgccaaccattgatccgaataccaggaccctgcttttgtgtgggtacccaaatgttgggaagtccagcttcatcaacaaggtgacgagagcagacgtggatgtccagccctatgcgttcacaaccaagtctctgtttgttgggcacatggattataagtatctacgttggcaggttgtagacactcctgggatcctggaccaccctctggaggataggaacaccatcgagatgcaggccatcactgccctggcccacctccgtgctgcggtcctgtatgtgatggatttgtctgagcagtgtgggcatgggctgagggagcagctagaactcttccagaacatcagacctctcttcatcaacaagcctctcatagttgtagccaacaaatgtgatgtgaagagaatagctgaactttctgaagatgatcagaaaatatttacagatttgcagtctgaaggattccctgtaatagagaccagcaccctgactgaggaaggtgttattaaagttaaaacagaggcttgcgataggcttttggctcatcgagtggaaaccaaaatgaagggaaataaagtgaatgaggtgctgaatagactgcacctggctatcccaaccaggagggacgataaggagaggccccctttcatccctgaaggagtggtggctcgcaggaagaggatggaaactgaggagtccaggaagaagagggaacgagatcttgagctggaaatgggagatgattatattttggatcttcagaagtactgggatttaatgaatttgtctgaaaaacatgataagataccagaaatctgggaaggccataatatagctgattatattgatccagccatcatgaagaaattggaagaattagaaaaagaagaagagctgagaacagctgctggagagtatgacagtgtatctgagagtgaagacgaagagatgctggaaatccgacagctggcaaagcaaattcgagagaaaaagaagttgaaaattctggagtccaaagaaaagaatacacagggacccaggatgccgcgaactgctaagaaggttcagaggacagttttggagaaggagatgcgtagtcttggtgttgacatggacgataaagacgatgcccattacgcagtccaggcaagaagatcccggagcatcactaggaaaagaaagcgggaagactctgctcccccgtcctctgtggcccggagtgggagttgctctcgaactccacgtgacgtttctggtcttagggatgtcaagatggtgaagaaagccaagactatgatgaagaatgctcagaagaagatgaatcggttggggaagaaaggggaggcggatagacacgtgtttgatatgaagcccaagcacttgctgtctgggaagaggaaagctggtaaaaaggacaggagatagtatccgtttggttggcgtggcttcgctagagtgttgctgtttatttcctggtttggcacagtatggtttcatgaaattggagctctgtataaactgaaaaagacaaaataagtaaagcacttgttgctttgctgaaaactatggttaaccctatataggtgtgggaaatttttgtcactgcataatattacaaatattttgagtagacagtgtttccacatttaatggagtatcagttgcttcagattttcagaactgggaagatttactggtgtaactgggttgtttttgatggagaaaaaccttattttcttttgtaagagctgggagcaaacacgtttatgagtgtgtcggaatcccgtgcttaaaatacgctcttaaattattttctagtcttattttacaatgtctcattgtagtctgtcttcaactattttatccaaaataaacctccagaagaaagta

SEQ ID NO: 26374 - DNA, 2048 bp, Homo sapiens
gacagtggaagtcccacctgcgcccgacggcggaagttccgggagtgccaagtacccgcgtgcatacggctgccggcatggcacattacaacttcaagaaaattacggtggtgccgtccgccaaggacttcatagacctcacgttgtcgaagactcaacgaaagactccaaccgttattcataaacattaccaaatacatcgcattagacatttttacatgagaaaagtcaaatttactcaacagaattaccatgatagactttcacaaattctaacagatttccccaaattggatgatattcatccgttctatgctgatttgatgaatattctctacgacaaggatcattacaagttggctctggggcaaataaatattgccaaaaatttagtggacaatgttgctaaagattatgtgcgactgatgaagtatggcgactctctctaccgctgcaaacagctgaagcgtgcggccctgggacggatgtgcacagtgatcaagaggcagaagcagagtttggagtatttggagcaagtgcgtcagcatttatcccgtttgccaaccattgatccgaataccaggaccctgcttttgtgtgggtacccaaatgttgggaagtccagcttcatcaacaaggtgacgagagcagacgtggatgtccagccctatgcgttcacaaccaagtctctgtttgttgggcacatggattataagtatctacgttggcaggttgtagacactcctgggatcctggaccaccctctggaggataggaacaccatcgagatgcaggccatcactgccctggcccacctccgtgctgcggtcctgtatgtgatggatttgtctgagcagtgtgggcatgggctgagggagcagctagaactcttccagaacatcagacctctcttcatcaacaagcctctcatagttgtagccaacaaatgtgatgtgaagagaatagctgaactttctgaagatgatcagaaaatatttacagatttgcagtctgaaggattccctgtaatagagaccagcaccctgactgaggaaggtgttattaaagttaaaacagaggcttgcgataggcttttggctcatcgagtggaaaccaaaatgaagggaaataaagtgaatgaggtgctgaatagactgcacctggctatcccaaccaggagggacgataaggagaggccccctttcatccctgaaggagtggtggctcgcaggaagaggatggaaactgaggagtccaggaagaagagggaacgagatcttgagctggaaatgggagatgattatattttggatcttcagaagtactgggatttaatgaatttgtctgaaaaacatgataagataccagaaatctgggaaggccataatatagctgattatattgatccagccatcatgaagaaattggaagaattagaaaaagaagaagagctgagaacagctgctggagagtatgacagtgtatctgagagtgaagacgaagagatgctggaaatccgacagctggcaaagcaaattcgagagaaaaagaagttgaaaattctggagtccaaagaaaagaatacacagggacccaggatgccgcgaactgctaagaaggttcagaggacagttttggagaaggagatgcgtagtcttggtgttgacatggacgataaagacgatgcccattacgcagtccaggcaagaagatcccggagcatcactaggaaaagaaagcgggaagactctgctcccccgtcctctgtggcccggagtgggagttgctctcgaactccacgtgacgtttctggtcttagggatgtcaagatggtgaagaaagccaagactatgatgaagaatgctcagaagaagatgaatcggttggggaagaaaggggaggcggatagacacgtgtttgatatgaagcccaagcacttgctgtctgggaagaggaaagctggtaaaaaggacaggagatagtatccgtttggttggcgtggcttcgctagagtgttgctccaatgcggggaccgagctcgagtcgta

SEQ ID NO: 26375 - DNA, 1640 bp, Homo sapiens
agcggcccgcctactactactaaaatttccggccgcgtcgacctgagcagtgtgggcatgggctgagggagcagctagaactcttccagaacatcagacctctcttcatcaacaagcctctcatagttgtagccaacaaatgtgatgtgaagagaatagctgaactttctgaagatgatcagaaaatatttacagatttgcagtctgaaggattccctgtaatagagaccagcaccctgactgaggaaggtgttattaaagttaaaacagaggcttgcgataggcttttggctcatcgagtggaaaccaaaatgaagggaaataaagtgaatgaggtgctgaatagactgcacctggctatcccaaccaggagggacgataaggagaggccccctttcatccctgaaggagtggtggctcgcaggaagaggatggaaactgaggagtccaggaagaagagggaacgagatcttgagctggaaatgggagatgattatattttggatcttcagaagtactgggatttaatgaatttgtctgaaaaacatgataagataccagaaatctgggaaggccataatatagctgattatattgatccagccatcatgaagaaattggaagaattagaaaaagaagaagagctgagaacagctgctggagagtatgacagtgtatctgagagtgaagacgaagagatgctggaaatccgacagctggcaaagcaaattcgagagaaaaagaagttgaaaattctggagtccaaagaaaagaatacacagggacccaggatgccgcgaactgctaagaaggttcagaggacagttttggagaaggagatgcgtagtcttggtgttgacatggacgataaagacgatgcccattacgcagtccaggcaagaagatcccggagcatcactaggaaaagaaagcgggaagactctgctcccccgtcctctgtggcccggagtgggagttgctctcgaactccacgtgacgtttctggtcttagggatgtcaagatggtgaagaaagccaagactatgatgaagaatgctcagaagaagatgaatcggttggggaagaaaggggaggcggatagacacgtgtttgatatgaagcccaagcacttgctgtctgggaagaggaaagctggtaaaaaggacaggagatagtatccgtttggttggcgtggcttcgctagagtgttgctgtttatttcctggtttggcacagtatggtttcatgaaattggagctctgtataaactgaaaaagacaaaataagtaaagcacttgttgctttgctgaaaactatggttaaccctatataggtgtgggaaatttttgtcactgcataatattacaaatattttgagtagacagtgtttccacatttaatggagtatcagttgcttcagattttcagaactgggaagatttactggtgtaactgggttgtttttgatggagaaaaaccttattttcttttgtaagagctgggagcaaacacgtttatgagtgtgtcggaatcccgtgcttaaaatacgctcttaaattattttctagtcttattttacaatgtctcattgtagtctgtcttcaactattttatccaaaataaacctccagaagaaagta

SEQ ID NO: 26376 - DNA, 1437 bp, Homo sapiens
gggtgctggtctctattacaggaatccttcagactgactgaggaaggtgttattaaagttaaaacagaggcttgcgataggcttttggctcatcgagtggaaaccaaaatgaagggaaataaagtgaatgaggtgctgaatagactgcacctggctatcccaaccaggagggacgataaggagaggccccctttcatccctgaaggagtggtggctcgcaggaagaggatggaaactgaggagtccaggaagaagagggaacgagatcttgagctggaaatgggagatgattatattttggatcttcagaagtactgggatttaatgaatttgtctgaaaaacatgataagataccagaaatctgggaaggccataatatagctgattatattgatccagccatcatgaagaaattggaagaattagaaaaagaagaagagctgagaacagctgctggagagtatgacagtgtatctgagagtgaagacgaagagatgctggaaatccgacagctggcaaagcaaattcgagagaaaaagaagttgaaaattctggagtccaaagaaaagaatacacagggacccaggatgccgcgaactgctaagaaggttcagaggacagttttggagaaggagatgcgtagtcttggtgttgacatggacgataaagacgatgcccattacgcagtccaggcaagaagatcccggagcatcactaggaaaagaaagcgggaagactctgctcccccgtcctctgtggcccggagtgggagttgctctcgaactccacgtgacgtttctggtcttagggatgtcaagatggtgaagaaagccaagactatgatgaagaatgctcagaagaagatgaatcggttggggaagaaaggggaggcggatagacacgtgtttgatatgaagcccaagcacttgctgtctgggaagaggaaagctggtaaaaaggacaggagatagtatccgtttggttggcgtggcttcgctagagtgttgctgtttatttcctggtttggcacagtatggtttcatgaaattggagctctgtataaactgaaaaagacaaaataagtaaagcacttgttgctttgctgaaaactatggttaaccctatataggtgtgggaaatttttgtcactgcataatattacaaatattttgagtagacagtgtttccacatttaatggagtatcagttgcttcagattttcagaactgggaagatttactggtgtaactgggttgtttttgatggagaaaaaccttattttcttttgtaagagctgggagcaaacacgtttatgagtgtgtcggaatcccgtgcttaaaatacgctcttaaattattttctagtcttattttacaatgtctcattgtagtctgtcttcaactattttatccaaaataaacctccagaagaaagta

SEQ ID NO: 26377 - DNA, 1673 bp, Homo sapiens
  misc_feature (1658)..(1658): n is a, c, g, or t
gacagtggaagtcccacctgcgcccgacggcggaagttccgggagtgccaagtacccgcgtgcatacggctgccggcatggcacattacaacttcaagaaaattacggtggtgccgtccgccaaggacttcatagacctcacgttgtcgaagactcaacgaaagactccaaccgttattcataaacattaccaaatacatcgcattagacatttttacatgagaaaagtcaaatttactcaacagaattaccatgatagactttcacaaattctaacagatttccccaaattggatgatattcatccgttctatgctgatttgatgaatattctctacgacaaggatcattacaagttggctctggggcaaataaatattgccaaaaatttagtggacaatgttgctaaagattatgtgcgactgatgaagtatggcgactctctctaccgctgcaaacagctgaagcgtgcggccctgggacggatgtgcacagtgatcaagaggcagaagcagagtttggagtatttggagcaagtgcgtcagcatttatcccgtttgccaaccattgatccgaataccaggaccctgcttttgtgtgggtacccaaatgttgggaagtccagcttcatcaacaaggtgacgagagcagacgtggatgtccagccctatgcgttcacaaccaagtctctgtttgttgggcacatggattataagtatctacgttggcaggttgtagacactcctgggatcctggaccaccctctggaggataggaacaccatcgagatgcaggccatcactgccctggcccacctccgtgctgcggtcctgtatgtgatggatttgtctgagcagtgtgggcatgggctgagggagcagctagaactcttccagaacatcagacctctcttcatcaacaagcctctcatagttgtagccaacaaatgtgatgtgaagagaatagctgaactttctgaagatgatcagaaaatatttacagatttgcagtctgaaggattccctgtaatagagaccagcaccctgactgaggaaggtgttattaaagttaaaacagaggcttgcgataggcttttggctcatcgagtggaaaccaaaatgaagggaaataaagtgaatgaggtgctgaatagactgcacctggctatcccaaccaggagggacgataaggagaggccccctttcatccctgaaggagtggtggctcgcaggaagaggatggaaactgaggagtccaggaagaagagggaacgagatcttgagctggaaatgggagatgattatattttggatcttcagaagtactgggatttaatgaatttgtctgaaaaacatgataagataccagaaatctgggaaggccataatatagctgattatattgatccagccatcatgaagaaattggaagaattagaaaaagaagaagagctgagaacagctgctggagagtatgacagtgtatctgagagtgaagacgaagagatgctggaaatccgacagctggcaaagcaaattcgagagaaaaagaagttgaaaattctggagtccaaagaaaagaatacacagggacccaggatgccgcgaactgctaagaagagagggcactggttttgagcctggggacacgatgaccanaaccactgggaagat

SEQ ID NO: 26378 - DNA, 1119 bp, Homo sapiens
  misc_feature (15)..(15): n is a, c, g, or t
agctgaaactcgagncggacccgcatggagcacactcactgactcagggttttctcattgttaatttgcttcattacaactccatttttaaagaaattggaagaattagaaaaagaagaagagctgagaacagctgctggagagtatgacagtgtatctgagagtgaagacgaagagatgctggaaatccgacagctggcaaagcaaattcgagagaaaaagaagttgaaaattctggagtccaaagaaaagaatacacagggacccaggatgccgcgaactgctaagaaggttcagaggacagttttggagaaggagatgcgtagtcttggtgttgacatggacgataaagacgatgcccattacgcagtccaggcaagaagatcccggagcatcactaggaaaagaaagcgggaagactctgctcccccgtcctctgtggcccggagtgggagttgctctcgaactccacgtgacgtttctggtcttagggatgtcaagatggtgaagaaagccaagactatgatgaagaatgctcagaagaagatgaatcggttggggaagaaaggggaggcggatagacacgtgtttgatatgaagcccaagcacttgctgtctgggaagaggaaagctggtaaaaaggacaggagatagtatccgtttggttggcgtggcttcgctagagtgttgctgtttatttcctggtttggcacagtatggtttcatgaaattggagctctgtataaactgaaaaagacaaaataagtaaagcacttgttgctttgctgaaaactatggttaaccctatataggtgtgggaaatttttgtcactgcataatattacaaatattttgagtagacagtgtttccacatttaatggagtatcagttgcttcagattttcagaactgggaagatttactggtgtaactgggttgtttttgatggagaaaaaccttattttcttttgtaagagctgggagcaaacacgtttatgagtgtgtcggaatcccgtgcttaaaatacgctcttaaattattttctagtcttattttacaatgtctcattgtagtctgtcttcaactattttatccaaaataaacctccagaagaaagta

SEQ ID NO: 26379 - DNA, 1348 bp, Homo sapiens
gacagtggaagtcccacctgcgcccgacggcggaagttccgggagtgccaagtacccgcgtgcatacggctgccggcatggcacattacaacttcaagaaaattacggtggtgccgtccgccaaggacttcatagacctcacgttgtcgaagactcaacgaaagactccaaccgttattcataaacattaccaaatacatcgcattagacatttttacatgagaaaagtcaaatttactcaacagaattaccatgatagactttcacaaattctaacagatttccccaaattggatgatattcatccgttctatgctgatttgatgaatattctctacgacaaggatcattacaagttggctctggggcaaataaatattgccaaaaatttagtggacaatgttgctaaagattatgtgcgactgatgaagtatggcgactctctctaccgctgcaaacagctgaagcgtgcggccctgggacggatgtgcacagtgatcaagaggcagaagcagagtttggagtatttggagcaagtgcgtcagcatttatcccgtttgccaaccattgatccgaataccaggaccctgcttttgtgtgggtacccaaatgttgggaagtccagcttcatcaacaaggtgacgagagcagacgtggatgtccagccctatgcgttcacaaccaagtctctgtttgttgggcacatggattataagtatctacgttggcaggttgtagacactcctgggatcctggaccaccctctggaggataggaacaccatcgagatgcaggccatcactgccctggcccacctccgtgctgcggtcctgtatgtgatggatttgtctgagcagtgtgggcatgggctgagggagcagctagaactcttccagaacatcagacctctcttcatcaacaagcctctcatagttgtagccaacaaatgtgatgtgaagagaatagctgaactttctgaagatgatcagaaaatatttacagatttgcagtctgaaggattccctgtaatagagaccagcaccctgactgaggaaggtgttattaaagttaaaacagaggcttgcgataggcttttggctcatcgagtggaaaccaaaatgaagggaaataaagtgaatgaggtgctgaatagactgcacctggctatcccaaccaggagggacgataaggagaggccccctttcatccctgaaggagtggtggctcgcaggaagaggatggaaactgaggagtccaggaagaagagggaacgagatcttgagctggaaatgggagatgattatattttggatcttcagaagtactgggatttaatgaatttgtctga

SEQ ID NO: 26380 - DNA, 1459 bp, Homo sapiens
gacagtggaagtcccacctgcgcccgacggcggaagttccgggagtgccaagtacccgcgtgcatacggctgccggcatggcacattacaacttcaagaaaattacggtggtgccgtccgccaaggacttcatagacctcacgttgtcgaagactcaacgaaagactccaaccgttattcataaacattaccaaatacatcgcattagacatttttacatgagaaaagtcaaatttactcaacagaattaccatgatagactttcacaaattctaacagatttccccaaattggatgatattcatccgttctatgctgatttgatgaatattctctacgacaaggatcattacaagttggctctggggcaaataaatattgccaaaaatttagtggacaatgttgctaaagattatgtgcgactgatgaagtatggcgactctctctaccgctgcaaacagctgaagcgtgcggccctgggacggatgtgcacagtgatcaagaggcagaagcagagtttggagtatttggagcaagtgcgtcagcatttatcccgtttgccaaccattgatccgaataccaggaccctgcttttgtgtgggtacccaaatgttgggaagtccagcttcatcaacaaggtgacgagagcagacgtggatgtccagccctatgcgttcacaaccaagtctctgtttgttgggcacatggattataagtatctacgttggcaggttgtagacactcctgggatcctggaccaccctctggaggataggaacaccatcgagatgcaggccatcactgccctggcccacctccgtgctgcggtcctgtatgtgatggatttgtctgagcagtgtgggcatgggctgagggagcagctagaactcttccagaacatcagacctctcttcatcaacaagcctctcatagttgtagccaacaaatgtgatgtgaagagaatagctgaactttctgaagatgatcagaaaatatttacagatttgcagtctgaaggattccctgtaatagagaccagcaccctgactgaggaaggtgttattaaagttaaaacagaggcttgcgataggcttttggctcatcgagtggaaaccaaaatgaagggaaataaagtgaatgaggtgctgaatagactgcacctggctatcccaaccaggagggacgataaggagaggccccctttcatccctgaaggagtggtggctcgcaggaagaggatggaaactgaggagtccaggaagaagagggaacgagatcttgagctggaaatgggagatgattatattttggatcttcagaagtactgggattacaggcgtgagctactgcgcccggcctaagctaagtgttttaatacatgacctcactgacatttcacagtaggcctgtgaagtatagcatgcagaagagctacagataaatttagggcccggagata

SEQ ID NO: 26381 - DNA, 1384 bp, Homo sapiens
gacagtggaagtcccacctgcgcccgacggcggaagttccgggagtgccaagtacccgcgtgcatacggctgccggcatggcacattacaacttcaagaaaattacggtggtgccgtccgccaaggacttcatagacctcacgttgtcgaagactcaacgaaagactccaaccgttattcataaacattaccaaatacatcgcattagacatttttacatgagaaaagtcaaatttactcaacagaattaccatgatagactttcacaaattctaacagatttccccaaattggatgatattcatccgttctatgctgatttgatgaatattctctacgacaaggatcattacaagttggctctggggcaaataaatattgccaaaaatttagtggacaatgttgctaaagattatgtgcgactgatgaagtatggcgactctctctaccgctgcaaacagctgaagcgtgcggccctgggacggatgtgcacagtgatcaagaggcagaagcagagtttggagtatttggagcaagtgcgtcagcatttatcccgtttgccaaccattgatccgaataccaggaccctgcttttgtgtgggtacccaaatgttgggaagtccagcttcatcaacaaggtgacgagagcagacgtggatgtccagccctatgcgttcacaaccaagtctctgtttgttgggcacatggattataagtatctacgttggcaggttgtagacactcctgggatcctggaccaccctctggaggataggaacaccatcgagatgcaggccatcactgccctggcccacctccgtgctgcggtcctgtatgtgatggatttgtctgagcagtgtgggcatgggctgagggagcagctagaactcttccagaacatcagacctctcttcatcaacaagcctctcatagttgtagccaacaaatgtgatgtgaagagaatagctgaactttctgaagatgatcagaaaatatttacagatttgcagtctgaaggattccctgtaatagagaccagcaccctgactgaggaaggtgttattaaagttaaaacagaggcttgcgataggcttttggctcatcgagtggaaaccaaaatgaagggaaataaagtgaatgaggtgctgaatagactgcacctggctatcccaaccaggagggacgataaggtaagacggcccctgggacagccgtgggctcacagtactgtcagcaggtgctgtctgcgtgccttttccagaagcctcccatccagcttcacacactcgcaggtggatattgtgggtgggcctcagtttcaccttcttgcttacataaaggatcgagaaggtgaagaaagtgcagaacgccacatggcacccgt

SEQ ID NO: 26382 - DNA, 381 bp, Homo sapiens
ccgcctcggcctcccagagtgctgggattacaggtgtgagccaccgcacccagccctacttttttttttttttaactacaattctgctgtaagattattaggtctggttgggtgtgtgtgagtgacttctgggatgtgctggacaagaagcttgtgggtgagtgtgctttcagtgacaaggtctggctgtgttaggttgtagacactcctgggatcctggaccaccctctggaggataggaacaccatcgagatgcaggccatcactgccctggcccacctccgtgctgcggtcctgtatgtgatggatttgtctgagcagtgtgggcatgggctgagggagcagctagaactcttccagaacatcagacctctcttcatc

SEQ ID NO: 26383 - DNA, 1308 bp, Homo sapiens
atccaatgctcctggagatttatggctatcccaaccaggagggacgataaggagaggccccctttcatccctgaaggagtggtggctcgcaggaagaggatggaaactgaggagtccaggaagaagagggaacgagatcttgagctggaaatgggagatgattatattttggatcttcagaagtactgggatttaatgaatttgtctgaaaaacatgataagataccagaaatctgggaaggccataatatagctgattatattgatccagccatcatgaagaaattggaagaattagaaaaagaagaagagctgagaacagctgctggagagtatgacagtgtatctgagagtgaagacgaagagatgctggaaatccgacagctggcaaagcaaattcgagagaaaaagaagttgaaaattctggagtccaaagaaaagaatacacagggacccaggatgccgcgaactgctaagaaggttcagaggacagttttggagaaggagatgcgtagtcttggtgttgacatggacgataaagacgatgcccattacgcagtccaggcaagaagatcccggagcatcactaggaaaagaaagcgggaagactctgctcccccgtcctctgtggcccggagtgggagttgctctcgaactccacgtgacgtttctggtcttagggatgtcaagatggtgaagaaagccaagactatgatgaagaatgctcagaagaagatgaatcggttggggaagaaaggggaggcggatagacacgtgtttgatatgaagcccaagcacttgctgtctgggaagaggaaagctggtaaaaaggacaggagatagtatccgtttggttggcgtggcttcgctagagtgttgctgtttatttcctggtttggcacagtatggtttcatgaaattggagctctgtataaactgaaaaagacaaaataagtaaagcacttgttgctttgctgaaaactatggttaaccctatataggtgtgggaaatttttgtcactgcataatattacaaatattttgagtagacagtgtttccacatttaatggagtatcagttgcttcagattttcagaactgggaagatttactggtgtaactgggttgtttttgatggagaaaaaccttattttcttttgtaagagctgggagcaaacacgtttatgagtgtgtcggaatcccgtgcttaaaatacgctcttaaattattttctagtcttattttacaatgtctcattgtagtctgtcttcaactattttatccaaaataaacctccagaagaaagta

SEQ ID NO: 26384 - DNA, 1648 bp, Homo sapiens
gacagtggaagtcccacctgcgcccgacggcggaagttccgggagtgccaagtacccgcgtgcatacggctgccggcatggcacattacaacttcaagaaaattacggtggtgccgtccgccaaggacttcatagacctcacgttgtcgaagactcaacgaaagactccaaccgttattcataaacattaccaaatacatcgcattagacatttttacatgagaaaagtcaaatttactcaacagaattaccatgatagactttcacaaattctaacagatttccccaaattggatgatattcatccgttctatgctgatttgatgaatattctctacgacaaggatcattacaagttggctctggggcaaataaatattgccaaaaatttagtggacaatgttgctaaagattatgtgcgactgatgaagtatggcgactctctctaccgctgcaaacagctgaagcgtgcggccctgggacggatgtgcacagtgatcaagaggcagaagcagagtttggagtatttggagcaagtgcgtcagcatttatcccgtttgccaaccattgatccgaataccaggaccctgcttttgtgtgggtacccaaatgttgggaagtccagcttcatcaacaaggtgacgagagcagacgtggatgtccagccctatgcgttcacaaccaagtctctgtttgttgggcacatggattataagtatctacgttggcaggttgtagacactcctgggatcctggaccaccctctggaggataggaacaccatcgagatgcaggccatcactgccctggcccacctccgtgctgcggtcctgtatgtgatggatttgtctgagcagtgtgggcatgggctgagggagcagctagaactcttccagaacatcagacctctcttcatcaacaagcctctcatagttgtagccaacaaatgtgatgtgaagagaatagctgaactttctgaagatgatcagaaaatatttacagatttgcagtctgaaggattccctgtaatagagaccagcaccctgactgaggaaggtgttattaaagttaaaacagaggcttgcgataggcttttggctcatcgagtggaaaccaaaatgaagggaaataaagtgaatgaggtgctgaatagactgcacctggctatcccaaccaggagggacgataaggagaggccccctttcatccctgaaggagtggtggctcgcaggaagaggatggaaactgaggagtccaggaagaagagggaacgagatcttgagctggaaatgggagatgattatattttggatcttcagaagtactgggatttaatgaatttgtctgaaaaacatgataagataccagaaatctgggaaggccataatatagctgattatattgatccagccatcatgaagaaattggaagaattagaaaaagaagaagagctgagaacagctgctggagagtatgacagtgtatctgagagtgaagacgaagagatgctggaaatccgacagctggcaaagcaaattcgagagaaaaagaagttgaaaattctggagtccaaagaaaagaatacacagggacccaggatgccgcgaactgctaagaagagtctgaagcgtcatggaggtgccggctc

SEQ ID NO: 26385 - DNA, 1706 bp, Homo sapiens
gacagtggaagtcccacctgcgcccgacggcggaagttccgggagtgccaagtacccgcgtgcatacggctgccggcatggcacattacaacttcaagaaaattacggtggtgccgtccgccaaggacttcatagacctcacgttgtcgaagactcaacgaaagactccaaccgttattcataaacattaccaaatacatcgcattagacatttttacatgagaaaagtcaaatttactcaacagaattaccatgatagactttcacaaattctaacagatttccccaaattggatgatattcatccgttctatgctgatttgatgaatattctctacgacaaggatcattacaagttggctctggggcaaataaatattgccaaaaatttagtggacaatgttgctaaagattatgtgcgactgatgaagtatggcgactctctctaccgctgcaaacagctgaagcgtgcggccctgggacggatgtgcacagtgatcaagaggcagaagcagagtttggagtatttggagcaagtgcgtcagcatttatcccgtttgccaaccattgatccgaataccaggaccctgcttttgtgtgggtacccaaatgttgggaagtccagcttcatcaacaaggtgacgagagcagacgtggatgtccagccctatgcgttcacaaccaagtctctgtttgttgggcacatggattataagtatctacgttggcaggttgtagacactcctgggatcctggaccaccctctggaggataggaacaccatcgagatgcaggccatcactgccctggcccacctccgtgctgcggtcctgtatgtgatggatttgtctgagcagtgtgggcatgggctgagggagcagctagaactcttccagaacatcagacctctcttcatcaacaagcctctcatagttgtagccaacaaatgtgatgtgaagagaatagctgaactttctgaagatgatcagaaaatatttacagatttgcagtctgaaggattccctgtaatagagaccagcaccctgactgaggaaggtgttattaaagttaaaacagaggcttgcgataggcttttggctcatcgagtggaaaccaaaatgaagggaaataaagtgaatgaggtgctgaatagactgcacctggctatcccaaccaggagggacgataaggagaggccccctttcatccctgaaggagtggtggctcgcaggaagaggatggaaactgaggagtccaggaagaagagggaacgagatcttgagctggaaatgggagatgattatattttggatcttcagaagtactgggatttaatgaatttgtctgaaaaacatgataagataccagaaatctgggaaggccataatatagctgattatattgatccagccatcatgaaggtttgtgtcactttttaaattgcggattgttttcctttttattatagtagtattgctggaagatagcagcatggcttcggctcagctgggcctgtccgcttcattctcctgcatccctccatcctgactctgccccctacaccaccttccccaccccgagactctggtggagatgctgggcctcttcattctcctgcacccctccatcctgactgtgcctcctgcaccaccttcccccccaccctgtgtctccgccaggccctgggatgggcttctgctgtgctg

SEQ ID NO: 26386 - DNA, 578 bp, Homo sapiens
cttgcaggtgctttgctacagatctgtgtggtcttcatgatggccggggtgccaccctggagccgtgtttgttacagacgaggtggcagagtggcagtaacccatgttgtagcccaaacggcatggcctgcaggcttcaaagtgcactggttccctaatgtcatcttgctaatgagaattgtctggacactgccagacatgctgttggccccacctgtcacctaatgaattaaaacgtgggcttagaagggctgaggaatatgattcttaccagagccaaacttgggagatagcaattgaatatactatgtgtatactattactttctgcaactattttctccatcacttttgcattacaaaagttggagtaagatgaatatcaccacaggcctggactgtaactaagttgaaaagaaaatttaaagcaaatcttaaactttgaatttcttaatttttcaatttgaacttttcctagtgcgtcagcatttatcccgtttgccaaccattgatccgaataccaggaccctgcttttgtgtgggtacccaaatgttgggaagtccagcttcatcaacaag

SEQ ID NO: 26387 - DNA, 423 bp, Homo sapiens
gttagcacaggaggataaggttgagcctaacccagctgggggctggaaggagtaagagttagcctggcaaagaaaaagaaagggcttttctggcaaagggaacactgtgtataggcactgagattaaagataacccagcagtgaaagtggagagataagcaaggaccagctcacaaggagctcatatgccatgctagggaatttggaatttattctgtagaccactgaagaatttaagtcttattaatggacatctaataccatgtagcaaggccacagttaaaaatacatatggggcccctactatgaactagatggtaagaactcaatggtgaagcaaacagacatgatttctgcaatcaacgtccctaatgtaaatgattttacaataaaaaaaattgtaaattataataaatgctatga

SEQ ID NO: 26388 - DNA, 3203 bp, Homo sapiens
ctttagcgtgcatcagaatcacctgtagggcttgttaaaacactaattgctgggcctcaacccaaaagcccccaaagtggcacttctgagttcctgctgatgttacaagggaccacacttttgagaatctgtgctttaagctaaggaaatattgcctggtgggttggctgcctggtattgggcatggaaatttgaattgctgattggtagatggtgtgtctggacttaactcacgtagtaaatactgctgatcaatacctaatcattccacatttattgagctccacctgtgtgtatgtgtacccaagcacacatgtgtgaagggctatagccaaagtatttttactagcctgtatgaaatcactagtccttatttttaaaggtctatggtttcttggaagtagtttgattgttgagagagacctttgatctgcagtgtaaatctaccagtcatgggccagaagggcaaaagcccagctttctctttggaaagactcaggctgtggttgttgatggccaggttttcctcaggctccaacaactgtgcttataccaagcagatcctcatcctccatataatcatctttgttattcgtgggggtttaattacattacaagtggccaaaacccctgttctcagtgaagaaccacattggatttgtattctgttcagttgtagtctacactgcagtcttattcctggttcaaactacctctttaaattgatttgtcttgtgctggtctgttaaatcctgccctccttggtgctagatccagttgtgcctcagggcagaggaaacaaaacacagctatcctgttggcctgtgttgtggttttgaagtttgtactttctctgtgggtgccagttaaatattggagagcaaggaatgtggacttgtatggctttgaaccaagagagggttatgagcctactggattgaggttaaaatccaagaaccaacatttagagctttgtgcttttctctcattccatcactttgtaatgatgatacttaacatgagcagggtgaatgacaggtactgacgaagtccaacacaaaggtataatacagcctgttgtctaaagccaaggagtcataaaaccatgagaaataaataggaatcaatagttagtagtgacattggtgctctctagaaatctcagcatgagctgctatagaataccctcccagcaacaaaacctaatcagtaaggccagctagacccaatggctcatgcctgtaatcccaacactttgggaggccaaggtgggaggatggcttgtgtccagaagttcgagaccagcctggacaacatagtgagatcctatctctataaaaaatcaaaaattagccaggcatggtggtgcatacctatagtcctggctatttgggaggctgaggcaggaggattgctttagccctggaggtcgaggctgcagtaagccatgattgcgccactgcactcagcccgggtgacaaagcaagaccctgtctcagaaaaaaagaaaattcaaggccagttaagacaaaatgctatgactttgaaattcacagaaagaaataacagtttagattaggtcttcaggtattcaggatagagataatctcctgaaaaacctgaatttcagagattcttagactggctgccaaaggatgaagctagtgaaggagaaaaagcttaaattccatcttgagctcttggattgtgataatacaatgatttcattaacttttcatttctgtatacctgttcatttggaatttaatgcttgacttctttgttcattttggatctaaacttctcttttcttccttccccattcacatctattagaagactgcatcaccatttctttggcccccttactctgttgtcctttcccttttctttcagtttttttaatcgcatgtctagtatattaagtctccatagccctcctgatgcagtagacagtgctatgctgtggatataataccaaccagaaattggcatttataaacctgttaagagactttaagcatgcttcaagaggcagttgacccactggaatttctataaggctggtacccttcccagagttacagaatcttaggtgccgtctctagtctgtgagggaggaactcccagcatccccattgcccacaaatggaatcctcactgtatccactaggagattagaaattaaggtttcttcactacttctatggtagggttgtctgaaattccctttcaggctgtgggtactggtcttgggttctagtcataaggggttccttataaggagcaggcggaggggagtacactttcatgtgatttaattttgatcctgccctctccagctgctccttcaaaagatacatcaaaagatagaaactctgggctgggcacagtggctcacacactttgggaggccaagcgggggtgcagatcacctgaggtcaggagtttgagaccagcctggccaatgtggtgaaaccccatctctactaaaaatacaaaaattagctgggcgtggtggtgcatgcctgtaatcccagctactcgggaggctgaggcaggagaatcgcttgaacccaggaggcggaggttgcagtgagccaagatggcgccattgcactccagcctgggcgacaagagcaaaactccgtctcaaaaaaaaaaaaaagatacaaagtctgcatttgatataatgccttaattactgggtctacaattaatgttgactgttttagattgtaagctcctggagagcagtattgctgtagtaggaatgttttaacagtgtcatatgaaaaagaacaaaataaatattttgattttgtgattctatgcaagtctttctgcccagagtgataatgcaataagctagtcttttcatagtctgcatagagtctggccattaccatcagtttttaagatgtccatattgtggccgggcgcggtggctcacgcctggtaatcccagcactttgggaggctgaggcaggtggatcatgaggtcaggagatcgagaccatcctggctaacacggtgaaacccgtctctactaaaaaaaatattaaaaaattagccaggcctggtggtgggcgcctgtagtcccagctacttgggaggctgaggcaggagaatggtgtgaacccggaagtcagaggttgcagtgagccaagattgcacctgggcaacacagcgagactccgtct

SEQ ID NO: 26389 - DNA, 3145 bp, Homo sapiens
ctttagcgtgcatcagaatcacctgtagggcttgttaaaacactaattgctgggcctcaacccaaaagcccccaaagtggcacttctgagttcctgctgatgttacaagggaccacacttttgagaatctgtgctttaagctaaggaaatattgcctggtgggttggctgcctggtattgggcatggaaatttgaattgctgattggtagatggtgtgtctggacttaactcacgtagtaaatactgctgatcaatacctaatcattccacatttattgagctccacctgtgtgtatgtgtacccaagcacacatgtgtgaagggctatagccaaagtatttttactagcctgtatgaaatcactagtccttatttttaaaggtctatggtttcttggaagtagtttgattgttgagagagacctttgatctgcagtgtaaatctaccagtcatgggccagaagggcaaaagcccagctttctctttggaaagactcaggctgtggttgttgatggccaggttttcctcaggctccaacaactgtgcttataccaagcagatcctcatcctccatataatcatctttgttattcgtgggggtttaattacattacaagtggccaaaacccctgttctcagtgaagaaccacattggatttgtattctgttcagttgtagtctacactgcagtcttattcctggttcaaactacctctttaaattgatttgtcttgtgctggtctgttaaatcctgccctccttggtgctagatccagttgtgcctcagggcagaggaaacaaaacacagctatcctgttggcctgtgttgtggttttgaagtttgtactttctctgtgggtgccagttaaatattggagagcaaggaatgtggacttgtatggctttgaaccaagagagggttatgagcctactggattgaggttaaaatccaagaaccaacatttagagctttgtgcttttctctcattccatcactttgtaatgatgatacttaacatgagcagggtgaatgacaggtactgacgaagtccaacacaaaggtataatacagcctgttgtctaaagccaaggagtcataaaaccatgagaaataaataggaatcaatagttagtagtgacattggtgctctctagaaatctcagcatgagctgctatagaataccctcccagcaacaaaacctaatcagtaaggccagctagacccaatggctcatgcctgtaatcccaacactttgggaggccaaggtgggaggatggcttgtgtccagaagttcgagaccagcctggacaacatagtgagatcctatctctataaaaaatcaaaaattagccaggcatggtggtgcatacctatagtcctggctatttgggaggctgaggcaggaggattgctttagccctggaggtcgaggctgcagtaagccatgattgcgccactgcactcagcccgggtgacaaagcaagaccctgtctcagaaaaaaagaaaattcaaggccagttaagacaaaatgctatgactttgaaattcacagaaagaaataacagtttagattaggtcttcaggtattcaggatagagataatctcctgaaaaacctgaatttcagagattcttagactggctgccaaaggatgaagctagtgaaggagaaaaagcttaaattccatcttgagctcttggattgtgataatacaatgatttcattaacttttcatttctgtatacctgttcatttggaatttaatgcttgacttctttgttcattttggatctaaacttctcttttcttccttccccattcacatctattagaagactgcatcaccatttctttggcccccttactctgttgtcctttcccttttctttcagtttttttaatcgcatgtctagtatattaagtctccatagccctcctgatgcagtagacagtgctatgctgtggatataataccaaccagaaattggcatttataaacctgttaagagactttaagcatgcttcaagaggcagttgacccactggaatttctataaggctggtacccttcccagagttacagaatcttaggtgccgtctctagtctgtgagggaggaactcccagcatccccattgcccacaaatggaatcctcactgtatccactaggagattagaaattaaggtttcttcactacttctatggtagggttgtctgaaattccctttcaggctgtgggtactggtcttgggttctagtcataaggggttccttataaggagcaggcggaggggagtacactttcatgtgatttaattttgatcctgccctctccagctgctccttcaaaagatacatcaaaagatagaaactctgggctgggcacagtggctcacacactttgggaggccaagcgggggtgcagatcacctgaggtcaggagtttgagaccagcctggccaatgtggtgaaaccccatctctactaaaaatacaaaaattagctgggcgtggtggtgcatgcctgtaatcccagctactcgggaggctgaggcaggagaatcgcttgaacccaggaggcggaggttgcagtgagccaagatggcgccattgcactccagcctgggcgacaagagcaaaactccgtctcaaaaaaaaaaaaaagatacaaagtctgcatttgatataatgccttaattactgggtctacaattaatgttgactgttttagattgtaagctcctggagagcagtattgctgtagtaggaatgttttaacagtgtcatatgaaaaagaaagggcttttctggcaaagggaacactgtgtataggcactgagattaaagataacccagcagtgaaagtggagagataagcaaggaccagctcacaaggagctcatatgccatgctagggaatttggaatttattctgtagaccactgaagaatttaagtcttattaatggacatctaataccatgtagcaaggccacagttaaaaatacatatggggcccctactatgaactagatggtaagaactcaatggtgaagcaaacagacatgatttctgcaatcaacgtccctaatgtaaatgattttacaataaaaaaaattgtaaattataataaatgctatga

SEQ ID NO: 26390 - DNA, 1370 bp, Homo sapiens
ctttagcgtgcatcagaatcacctgtagggcttgttaaaacactaattgctgggcctcaacccaaaagcccccaaagtggcacttctgagttcctgctgatgttacaagggaccacacttttgagaatctgtgctttaagctaaggaaatattgcctggtgggttggctgcctggtattgggcatggaaatttgaattgctgattggtagatggtgtgtctggacttaactcacgtagtaaatactgctgatcaatacctaatcattccacatttattgagctccacctgtgtgtatgtgtacccaagcacacatgtgtgaagggctatagccaaagtatttttactagcctgtatgaaatcactagtccttatttttaaaggtctatggtttcttggaagtagtttgattgttgagagagacctttgatctgcagtgtaaatctaccagtcatgggccagaagggcaaaagcccagctttctctttggaaagactcaggctgtggttgttgatggccaggttttcctcaggctccaacaactgtgcttataccaagcagatcctcatcctccatataatcatctttgttattcgtgggggtttaattacattacaagtggccaaaacccctgttctcagtgaaaccccatctctactaaaaatacaaaaattagctgggcgtggtggtgcatgcctgtaatcccagctactcgggaggctgaggcaggagaatcgcttgaacccaggaggcggaggttgcagtgagccaagatggcgccattgcactccagcctgggcgacaagagcaaaactccgtctcaaaaaaaaaaaaaagatacaaagtctgcatttgatataatgccttaattactgggtctacaattaatgttgactgttttagattgtaagctcctggagagcagtattgctgtagtaggaatgttttaacagtgtcatatgaaaaagaacaaaataaatattttgattttgtgattctatgcaagtctttctgcccagagtgataatgcaataagctagtcttttcatagtctgcatagagtctggccattaccatcagtttttaagatgtccatattgtggccgggcgcggtggctcacgcctggtaatcccagcactttgggaggctgaggcaggtggatcatgaggtcaggagatcgagaccatcctggctaacacggtgaaacccgtctctactaaaaaaaatattaaaaaattagccaggcctggtggtgggcgcctgtagtcccagctacttgggaggctgaggcaggagaatggtgtgaacccggaagtcagaggttgcagtgagccaagattgcacctgggcaacacagcgagactccgtct

SEQ ID NO: 26391 - DNA, 818 bp, Homo sapiens
aaatagtaaccgtcttactgactggtaatcctgtttctgtgtacacagtgtaacctcatctccctcagtgttgtctgtgacaaagttgaaccaaacaggaacttctgtctcgtaagctttcttaggatctgtcagtgtcttgctgtccttgtgctgacttcctgcccagagatgagcccacaacattccgtggggtcaggagcgctgcgggctggctctgcccccagtcagtcccgggaaccgctctctgggctgtgcccacagccagcctcaggaaccacctccctgggctgtgctctgggcatttttcccttcgtgtggattttctttctttttttttcccctcccttattgcaaggctttatttattcataatttcaacttttattttagattcaggggatccacgtgcaggtttgtgacgtgggtagagtttctttggaatctggtatttggcacagggatagtcttgttgccctgtagccacttaaaaaaaacgggcatttaagtgcgctgatgaaatagtgaaatagcttgggcacagtggcccacctgtaatcccaacacttggggaggccgaggcaggtcgatcatttgcgcccaggagtttgagaccagcctggggaacacggcaaaaccctgtctctatataagataaaaaacaaaaattagctgggcgtgctagtgcgtgcctgtagtcccagctactcaggaggctgaggtgggaggatcacctgagcctgggagattgaggctgcagtgagccgtgatcctgccactgcgctccagcctgggcgacagagcaagagcctgcctct

SEQ ID NO: 26392 - DNA, 293 bp, Homo sapiens
taacattgaggaaaaactttgaatgtgggttccattcaattgtacaacaactcaatgtatacagcatcaacacttttaaaacattgagataaaatatttttgattttatcaaatttgatgtaatgctagaagaagaattcatactttgaagggactgtgataaatttaaggatttatttagttctgtttgcacttgctacatgctgtttccaatatgaatattttcacaagatttacatgtctaatacatgagttggctcctgaccttgaagcaattggtagtaatagataca

SEQ ID NO: 26393 - DNA, 337 bp, Homo sapiens
gtgtaccattgtgattgctaagaagaacacaatctatttagcaaacgtttttggcataaaaggaatgataattattacttgacttttatatccttatagagacctaagctaaatctctgacactgacaatattgactattagccagcttgttaacagtactagaaatgaatttggaagaagcaatttgataaattacacacccttttggcttttaccctccctttatatcagacttgtgactgactcagaatgatatttggggaggtgaaaaaaggtaaacatgtttgagaggaattagccatcagactagagtgtattcaaaaaagaagatttaag

SEQ ID NO: 26394 - DNA, 522 bp, Homo sapiens
cagtagcacttttcagtgaattggttttgtctgcagtaagcaggaaaaacctgcagtgccattcattcccatgagtggaaagttctttccatttagagcttaaggtgttgtcactttctccaagaagcaggtcttgcccttggcctggtgtggtggttcatggctgcaatcccagcacattgcggggcggaggcgggaggattgcttgagcccaggagttcaagaccagcctggacaacaaagtaagaatcagtctctaaattaaaaaataaaagtaatttttttttgtttttttgttttgagacagagtcttgcactatcacccaggctggagtgcagtggcaccgatctcggcttactgcaacgtccggctcccgggttcagacgattctcctgcctcactactcaggaggctgaggcaggagaatggcgggaatccggcaggcagagcttgcagtgagccgagattgcgccactgcactccagcctgggcaacagagcgagactctgtctcaaaaaacc

SEQ ID NO: 26395 - DNA, 452 bp, Homo sapiens
ctttcatacaaacacaataataatatgatataatgagtggttgttgagagaaattcttaacataaacctttgtcaaatacagttgctatagccaaagaaagaaatagttctatgtattgtaaatctctatttgaaatactatgccaaataaatgatgcaactcataatcgcacattagggctggttgcagtggctcatgcctgtaatctcatcactttgggaggccgaggcaggtggatcacgaggccaggagttcgagaccagcctagtcaacatggtgaaactccgactctaaactacaaaattagccaggcattgtggcaaacacctgttttccctgctactcaggaggctgaggcaggagaattgcttgaaaccagaaggtggaggttgtggttagctgagattgtgccaccacactccagcctgggcgaaagagtgaaactccatct

SEQ ID NO: 26396 - DNA, 365 bp, Homo sapiens
aatctcttagggcagcactaaggggaactccagcattggcagaggggaaggctgtgacccagggggacaggctgaggacctggggctggatgaagctgtgggtgagtgtagacaaagaagaaaagaggaccaaggacagtgccctgggtcctccaaggttaagggctcaagaaagaggccaggtgcagtggctcacgtctgtaatcccagcactttaggaggccgaagcaggcgggaccacttgagatcaggagttcaagaccagcctggccaatatagtgaaactccgtctctactaaaaatacaaaaaattagccaagtgtggtggcactcacctgtagtcccagctattcgggaggctgagg

SEQ ID NO: 26397 - DNA, 756 bp, Homo sapiens
atgaaagaggtcctaaatagatacctcatgttcatggattggaagacacaaaattgcattcaaaaccccagtaggattttttgtagatacagagtagctaattctaaaattcatatggaaggcaaagaaactaaattagccaaaacaattttgaaaaagatttcaaaaaaattttgaaggaatcatgctgcccagttttaagacttactataaagctgtgataatcaaggcaatctggtatttatgaaaggataaacacatagatcaatggaataaagtccaaaaccagactcacataaatagcaattgatttctgacaaaggtgaaaagacaactcaatggggaatggagagtttttcaacagatgattttaaaacaactgaacatccatatgcaaaaaaataaacctacctaaatttcacagcttatacaaaaattaacctaaaatggatcacggatctaaatgtagaactaaatttataaaatttttagaagaaaaaaatccataggccgggcacggtggctcatgcctgtaatcccagcacttcagaggctgaggcgggcagatccgttgaggtcagttcaagaccagcctagcctatatggtgaaatcccaactctactaaaaataaaaaataaaaaaaaaatgggctgggagtggtggtgcacacctgtagtcccagctacttgggagactgaagcacaagaatcacttgaacccagcaggcagaggttgcagtgagtggagattgtgcc

SEQ ID NO: 26398 - DNA, 416 bp, Homo sapiens
ctacatataccctgtgtgaatgaagtcataatgccattgccccatttctgttttctataaattgctgaactattcattattacttttaagcctgctgcagaacctctccccatgcagagctaccaccactgctactctgacttcttttcattctattataaattacagagctactaaccaaacacttcatgtctttttccggtgtcctggtgttaacgagtcatctctgtgattttacttttgtgatttagatggttgaattctgatcattgttgcagggaaggacaatttctttcttttttttttttttaaacacaatttttttttaaagataacaaaaaaacatttactgtgttgaagaaagtcgtctttatataaaaggggtttaccatatttcaggcaaaattcagtgaaaa

SEQ ID NO: 26399 - DNA, 232 bp, Homo sapiens
attatgttgggaatggttatagactcatttagctctggaaacccatcaagcaggaatgttgaatcatgaaactagggttggccaaatattacacttgttataattaatttgagcttaagcttcaacacagtgacatgtttcctttaaataaagttaagtcctctaaggatgcatgaatctatatggatctcgattttcagctgggaactgaaatttttcagatatgcagaat

SEQ ID NO: 26400 - DNA, 411 bp, Homo sapiens
ttttttttttttgagacagcatcttgctccgtcacccagactggagtgcaatggcgtgaccagggctcactgtaccctcaacttcctgggcacaaggaatccacctcccagtctcctgagtagatgggaccacaggcatgcaccaggatgcccagctgattttttttaactgttttttatacagatggggtttcactacgttgccagggctggtctcgaactcttaggctcaagcgatcctcccaccttggcctcccagtgtgctgagataataggcatgagcaccatgcctgggcccttgaattctgaaatttgaaaaacttgtactgccgtgcctatttttaggctgacataaagttttcatcctcaactacacaatttctaaggatacaattttcagcatattgtaaa

SEQ ID NO: 26401 - DNA, 398 bp, Homo sapiens
ggagacagagtttcactcttgctgcccgggctggagtgcaataacacgatctcagctcactgcaacctccgcctcctgagttcaagtgattctcctgcctcagcctcctgagaagctggcattacaggtgcccaccaccacgcccagctaatttttttgtgaatacctactatctactaagcaatgttctcaatgctgggaatacagtttatcaaagctgataaaagtccatttaatggagcaatttaattctaatgcagaaaaagaagtacaatgtttagtatgacagaaataagagacaagggccagatgcagtggctcccacctgtaatcccatcactttgggaagctgaggtgaaaggatcgcttgaggccaggagttcaagaccagcctgggc

SEQ ID NO: 26402 - DNA, 436 bp, Homo sapiens
gttcgacggcgattctcctgcctcagccttccaagcggctgggattgcaggcgcgcatcaccatgcccagcaaattttttgtatttttagtagggatagggtttcgctatgttggccaggctggtcttgagctcctgacctcaggtgatctgctcgcttcagcctcccaaagtcctgggattacaggcatgagccactgcacccggcctagaaaacatcattaaatagcaaacagtagcagtgtgcttggggattttaggattgattattttcaaatctctagaaaagctcaatgtattaccttaggctataatccctgggcagagtctcatctgttaatgggagctggtctaagggtccttccagctcccagattgatgatttcccaggttgatctgctccctgccacccacccatcctcggttttgtttgtttt

SEQ ID NO: 26403 - DNA, 672 bp, Homo sapiens
attttgttgatagtatcttttgaagcctgaagattcagaaagctgcagtggacccgaccaccaaacagtgaccatgacctttatttggtgcaagtttggctttgggaagtgctttggagctttttctcactccaaccactgagctagttgttgccagttgtcactttttgtcgcacatcacaatcagatcaagaaatggtttgtcgtgtagaataagagaagatgacacttcaaaacgaggattttttaattttcgctcagctcatgaggcacccacttagcgagattttcccagctttccaatttgcttcaaatgctaaagggctgtagaatcgtcaaggtttgagttctttggcaacttctcatgtggttgttagagaaacagcttcaatgattgctctcaaatggtcattgtggacttccgatgtctggccactatgctcctcatctacaaggatctcttttcctttgcaaaacttcttgaacttcttgaatgcactgtatgttcgttagcaattcctgagacaaatgctttgtttatatcgtgagttgtctgcgcttcttttacgacccattttgaactcaaataagaaaatcgcttggatttgtttttgtctaacatcatttccatagtctaaaataaacataaacagcaagtgatgtcattagcaa

SEQ ID NO: 26404 - DNA, 837 bp, Homo sapiens
attttataagcaatgctagcaaaaaaagacaacttaaaagattatggagaaaaaggcgtattttagatacaaaacacagattgagaaacacttaggggcaagaagtaatgcatcactggccagtgtaaatgaaccgtttaggcagtaaaatgtgtccaagcaagtggtgagtatatcctgttctcttttatatatctagacaagtgatttcaaacacccacgtggagccctgagaccctgggtgttcacctaatgtaagccccaatataggagctgaggtcaactaattgagggaatatgtccaacaatcaataagcaaattagaatgagctaactgtcacacattcttaccctcatccctttgctgcattaactgagcaaacagctctctctaactatgtaggaaaagtgtttagtactcaaataaaaaggtaaatttaataatctgcttaaggctgtatgaaaaaatgaagcaatgtgtatcaggtttcttcaaatatatgcatattgcaatccacccttatttaccctcgattgtaagagctaaaagcaggccgggcacggtggctcatgcctataatcccagcactttgggaggctgaggtgggcggatcacgaggtcaggagatcaagaccatcctggctaacatggtgaaccccgtctctattaaaaatacaaaaaaattagttgggtgtggcggcgggcgcctgtagtcccagctactcaggaggctgaggcaggagagtggcgtgaacccgggaggcagaggttgcagtgagccgagatcacaccactgtactccagcctgggcgacagaacgagactctgtctcaaga

SEQ ID NO: 26405 - DNA, 228 bp, Homo sapiens
gacactgccacctgctccctcacttctttgtgttacgtcatgctgtctgttcagtaatgcaaaatgctgaattcaaaatagacattaacttactaattcagcccaatgaaacatagtccacctaaaaaagagctcatagaagcttatttcaaatacgatggatacattcaacaaaatattggtatataccatgtccatactctgttagatgctgaggatatggcaatg

SEQ ID NO: 26406 - DNA, 1247 bp, Homo sapiens
tctcttcaggcgtgttaagcagcggggttggcctgtacttcctctggccctggctgaagagggctagtgaaaccgttaagcccctaggcgatcatggccttgagacctgaggaccccagtagtgggttccggcacggaaacgtggtggccttcatcatcgagaaaatggccaggcacacgaaaggccccgagttctacttcgagaatatatccttatcctgggaggaggtggaagacaagctcagggccatcctggaggacagcgaggtgcccagcgaggtcaaagaggcctgcacctggggcagcctggccttgggtgtgcgctttgcccacaggcaggggcagttacaaaaccgcagggtgcagtggctgcaaggctttgccaaactgcacagatcagctgcgctggtcttggcctcaaacctgacggaactcaaggaacagcaggagatggaatgcaatgaggcgaccttccagttgcagctaaccgagaccagccttgcggaggtgcagagagagcgggacatgctgagatggaagctcttccatgccgagctggcacctccccagggacagggccaggctacagtgtttccaggcctggccactgccggaggggattggacagaaggagcaggtgagcaggaaaaggaggcggtggctgctgctggtgctgctggaggaaaaggagaggagaggtatgcagaggcagggcctgcccccgcagaggtcttgcaggggctgggaggaggcttcaggcagcccctcggagctattgtagcaggcaaattacacctttgcggggcagagggagaaagatctcaggtcagtacaaacagccatgtctgtcttctctgggcttgggtccacagtctcactggagcctcttcctgtccagctccctacctcattcacatactcatacccatgccctttgtccgccttctcagccatacccaatatacccccttcaccagcaaaggtcacagaacgggttccaactcagatgcctttcaactggggggcctctgatgctagcctgtggtcagatgtggaggcccagggaatagaccctcaagagcccccaagagacaggagagactccgaactccatcagcagagaagacctccagtatatcgcaggccagggaactgggactgcccgtggtgtaaagctgtgaatttttcatggagggaaaattgcttcctctggggaggcgaatacggctgcaaaagcctcagtaaat

SEQ ID NO: 26407 - DNA, 405 bp, Homo sapiens
ttaatgatttctagcttaactgcaccgtggtcaaataacatactctgtaggatttcagtcctttaaaatttgttagtacttatttcatggccaaacatatagtctttttgtaaaatactcaatgtgcacttgaaaagaatgtgtatcctgccattcttggtttattgtgtggttaaaatcttttatattgttatttttcttttttgtgtttgtttgttagtaactgagagaggtgtgttagtctcccaagatgattgtggctttttccatttttcttcttagctctgtcaatttttgttctatttggaagctatgttattaggtccatacaaatttagcagttatatcttcttgatgaattgaatcttttgtcattaaaaagtgtcttcctttggcatcttgaat

SEQ ID NO: 26408 - DNA, 788 bp, Homo sapiens
ttttttttcaaggttcattcctgtattttaggctggaagcaatgtcttcatgaaatggccatgttgttatgtccgtgaacaaaatgaggcaatgtcatcactaggcaaaatttatgccaggttttaaaattgtgattcttaattggtataattcaagaattggatattactgggtgattctcagaaataaagacttgatagtcacctaagtatggcaaatgatggtctgaaaaagtttgagttttctttactggagagtgtctccaagctcggaagaagtagctctgtttgagggagggagtgtgccgtattttccagacttctttgaccagagaatcccttcatgaaaagatttcttctatggatcctgtcccaagaaggacacatggggacatgcccatccattggctgctgggattgacagtaacctaggaggctgaaggaagtgttttctggggaagcagggacaaactacagtaagatactctttaaaaattttgtggccaggtgcggtggctcacgcctgtaatcccagcacttggggaggccgaggcaggcagatcacgaggtcaggagatcaagaccatcctggctaacatggtgaaaccccgtctctactaaaagaaatacaaaaaaattagccgggcgtgggggcgggcacctgtagtcccagctactcaggaggctgaggcaggagaatgccgtgaatctgggagatggagcttgcagtgagctgagatcgtgccactgcactccagcctgggcgacagagtgagactccatcttaa

SEQ ID NO: 26409 - DNA, 500 bp, Homo sapiens
ggccaagattcggccggggttaagaattgttgctgtgaggtaggttttacgagactagtgaagaataatctagtatacagtaagaacaccatctttctttttcttttttcagaaaggacatttttggtaacaaaggccaggtaaccttttaatcctaaatggcaggaagctatgaaaataagtcagacataatcaaaggacaagttgttgcttggttttgtttaacatctgtacctttcttcaaaaggctttaaggcagcttccagcaaaagacagacatgtgtagtaccttctttgtagccttcccttcggttttcacagaaacactggctgataaaagccttttggaaagtgtggtaagttaagagcatctggcaaaaagaaaatcctaaaaaagtagtagaattgtattgaaaaaattctgattcattgctgatcttttaaaatctcttttgtaattgtgtctctattccttactcaacctgcaaaatgttaaaaaa

SEQ ID NO: 26410 - DNA, 636 bp, Homo sapiens
cacatgtgtatgtgtgcacttttttcaataaggtcacaaatggatctgtgactcctaaatatttaataacgatgactataaagatatttcactaaattatttgtatgtaactcttctatgagatcgaacagcagactctgaaagcactggtcttaggagtttcagagatactcataagctatataatttttcactttgtttttagtaggtatgtagaattggttaaaataaactttcttactgaatgtatttacagactggatttttccaactaccacatggagactttttcattgaacccgtgaagaagcatccactggttgagggagggtaccacccgcacatcgtttacaggaggcagaaagttccagaaaccaaggagccaacctgtggattaaagggtattgtgactcacatgtcctcctgggttgaagaatctgttttgttcttttggtagttttattaaaacatgacctattcttactcaagtctcttatctcctctgtattcttttttttttaatatcttcatgacattcaaatctcttctgtattctcttgccagaaagtgtacattctttttgcttgtataaaccctttcacttgtcaatactcgagtctctgcatattcttaatg

SEQ ID NO: 26411 - DNA, 483 bp, Homo sapiens
cacatgtgtatgtgtgcacttttttcaataaggtcacaaatggatctgtgactcctaaatatttaataacgatgactataaagatatttcactaaattatttgtatgtaactcttctatgagatcgaacagcagactctgaaagcactggtcttaggagtttcagagatactcataagctatataatttttcactttgtttttagtaggtatgtagaattggttaaaataaactttcttactgaatgtatttacagactggatttttccaactaccacatggagactttttcattgaacccgtgaagaagcatccactggttgagggagggtaccacccgcacatcgtttacaggaggcagaaagttccagaaaccaaggagccaacctgtggattaaagggtattgtgactcacatgtcctcctgggttgaagaatctgttttgttcttttggtagttttattaaaacatgacctattctta

SEQ ID NO: 26412 - DNA, 491 bp, Homo sapiens
ttttagctccagatcgactgcaagaacaaaccagcaatcccaagaggccccacagaccctctgaaggaagcggacttctcctgcaggaccggaagagacaccccaaatactactggatttttccaactaccacatggagactttttcattgaacccgtgaagaagcatccactggttgagggagggtaccacccgcacatcgtttacaggaggcagaaagttccagaaaccaaggagccaacctgtggattaaagggtattgtgactcacatgtcctcctgggttgaagaatctgttttgttcttttggtagttttattaaaacatgacctattcttactcaagtctcttatctcctctgtattcttttttttttaatatcttcatgacattcaaatctcttctgtattctcttgccagaaagtgtacattctttttgcttgtataaaccctttcacttgtcaatactcgagtctctgcatattcttaatg

SEQ ID NO: 26413 - DNA, 929 bp, Homo sapiens
cactccccttttaggaggagggaggggaaaaaggtgtctagctcctttctgcttaaaaaagcacagggagatcgcgggcagctttgcagtcgctgccttctcgcgcctgaccatgcacccctgcatcttcctgctgggccacaggcgagcgctttatttctggagctgagggctaaaacttttttgacttttcttctcctcaacatctgaatcatgccatgtgcccagaggagctggcttgcaaacctttccgtggtggctcagctccttaactttggggcgctttgctatgggagacagcctcagccaggcccggttcgcttcccggacaggaggcaagagcattttatcaagggcctgccagaataccacgtggtgggtccagtccgagtagatgccagtgggcattttttgtcatatggcttgcactatcccatcacgagcagcaggaggaagagagatttggatggctcagaggactgggtgtactacagaatttctcacgaggagaaggacctgttttttaacttgacggtcaatcaaggatttctttccaatagctacatcatggagaagagatatgggaacctctcccatgttaagatgatggcttcctctgcccccctctgccatctcagtggcacggttctacagcagggcaccagagttgggacggcagccctcagtgcctgccatggactgactggatttttccaactaccacatggagactttttcattgaacccgtgaagaagcatccactggttgagggagggtaccacccgcacatcgtttacaggaggcagaaagttccagaaaccaaggagccaacctgtggattaaagggtattgtgactcacatgtcctcctgggttgaagaatctgttttgttcttttggtagttttattaaaacatgacctattctta

SEQ ID NO: 26414 - DNA, 1082 bp, Homo sapiens
cactccccttttaggaggagggaggggaaaaaggtgtctagctcctttctgcttaaaaaagcacagggagatcgcgggcagctttgcagtcgctgccttctcgcgcctgaccatgcacccctgcatcttcctgctgggccacaggcgagcgctttatttctggagctgagggctaaaacttttttgacttttcttctcctcaacatctgaatcatgccatgtgcccagaggagctggcttgcaaacctttccgtggtggctcagctccttaactttggggcgctttgctatgggagacagcctcagccaggcccggttcgcttcccggacaggaggcaagagcattttatcaagggcctgccagaataccacgtggtgggtccagtccgagtagatgccagtgggcattttttgtcatatggcttgcactatcccatcacgagcagcaggaggaagagagatttggatggctcagaggactgggtgtactacagaatttctcacgaggagaaggacctgttttttaacttgacggtcaatcaaggatttctttccaatagctacatcatggagaagagatatgggaacctctcccatgttaagatgatggcttcctctgcccccctctgccatctcagtggcacggttctacagcagggcaccagagttgggacggcagccctcagtgcctgccatggactgactggatttttccaactaccacatggagactttttcattgaacccgtgaagaagcatccactggttgagggagggtaccacccgcacatcgtttacaggaggcagaaagttccagaaaccaaggagccaacctgtggattaaagggtattgtgactcacatgtcctcctgggttgaagaatctgttttgttcttttggtagttttattaaaacatgacctattcttactcaagtctcttatctcctctgtattcttttttttttaatatcttcatgacattcaaatctcttctgtattctcttgccagaaagtgtacattctttttgcttgtataaaccctttcacttgtcaatactcgagtctctgcatattcttaatg

SEQ ID NO: 26415 - DNA, 816 bp, Homo sapiens
agtaattttgtcgctagttactgtattactggaaaatgtattcctaggctttaagatttgggaagcgtgtgagtctaacttctcaaacagaatttgacaaggacgtagcagtgttttaaaaagtcagggaaaggaaagaggtgtgttcagcattcctgccccatcttaacatattctttttctcgtcttaacagtggtaatattttatgttattttggtttgatttttgtttgtggcatatggctctgctgtcctgtgactctaagtaggaagagaaaatagtgccaataattcttcatgggagatgcacctctctcaagtcttgaacaatgtttgagggaaaagtgctttcagctggggctgatggaggaacaccttggcactctttccctgcaatgggcactgattgagggtcttcctggtgtggcatcatcaaatccctgttgctcaaacccactaattagctcattcttatctacaagtagcaggggcccctaaagctctctgagaagatctcatactgtgtctcctacatttcatcttctataatctcttattcttagagacagaaagatggttaaaagacatcacttcatttctttctctggatttggaaagagttatatattgggattatgctgttagtttacacttgcattgtttaaattagaggaaaggttattttgtgcagaacaaataaaaattactctttaactacctttcagaatatcccaacttttaacataagctgttttgtaaaggctggttgtagtgacttgcttcataatagactattaaaataagatgcattgaaat

SEQ ID NO: 26416 - DNA, 789 bp, Homo sapiens
gcgatttggggagtgttgtgaattccgagggctccacacttaagaggttgtacactcacctgtctacctggactccaatttccatatttccagccacttgaggactgagaggtggatgataaaccctgtcatagtggagcaagttcaggtgtttaaccgctgttatgggggatctgccttttctccctcttctttcttacttccataagtatgtatgtgcagagattgaaaaataaccttgagagagtccatccatctaactccaggtaagactgcaaatatttctttcttataaatctgggaggaatgcagtcagtgtttcatgccaaccaaaaaagactgcaaacgtttttccatccttctgccttgaatacctttctacttagatgactattttgtaagacgtgagtgcaaatgttatatacaataccaactccatactagatgtttaattaattctagggattcagtaataaggaatgactcgaacagatttctgcctacagacagctaatgcttcttgtatttttgcattacctgaaatgaaagtagcaatgttagattttacagtagtgggaggttgtaaacaatagtatgttaaacatttttgatcatttataataaaatgttcagcactaaacatatggtctgatactctgtgctttattgcttaataagcttttttttttcttttcgagagggagtcgtgctctgtcacccaggctggagtgtagtggcgcgatctctgctctgctcattgcaacctctgcctccctggttcaagcaatt

SEQ ID NO: 26417 - DNA, 499 bp, Homo sapiens
gcgatttggggagtgttgtgaattccgagggctccacacttaagaggttgtacactcacctgtctacctggactccaatttccatatttccagccacttgaggactgagaggtggatgataaaccctgtcatagtggagcaagttcaggtgtttaaccgctgttatgggggatctgccttttctccctcttctttcttacttccataagtatgtatgtgcagagattgaaaaataaccttgagagagtccatccatctaactccaggctggagtgcagtggcgtgattttggctcactgtatccttcgcctccctggctcaagtgattctcctgcctcagcctcccaagtagcttggattacagaggttgttggcttccatcaggggtggtcatttccaatcagacacctaagaactcctgctaatgggcaatgatggaggcacattctagatggaggcacattctagaaacgcttgaaactgtgtgttgctttggaca

SEQ ID NO: 26418 - DNA, 1350 bp, Homo sapiens
gcgatttggggagtgttgtgaattccgagggctccacacttaagaggttgtacactcacctgtctacctggactccaatttccatatttccagccacttgaggactgagaggtggatgataaaccctgtcatagtggagcaagttcaggtgtttaaccgctgttatgggggatctgccttttctccctcttctttcttacttccataagtatgtatgtgcagagattgaaaaataaccttgagagagtccatccatctaactccagttcattggaaatttctgcttctttgagactgaggttatattccacttcttctgactacaccaccaccatcaatctccttctctgaactcttggatcattacttcaacctgaaacaactcatcaggcagaatagttgcctactgccccaaccccaccaaatgttccagcacctctgatattacctcacatggcaagagggctttgaagatgtgattgagtcaaggatcttgaatggggagattatcctgaattattcagctggacccagtgtaatcacaaaggtttttcaaagatggaagagaggcagaagagccagaaaaggatatgtgacaatggagtcagtgtcagagttggagtgacgtgatgtgagaaggattcaacctgctgtttctggctttgaggatgaaagaaggggccatgagccaagcaatacaggtggcttctttcaagaagttggaaaagtggtaatattttatgttattttggtttgatttttgtttgtggcatatggctctgctgtcctgtgactctaagtaggaagagaaaatagtgccaataattcttcatgggagatgcacctctctcaagtcttgaacaatgtttgagggaaaagtgctttcagctggggctgatggaggaacaccttggcactctttccctgcaatgggcactgattgagggtcttcctggtgtggcatcatcaaatccctgttgctcaaacccactaattagctcattcttatctacaagtagcaggggcccctaaagctctctgagaagatctcatactgtgtctcctacatttcatcttctataatctcttattcttagagacagaaagatggttaaaagacatcacttcatttctttctctggatttggaaagagttatatattgggattatgctgttagtttacacttgcattgtttaaattagaggaaaggttattttgtgcagaacaaataaaaattactctttaactacctttcagaatatcccaacttttaacataagctgttttgtaaaggctggttgtagtgacttgcttcataatagactattaaaataagatgcattgaaat

SEQ ID NO: 26419 - DNA, 1141 bp, Homo sapiens
cgatatcaaaatatacgcaagataaacgcaggccgaacactcacacagcggcttcagttcattggaaatttctgcttctttgagactgaggttatattccacttcttctgactacaccaccaccatcaatctccttctctgaactcttggatcattacttcaacctgaaacaactcatcaggcagaatagttgcctactgccccaaccccaccaaatgttccagcacctctgatattacctcacatggcaagagggctttgaagatgtgattgagtcaaggatcttgaatggggagattatcctgaattattcagctggacccagtgtaatcacaaaggtttttcaaagatggaagagaggcagaagagccagaaaaggatatgtgacaatggagtcagtgtcagagttggagtgacgtgatgtgagaaggattcaacctgctgtttctggctttgaggatgaaagaaggggccatgagccaagcaatacaggtggcttctttcaagaagttggaaaagtggtaatattttatgttattttggtttgatttttgtttgtggcatatggctctgctgtcctgtgactctaagtaggaagagaaaatagtgccaataattcttcatgggagatgcacctctctcaagtcttgaacaatgtttgagggaaaagtgctttcagctggggctgatggaggaacaccttggcactctttccctgcaatgggcactgattgagggtcttcctggtgtggcatcatcaaatccctgttgctcaaacccactaattagctcattcttatctacaagtagcaggggcccctaaagctctctgagaagatctcatactgtgtctcctacatttcatcttctataatctcttattcttagagacagaaagatggttaaaagacatcacttcatttctttctctggatttggaaagagttatatattgggattatgctgttagtttacacttgcattgtttaaattagaggaaaggttattttgtgcagaacaaataaaaattactctttaactacctttcagaatatcccaacttttaacataagctgttttgtaaaggctggttgtagtgacttgcttcataatagactattaaaataagatgcattgaaat

SEQ ID NO: 26420 - DNA, 867 bp, Homo sapiens
gcgatttggggagtgttgtgaattccgagggctccacacttaagaggttgtacactcacctgtctacctggactccaatttccatatttccagccacttgaggactgagaggtggatgataaaccctgtcatagtggagcaagttcaggtgtttaaccgctgttatgggggatctgccttttctccctcttctttcttacttccataagtatgtatgtgcagagattgaaaaataaccttgagagagtccatccatctaactccagttcattggaaatttctgcttctttgagactgaggttatattccacttcttctgactacaccaccaccatcaatctccttctctgaactcttggatcattacttcaacctgaaacaactcatcaggcagaatagttgcctactgccccaaccccaccaaatgttccagcacctctgatattacctcacatggcaagagggctttgaagatgtgattgagtcaaggatcttgaatggggagattatcctgaattattcagctggacccagtgtaatcacaaaggtttttcaaagatggaagagaggcagaagagccagaaaaggatatgtgacaatggagtcagtgtcagagttggagtgacgtgatgtgagaaggattcaacctgctgtttctggctttgaggatgaaagaaggggccatgagccaagcaatacaggtggcttctttcaagaagttggaaaaggtaaggaaatgggttctcacctagaactgctggaaagcaacccagccctactgacaccatgattttagctcagtgagactctgtccagatttctgacctctagaactataagataataaatttgcattgttttaagcca

SEQ ID NO: 26421 - DNA, 594 bp, Homo sapiens
agatagcttaatgccatgactaaaatctggccagaagataggaagtttgcacattgtagatcaaagaattatggatatcatggccaattttttaaacaaaacattagtaaactgaattcagcaatacatcaagacaatcatacaggatgatgaaattcatagtctaggaatgagggctgctttcatgttaaaaacattagaaaatcatgatatgtgattgaaatttgaaaacaatgtaattatcttaaactcagaataaagtaccatatttgataaaaatttaacctcatatattcagaagaaatgtctggcaaaatttagcatccatcatgccataaaattcttaacaaagtataaataaaagtttttttttcctaatttgacacagggtattacacaaaaatcacaaagggagactttgtaagctttgcctctgagccaggggacagcatgaggaagccagtggtcaacacttccatccagcattggatggcacagttaggaggaaagtaaaacgaaaggtgtaaaagttagaaaaaagtgaattgacagaatatacggtttacctagaagataaattattagagagttgag

SEQ ID NO: 26422 - DNA, 343 bp, Homo sapiens
agtgctgggattacaggcatgagccactgtgcctggcctagaattttaaaatataagtagaagagtagatttttttttttggtagtcctcgtcatttaagtattctggatagtgggaataaaagagcttagaatttttcatctttgtcttaaacttttaaaaaaatgtagcttatattaattctgcttgtttaaaaagaatatactcttcattatactgaacctaggtaagacagctggtttatattttgttgcaattaaaaaacgtgagctgtggttgcagtgagccaagattgtggccattgcacttcagcctggcaacagagtgagacttggcctcaaaa

SEQ ID NO: 26423 - DNA, 844 bp, Homo sapiens
agacaagagtgtctatttgatgtaagtgtagggaatattagtgatagttcggaaatttctccagataatggcaagacactcctttagcagcccccctttcctgagtttcccattgttccacttattaaactctgacatatgtcatgccctgtgtacctggatatccattcatcctgatcacaacctgatctcccacttaccacaccatctcagaacattgtctggcagattaaaatatctccccagctctgctaacccactcttataacatgactagctcctccttcccccttttatccctttatctataagtactttttaaaacaagggctgacagctttattgttcaggaataattgtcaaaaggcttagtggactgtacttgccagtaaaaggttatttgctggcttggggtgtgtgctcctcagctgtcctgtgtcattccaattatattgtcatatggtgagatttgtgcctgatgtcattgtaggcaaggatatagtagaggcagctcatttgtatgttggtgcttcccagttctccatttgttgagatgcttttatcattcagacctttgagacaatccaacctgcttccttcatcttaaaggtgaggaaatgggcccagaaagggaatgtgatttaccccaaatcatactatgtgttggtgatgggaccaagatgaaatccagctccccagcctctggcagggactcctgaactcatagctttgggcactgacctcatggggtgaaagggaagattatatttctatttgaatgttttctaacacatgaaatttatataggtagttatacctagcaggagccaaagaacaataattt

SEQ ID NO: 26424 - DNA, 445 bp, Homo sapiens
gaatcgcttgaacccaggaggtggagtgagctgagatcacgccactgcactgcagcctgggtgacagagcgagactctttctcaaaaaaaaaaaaaaaaaaaaaaagaaaggaaaagaagaaaaaagtaggggagtcaaagcagttgatatgttttctgggaaaaaaaaatgatgcatggggaaagataggtggttgtccaggcagaagggagccctgatccctaagggctgtcatgctgactgccacaggagtagtaaattggagatggcgaagaaagagaaccaacagtcagtgactaccctcctaatcatgtgacagtgtaaattcttgaagtgcttgtcaaactgttcctaccctgtgtcctcatagaacggtaactggggcacagccccactttagtgtatcttgttccttccccagggatctaatcctagcttgtttac

SEQ ID NO: 26425 - DNA, 332 bp, Homo sapiens
ctgtggcaacagctggcagagaaaagacctgaagagtctaaatctgtgtttctctggaatggacacaaccatctctgcccctgggacgccacaagagcatcagccaagggctcagctatgagatgggcacttttgtaatccagagatggcagcaacaatattcattatttttaactcaaggaggattaaattcagttcccaaattcatggttatggtttcagacaacaggattttcttttttattttattttattttattttttgaggtggagtctcactctgtcacccaggctggagggcagtggtgtgatcttggcttactgcaacctct

SEQ ID NO: 26426 - DNA, 511 bp, Homo sapiens
ccgcaacaggtgtttggggacctggaccaggtgaggatgacctcggagggctccgactgccgttgcaagtgcatcatgcggcccctgagcaaggacgcgtgtagccgagtgcgcagtgggcgggcacgcgtggaggacttctacacggtggagactgtgagctcgggcactgactgccgctgctcctgtaccgcacctccctcctctctcaacccctgtgagaacgagtggaagatggagaaactcaaaaagcaggcgcccgagctcctcaagctgcagtccatggtggatctcctggagggcaccctgtacagcatggacttgatgaaggtgcacgcctacgtccacaaggtggcctcccagatgaacacactggaagagagcatcaaggccaacctgagccgggagaatgaggtggtgaaggacagcgtgcgccacctcagtgagcagttgaggcactatgagaatcactctgccatcatgctgggcatcaagaaggagctgtcccgcc

SEQ ID NO: 26427 - DNA, 386 bp, Homo sapiens
ccgcaacaggtgtttggggacctggaccaggtgaggatgacctcggagggctccgactgccgttgcaagtgcatcatgcggcccctgagcaaggacgcgtgtagccgagtgcgcagtgggcgggcacgcgtggaggacttctacacggtggagactgtgagctcgggcactgactgccgctgctcctgtaccgcacctccctcctctctcaacccctgtgagaacgagtggaagatggagaaactcaaaaagcaggcgcccgagctcctcaagctgcactccagcctgggcaacagagtgagactccgtctcaaaaaataaataaaatagaagcagccttgtaactgtatttaccatgataatatattctgcacggtaagaattcc

SEQ ID NO: 26428 - DNA, 382 bp, Homo sapiens
ccgcaacaggtgtttggggacctggaccaggtgaggatgacctcggagggctccgactgccgttgcaagtgcatcatgcggcccctgagcaaggacgcgtgtagccgagtgcgcagtgggcgggcacgcgtggaggacttctacacggtggagactgtgagctcgggcactgactgccgctgctcctgtaccgcacctccctcctctctcaacccctgtgagaacgagtggaagatggagaaactcaaaaagcaggcgcccgagctcctcaagggctgttcactctacagctagatggctcagcacagagacagtcagtgcctctgcacgcaagtcatgcagaaaagcaagagatctgggaagaactgtctcccaacatttg

SEQ ID NO: 26429 - DNA, 2958 bp, Homo sapiens
tggaattgtatttagaaaggcccctgcaaagtatatagatggatgactctagttcatgacatacaaatcccataaggccaacgaccactcttctggaacaccaagagcagctctgagatcatgctggccctacgcgaattgagtttctgtggcctaattggatttggagaacgccttccctggccccttttcctcagacagatctgctctgataggaaccttttcaagaaagttactgttgtttcaatgccactccttacctgtatagaacatttccaatacattcgctcattgaacttaatccttgcaactgtgactggggggtagatggctctgtttgcatacgaagaaataaaggctccaggaggttaaatcgggcaactttttagaactaaatcagtctctgtaaggcctacattgctaagataccatttcagctctgaaaatctgcttcagggaagtgagtggatgaggccttcctgcctcagctactctgcccgtctgtacatcttttgtgtctgcctccgtaccttattcagttattttcacactaaagtaagtagaattaagactgtagttcagatgctttttctttttctgttggaaactgaacacactacagacagtgaaaaaaggtacatattccattttctcattgcctgaagatctctgctgatgctcctggagaatgactttgggggctttagaaagaatattgccagtccgtctcggcaaggagatgatgggagcgctttatatggaggctttacatgacttgtaaattaaatgtgaatgagggcagttgattaaaattggtattacagaagggccctgctgaggtttgaaaacagctgagctgctgatgtctcaggcctttccctgaattagcactgcggttctccaggatatcagcaaagagggcaagtaatagaagcccctgataaggagcgtcagccgacaggcaagccttgggaggctgtgggaatgggtctgcccccagcttcacagacctcttcctccagcctctgaatcccattagccacagcctagaacattagctgagctgcacaagctcacccacccctgtgccagggggccctgacctccctccatgccatgtttttggctgtatctacggcacttaacaataggggctttttattttcattacagagatattttgaaaaatttaaaagacatgaactcacataaacagttatggatgatagttaaaagagaaacgggtggaggtggatgagaggttgtcttcatgaatataattacttgagatttttttttcttaatggaattagtttattagaaaatgtctgcgttaaatccgtagaaaaggaagaaaagtgtagcaacaaaaatgtagccattatctaacttgccataaatatttgcagttatgataccttggaatgttgccacgatatggattgctttgattaaaagatgtcagttgaataaaacagtactgtgggagaatcgctttctgctgctagataaatgctgatgtttatttttaaaccaggaaacattgatcctgtaacaatgcccgattacaattgctttattacaccccagggctgatggagatgtaatcacttggctaatggatgtgggtgcaggacagatgctcgcttgctggcctgctttcctgcttgcattctgatgagctgcaggagtgcgcctggccttctgcaggtggagctgctgtcagagcttcgtttcactgatacccaaagccatgtctgactgaaataaaacaggttccctttttttttccctttggaaaatgccaactaagggagactaatcagatatcttaacacaatttcatccaggcttagtgctaacaagattgcggggctttttagggtttaagaagatgagaaatgagtgtgcacgtttcacacgttgacttgccggtttttccatgtcatacaaaaaagtcctggctgtttctccgaactggctgcctgcattcccgtctttcttttgtttttaagaaatagactgaattcagctgttaatcctctagtacagtatccatgttaaaatgtttttccattgcatcttttatgtgaattcaaaggtcagaatttattgtctgtgatattgagaccatgtgtacaagaactactttttgcttttcatcattcactccttagcaaacgtttcgtaagtaccctctgtctgtttgctactatatgaggtgctgcgaaattagtgggcgtggctttttatatttttcattcgtgtgtagcctaagtaaggtgactcaagatgatacaccgagagaaaaatgcaaaatatatttggttctcatttctgttgctgtcgtttcctttttaaagacgatttatcaactgctgccatttggaacttcctataagaaactaaaaatgatctatttcagtgttcctttcgcctttcctctgctttctgaataaatggtttcagtaacccatgctgttctctccctattctacgtctttctccctatgttgaaaaaagattcccacagtttctgatgtgtgtgtttatagtcttcaatgtatgttaacatgttaggaactgagtatcttaagagatgtcttagaatgctttagttttcataatttgtcctttatgtatttttcattgtatttgctgttttgacatggaagtaatttaaaaagttggtgcaggaaaggactctttactgttgcacattttggttttctgatatgtaataaattcatggcttggcagctgacatgatgtttcccagagagaaggagatgtatttctgcagggtccagaccaaaagagccatttacagcatgttctcccatgttccattatcagcctgatgaaacctgccctgccaaggcataaacttttgtactagctgtctccatattatgttcaataaattctgtgctctgaatatatttaaaaaaaaattca

SEQ ID NO: 26430 - DNA, 313 bp, Homo sapiens
agatttaccagaacatttgaaactcaaagaagataatttcttccaggtttctaaaagcaaaataatgaatggccactgatgaaaaatcatattatttattcattcactgtcttccagtatttcagtgttttgttttgtttttattttattttattttaagtttttgagatggagtctcgctctctctcccaggctggagtgcagtggcgtgatcttggctcactgtgacctctgcctcccaggttcaagtgattctgctgcctcagcctcctgagtagctggaattacaggcgcacaccaccacgcctggcta

SEQ ID NO: 26431 - DNA, 436 bp, Homo sapiens
tttttctcttctccctttccttctggaatgccagttagatatgtgttagattttcttactctatgttgcatgtcgcccaactcttcattcatttgtcctgcattctgcataatttcttcagctctaccttgtactttattcgttctctgttcaggtcaacctgatctgaggttaaaccatttatagagttttgactgtcggtgactgtgatttccatttcttggagtttgatttggttcttcgtcatttgattttcattttctgtaatctctattcctcttaatttcatcatttatttctttaaacatacttaaaattttatttatgtatttgctatttccactgactgaggtgaaaatcttcaccagtttgattttgttgctgtttgctgccttgcagttagagtgacttgtgatgtgacatgtgtgtgttttga

SEQ ID NO: 26432 - DNA, 617 bp, Homo sapiens
aattctgggtataagggaaaaaagcaaatgaactattttatgtgtttatgatttacaagtttatgtataaaatttttgtatgaagattggagttatagttggccttatttttaattctatctcagataatcttgtggagtttatatgggtaattagtaaaatcctattaaagacgatttattatgaaaagaattatccagatagtggacaattcacattaatcaaatgtgtggctcaattttattaaagctgacatgacattattgcttatgttttggccaaccttggtttcaattattacctttcatatttttattttactcctatgttttacccttgcatactgctacattaagaagagaaattaagtctcttttaagccatctcagaacttttgggccgggtgtggtggctcacacctgtaatcccagcactctgagaggctgaggcaggaggatcgcttgagctcatgagtttgagaccagcctgggcaacatagggagaccttgtcgatacaaaaatttaaaaatgagatgggaggatggctggagccagggagatcgaggctgcagtaagctgtgattgtgccactgcactcttgcctgggtgagcctgcc

SEQ ID NO: 26433 - DNA, 220 bp, Homo sapiens
agactataaagcctaaaatatttatagtgttaactttgataggacaagtttgccagctcctgcactagaggataaagattaacaggattgactccacatagaggagaggagaggaaggggcaaggatggaagcaaggagggagaagggttagagagaaagaaagagggaggggggtcactcagagacttcacaaagtatgttatttcctaaaaactgtaa

SEQ ID NO: 26434 - DNA, 401 bp, Homo sapiens
gggtaccctcaaaaacaatgggaaattgttgacaggtaactaagagaagaagagaagggtggtaacttcatgagatatacaagttaaaccattggtccagtagtttgccagaaagaatgatgaacacactgctaagaaaatgcctttctggggccgaaaaaaaccaaaatcttacctcaagagctgccccttcaaaataatctatatttaattggtattaaactaataataaagaaaagaagccgctcagaaagaaaactcagactcatatggcttccctggtgattctcccaatcatttaaagaagaattaataccaatacttcacaagttcttccaagaaaaatagaggaacatgtcccagaaaattttatgaggtcagtattatgtcgacatcaaatc

SEQ ID NO: 26435 - DNA, 471 bp, Homo sapiens
gactcacatctccaagcacatttccatttctcttattcaaggagatgcccccattgtctttcaaggtgaattgtggccataacaaagataaatgagtctcagattcatacaagtcaaaagcagatgaccagcacctggaaatactaaagccctgagctccaaggcaattcgataatttgaaagaagcatgaaaccttgtagtttctgccattatggtactcggggtaatgagattgaaaagtggtctatgccttgatcttggtattttaagttaatttttgcagcacttaaatattcctctgaacctattgaaagctattgtaacttgccattcttacaagtattcattaattcattcactgtaaatatttgctaaacattgaaggtgagattacatctatccatacaaccatatgtgtgcaagacagaacagtgtacatcaatgctggttaataaaatcagaaaactctg

SEQ ID NO: 26436 - DNA, 432 bp, Homo sapiens
tgcgtcgacctggttttttctgtgccccagtggaaggtgttccctctttaaacgcagccctgtgattcacacatcctcccaggtctttcaatgctaaagacaatggattatctctgagtttcagtccctacgtccagaagagaaaaatatgggtcaggcacagtggctcatgcctgtaatcccagcacttggggaggccaaggtgggtggatcacttgagaccaggagttcaagaccagcccggccaacatggcgaaacctcatctccactaaatctacaaaaattagccgggtgtggtggtgcacacctgtaatcccagctactcgggagactgaggcgcagcaatcacttgaacctggggggcagaggttgcagtgagctgagattgcaccatcgcatccagcctgagcaacagagcaatactcattcca

SEQ ID NO: 26437 - DNA, 392 bp, Homo sapiens
aggtgggaggatggcttgagcccagaagactgaggctacagtgagctgtgatcatgccactgcactccagcctgggttgcagagtacgaccccacctcaaaacaacaacagcagcaaaaaaatcttattgaggcatggtttaataaaatatagctgtttaggtgtatagttccatgacttctgaccaacctactaacccaggcaattattaccacaatcaagataaagaacatttctatcaccccaaaaagcaaatgccctcctctccccacactcagccccagcaacaactgctctcctttctgtcactatagattagatttgcctcttccagaatttcagatacataaacatgaatcaaacggtctgtactctttcgtgtttggcatctt

SEQ ID NO: 26438 - DNA, 893 bp, Homo sapiens
tcttctaaattcatttgtctaagtgacaagactatatataaaacttatatattggccaggcatggtggctcacacgtgtaaccccagcacttttggaggcaaaggcgggtggatcacttgagcccaggagttcaagaccagcctgggcaacatagcgggaccccgtctctaccaaaaattaaaaattagctggatgtcatcatgcatacctgtagtctcagctacttggacctgtagtctcagctactttggaggcaggaggatcacttgagtcagggaggtcgatgcttatcaaatcagtgagccatgattgtgccactgcattccagcctggatgacagagtctcaatcaatcaatcaataaaaaccttatatattcagtttagcagaattgtaaagtgaatacttgtgtaaacactatctggaccaagaaataggatctactggcactgcagaagttccccttactgtggatttcaatcccatccacaaccctctccctgtatcccaaaggtgatcactagactggctctttacatttttactacctttgtatgtatccctaaactatagtttcgtgtggtctttttggggagcctaacaaatagaatcatatggtatactttaaagaattaattgaagtgtaatgtacatatagaagaatccacagctcatagcatagagctcaattgtcataagaacacaccagtctagctatcatctagttagtgtacatttttttatgatcttgccttttctgctcaacattgtatccataagagggtagctgtaatttgttattttcattgctgtaatacatttctttattctcactctaaatgaaatgaaagagctaaataaacagtaactgtctgaaggaaactttagctcct

SEQ ID NO: 26439 - DNA, 282 bp, Homo sapiens
gccctcaccctagcagctgttggagaagatgagggaagcgctgagagtgcagactgttttcttatgctccccagtctctgtggccaggagtactccttttgccaagaaaggggtggtgccccactaaacctggtttgtcttttctctgtctctgccctgtctttgaaggtcctagggcccttgtgcatttcttacatgccaatcatggagtaggctggggcctggggttttgggtagggattctgttttgttcgttcccagtctggaagatgtggccaagag

SEQ ID NO: 26440 - DNA, 276 bp, Homo sapiens
atgctctttctacttctagttcacaggttccaggataaccagatgactgaggaatgttgaagattgcagtgatggaagtgtctcagtcagcctggaagactgtatggaaggaggttgcctggccacactgtcatgtccccctctccctaaaaaagggacacatttgcctttgtgcaaggcaacacatacatttggtctgtgtatatactttggtctatgtattctgttatttaacattctaataatgttgatgaccttaaaatatgtttgacaatg

SEQ ID NO: 26441 - DNA, 357 bp, Homo sapiens
ggccccttcttcagcagctcaggctgctgaaacagaacaccgcagcctgggtgcttcaacaaaaagaaaaatgcatttcctctcagctctggagacggaaagtccaagattgaggtgccagcagggttgatgtctgacaaggcctctcccctcgggttcaaagggccaccttctcagtgtcctcacatggccttccctttgtgggcatgggagagaaagcgatctctggtcttcttcctgttcttgtaaggacacccgtcctattggattaggggcccgaccttatgacatcatttaatctgaatgacctccttaaatgccctatctccaaatacagtcacatttggggttaggact

SEQ ID NO: 26442 - DNA, 692 bp, Homo sapiens
cacagggacccaggacaagggccccaaagaggcctgcccttggtgagctcaccgtgtgtgtgcccccagccacggacctcaccgtggggaagatctacgcagccatgatgatcatggagtactaccggcagagcaaggccaagaagctgcaggccatgcgcgaggagcaggtgcgctgttcgccgctctggggacatctgggctggggacagtggcttgcatgtcaccacgggaaccaactggaatatgagggtggctgagccccagggcaggtccctgaaaagtaggggctgtgcacagcagctcacacctgcaatctcagtgctttgagaggccagggcagagggatcgtttgagaccaggatgagaccaccctgggcaacacagtgagactccatctctacaaaataaaacattagccaggcatggtggtgcacacctgtagtcccagctatttaggaggccaagatgggaggatcacttgaggccaggagtgggagaccagtctgggcaacatagaaagacccatatctctacaaaaaaaaaataaaattagctgcatgtggcgccatgcacctgtggtcccagctacttgggaggctgaggcaggagaatcacttgaacctgggaggtggaggttgcagcaagccaagatcaagccactgcactccagcccgggtgataagagcagg

SEQ ID NO: 26443 - DNA, 464 bp, Homo sapiens
ttttgtgccctccctgcgggccaccaagagaaactgagtactgggacaggtaacctaagtaagagacacctcagccgccacagctttcagagttcttcctgggactccctgggtaggggcgggcgcggctcacgggagacccaggagggatgcctgggaatgactgcgcttgccttgggttttctgtagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtgtaagagctgagcccagccctgggatccaatccaccaggacagatggagggggagggaaag

SEQ ID NO: 26444 - DNA, 552 bp, Homo sapiens
attgcattaatagtgctttctctctccctccttatttggggtctggcttgcttttttcctgttggttggcttcatgtaggggcctctgtgagtggtgacagctctgagccttttggggtgggtggatggtcacccctcttcctccatctccccagaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggtgagaaggggacctgctctgataattctgtttccgtggggtggggtgcctgccttcatccttctgttcccatagaggatgtaccctcctcttccaat

SEQ ID NO: 26445 - DNA, 8641 bp, Homo sapiens
  misc_feature (5859)..(5859): n is a, c, g, or t
  misc_feature (5881)..(5881): n is a, c, g, or t
  misc_feature (5887)..(5887): n is a, c, g, or t
  misc_feature (5900)..(5900): n is a, c, g, or t
  misc_feature (5903)..(5903): n is a, c, g, or t
  misc_feature (5908)..(5908): n is a, c, g, or t
cgcaccctccttccgcccctccttctccggggtcagccaggaagatgtcccgagctgctatccccggctcggcccgggcagccgccttctgagcccccgacccgaggcgccgagccgccgccgcccgatgggctgggccgtggagcgtctccgcagtcgtagctccagccgccgcgctcccagccccggcagcctcagcatcagcggcggcggcggcggcggcggcggcgtcttccgcatcgttcgccgcagcgtaacccggagccctttgctctttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggaatggatctcaaaagcagaagaggtgatcctcgccgaggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttgcggtcggattcattataaggatatgtacagtttattacgagtaatntctccgccctctcggcttaggnaagaantgtccgtcatagngtngcttncaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcaccccacgcacacaccccacccgaggagccgcgcagaggccgcgggggcccagcacagagggcccgggagagggccagccgggagaccccagactctggagaggccagggctgggccacaagggtgtcccgcagagaccctcggccaaaagagaccctcctgggcagccacggcgccccccaaccagccccgatccccccacccacgacaggggctctcgggtgggaggcagggagcagacaaaccacacagccaagggatttgaattaactcagccatttttggagaactttggggaacatgaaaaaaaaaaaaaaaaaaaaaaaaacatttttaaaagaaaaaacggggagaaaaaaatagcttctattgatgagttttatcatctcaattgaatctttcctttccctgatgaagacagctggtggccgagtgcggcaaagaagccagaaggaaccagaatcccagtgccctacacccaccaccagacacactcacacccacacacgttctcagacacacacaagagtgcttgccggttataccaaaccctactattactgcctgcagaaatcaatttaaaaaaataataataacaataaacaattttaaaaaggacaaaaaaattaatgattgagaaaagaggcatttttttctgacatttggtcctgcttgaaacaacaaaagaagaagaaaaacccaccatcaccaccgattcctttgcttcttttttccttttttcctaccttgtttgaaaaccgtgggcttgggactgtgaattattgcatgacattcaa

SEQ ID NO: 26446 - DNA, 8674 bp, Homo sapiens
  misc_feature (5859)..(5859): n is a, c, g, or t
  misc_feature (5881)..(5881): n is a, c, g, or t
  misc_feature (5887)..(5887): n is a, c, g, or t
  misc_feature (5900)..(5900): n is a, c, g, or t
  misc_feature (5903)..(5903): n is a, c, g, or t
  misc_feature (5908)..(5908): n is a, c, g, or t
cgcaccctccttccgcccctccttctccggggtcagccaggaagatgtcccgagctgctatccccggctcggcccgggcagccgccttctgagcccccgacccgaggcgccgagccgccgccgcccgatgggctgggccgtggagcgtctccgcagtcgtagctccagccgccgcgctcccagccccggcagcctcagcatcagcggcggcggcggcggcggcggcggcgtcttccgcatcgttcgccgcagcgtaacccggagccctttgctctttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggaatggatctcaaaagcagaagaggtgatcctcgccgaggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttgcggtcggattcattataaggatatgtacagtttattacgagtaatntctccgccctctcggcttaggnaagaantgtccgtcatagngtngcttncaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcaccccacgcacacaccccacccgaggagccgcgcagaggccgcgggggcccagcacagagggcccgggagagggccagccgggagaccccagactctggagaggccagggctgggccacaagggtgtcccgcagagaccctcggccaaaagagaccctcctgggcagccacggcgccccccaaccagccccgatccccccacccacgacaggggctctcgggtgggaggcagggagcagacaaaccacacagccaagggatttgaattaactcagccatttttggagaactttggggaacatgaaaaaaaaaaaaaaaaaaaaaaaaacatttttaaaagaaaaaacggggagaaaaaaatagcttctattgatgagttttatcatctcaattgaatctttcctttccctgatgaagacagctggtggccgagtgcggcaaagaagccagaaggaaccagaatcccagtgccctacacccaccaccagacacactcacacccacacacgttctcagacacacacaagagtgcttgccggttataccaaaccctactattactgcctgcagaaatcaatttaaaaaaataataataacaataaacaattttaaaaaggacaaaaaaattaatgattgagaaaagaggcatttttttctgacatttggtcctgcttgaaacaacaaaagaagaagaaaaacccaccatcaccaccgattcctttgcttcttttttccttttttcctaccttgtttgaaaaccgtgggcttgggactgtgaattattgcatgacattcaa

SEQ ID NO: 26447 - DNA, 8603 bp, Homo sapiens
cgcaccctccttccgcccctccttctccggggtcagccaggaagatgtcccgagctgctatccccggctcggcccgggcagccgccttctgagcccccgacccgaggcgccgagccgccgccgcccgatgggctgggccgtggagcgtctccgcagtcgtagctccagccgccgcgctcccagccccggcagcctcagcatcagcggcggcggcggcggcggcggcggcgtcttccgcatcgttcgccgcagcgtaacccggagccctttgctctttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggaatggatctcaaaagcagaagaggtgatcctcgccgaggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggggccgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcaccccacgcacacaccccacccgaggagccgcgcagaggccgcgggggcccagcacagagggcccgggagagggccagccgggagaccccagactctggagaggccagggctgggccacaagggtgtcccgcagagaccctcggccaaaagagaccctcctgggcagccacggcgccccccaaccagccccgatccccccacccacgacaggggctctcgggtgggaggcagggagcagacaaaccacacagccaagggatttgaattaactcagccatttttggagaactttggggaacatgaaaaaaaaaaaaaaaaaaaaaaaaacatttttaaaagaaaaaacggggagaaaaaaatagcttctattgatgagttttatcatctcaattgaatctttcctttccctgatgaagacagctggtggccgagtgcggcaaagaagccagaaggaaccagaatcccagtgccctacacccaccaccagacacactcacacccacacacgttctcagacacacacaagagtgcttgccggttataccaaaccctactattactgcctgcagaaatcaatttaaaaaaataataataacaataaacaattttaaaaaggacaaaaaaattaatgattgagaaaagaggcatttttttctgacatttggtcctgcttgaaacaacaaaagaagaagaaaaacccaccatcaccaccgattcctttgcttcttttttccttttttcctaccttgtttgaaaaccgtgggcttgggactgtgaattattgcatgacattcaa

SEQ ID NO: 26448 - DNA, 4397 bp, Homo sapiens
ctgccccctacccaacctgacctctgcttcctctcttcccttcttcccacctaaacattcctccacagtggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggggccgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcaccccacgcacacaccccacccgaggagccgcgcagaggccgcgggggcccagcacagagggcccgggagagggccagccgggagaccccagactctggagaggccagggctgggccacaagggtgtcccgcagagaccctcggccaaaagagaccctcctgggcagccacggcgccccccaaccagccccgatccccccacccacgacaggggctctcgggtgggaggcagggagcagacaaaccacacagccaagggatttgaattaactcagccatttttggagaactttggggaacatgaaaaaaaaaaaaaaaaaaaaaaaaacatttttaaaagaaaaaacggggagaaaaaaatagcttctattgatgagttttatcatctcaattgaatctttcctttccctgatgaagacagctggtggccgagtgcggcaaagaagccagaaggaaccagaatcccagtgccctacacccaccaccagacacactcacacccacacacgttctcagacacacacaagagtgcttgccggttataccaaaccctactattactgcctgcagaaatcaatttaaaaaaataataataacaataaacaattttaaaaaggacaaaaaaattaatgattgagaaaagaggcatttttttctgacatttggtcctgcttgaaacaacaaaagaagaagaaaaacccaccatcaccaccgattcctttgcttcttttttccttttttcctaccttgtttgaaaaccgtgggcttgggactgtgaattattgcatgacattcaa

SEQ ID NO: 26449 - DNA, 6988 bp, Homo sapiens
cgcaccctccttccgcccctccttctccggggtcagccaggaagatgtcccgagctgctatccccggctcggcccgggcagccgccttctgagcccccgacccgaggcgccgagccgccgccgcccgatgggctgggccgtggagcgtctccgcagtcgtagctccagccgccgcgctcccagccccggcagcctcagcatcagcggcggcggcggcggcggcggcggcgtcttccgcatcgttcgccgcagcgtaacccggagccctttgctctttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggaatggatctcaaaagcagaagaggtgatcctcgccgaggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggggccgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccatcaccaccgattcctttgcttcttttttccttttttcctaccttgtttgaaaaccgtgggcttgggactgtgaattattgcatgacattcaa

SEQ ID NO: 26450 - DNA, 8809 bp, Homo sapiens
cgcaccctccttccgcccctccttctccggggtcagccaggaagatgtcccgagctgctatccccggctcggcccgggcagccgccttctgagcccccgacccgaggcgccgagccgccgccgcccgatgggctgggccgtggagcgtctccgcagtcgtagctccagccgccgcgctcccagccccggcagcctcagcatcagcggcggcggcggcggcggcggcggcgtcttccgcatcgttcgccgcagcgtaacccggagccctttgctctttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggaatggatctcaaaagcagaagaggtgatcctcgccgaggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttggggcctggtcccgtgctactccacccagccccagaagctgagaagccatccctgagaggggggaaaagggccccaaatgcatcttctccgactcagcgggcagcgaggactcaccctgcagccgaacagtcccagctccctcccgtcctccccattcccgctcgccaaggggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggggccgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcaccccacgcacacaccccacccgaggagccgcgcagaggccgcgggggcccagcacagagggcccgggagagggccagccgggagaccccagactctggagaggccagggctgggccacaagggtgtcccgcagagaccctcggccaaaagagaccctcctgggcagccacggcgccccccaaccagccccgatccccccacccacgacaggggctctcgggtgggaggcagggagcagacaaaccacacagccaagggatttgaattaactcagccatttttggagaactttggggaacatgaaaaaaaaaaaaaaaaaaaaaaaaacatttttaaaagaaaaaacggggagaaaaaaatagcttctattgatgagttttatcatctcaattgaatctttcctttccctgatgaagacagctggtggccgagtgcggcaaagaagccagaaggaaccagaatcccagtgccctacacccaccaccagacacactcacacccacacacgttctcagacacacacaagagtgcttgccggttataccaaaccctactattactgcctgcagaaatcaatttaaaaaaataataataacaataaacaattttaaaaaggacaaaaaaattaatgattgagaaaagaggcatttttttctgacatttggtcctgcttgaaacaacaaaagaagaagaaaaacccaccatcaccaccgattcctttgcttcttttttccttttttcctaccttgtttgaaaaccgtgggcttgggactgtgaattattgcatgacattcaa

SEQ ID NO: 26451 - DNA, 8781 bp, Homo sapiens
cgcaccctccttccgcccctccttctccggggtcagccaggaagatgtcccgagctgctatccccggctcggcccgggcagccgccttctgagcccccgacccgaggcgccgagccgccgccgcccgatgggctgggccgtggagcgtctccgcagtcgtagctccagccgccgcgctcccagccccggcagcctcagcatcagcggcggcggcggcggcggcggcggcgtcttccgcatcgttcgccgcagcgtaacccggagccctttgctctttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggaatggatctcaaaagcagaagaggtgatcctcgccgaggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttggggcctggtcccgtgctactccacccagccccagaagctgagaagccatccctgagaggggggaaaagggccccaaatgcatcttctccgactcagcgggcagcgaggactcaccctgcagccgaacagtcccagctccctcccgtcctccccattcccgctcgccaaggggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggggccgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggccccccagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcaccccacgcacacaccccacccgaggagccgcgcagaggccgcgggggcccagcacagagggcccgggagagggccagccgggagaccccagactctggagaggccagggctgggccacaagggtgtcccgcagagaccctcggccaaaagagaccctcctgggcagccacggcgccccccaaccagccccgatccccccacccacgacaggggctctcgggtgggaggcagggagcagacaaaccacacagccaagggatttgaattaactcagccatttttggagaactttggggaacatgaaaaaaaaaaaaaaaaaaaaaaaaacatttttaaaagaaaaaacggggagaaaaaaatagcttctattgatgagttttatcatctcaattgaatctttcctttccctgatgaagacagctggtggccgagtgcggcaaagaagccagaaggaaccagaatcccagtgccctacacccaccaccagacacactcacacccacacacgttctcagacacacacaagagtgcttgccggttataccaaaccctactattactgcctgcagaaatcaatttaaaaaaataataataacaataaacaattttaaaaaggacaaaaaaattaatgattgagaaaagaggcatttttttctgacatttggtcctgcttgaaacaacaaaagaagaagaaaaacccaccatcaccaccgattcctttgcttcttttttccttttttcctaccttgtttgaaaaccgtgggcttgggactgtgaattattgcatgacattcaa

SEQ ID NO: 26452 - DNA, 6917 bp, Homo sapiens
cgcaccctccttccgcccctccttctccggggtcagccaggaagatgtcccgagctgctatccccggctcggcccgggcagccgccttctgagcccccgacccgaggcgccgagccgccgccgcccgatgggctgggccgtggagcgtctccgcagtcgtagctccagccgccgcgctcccagccccggcagcctcagcatcagcggcggcggcggcggcggcggcggcgtcttccgcatcgttcgccgcagcgtaacccggagccctttgctctttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggaatggatctcaaaagcagaagaggtgatcctcgccgaggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttggggcctggtcccgtgctactccacccagccccagaagctgagaagccatccctgagaggggggaaaagggccccaaatgcatcttctccgactcagcgggcagcgaggactcaccctgcagccgaacagtcccagctccctcccgtcctccccattcccgctcgccaaggggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggggccgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggtgcgctgttcgccgctctggggacatctgggctggggacagtggcttgcatgtcaccacgggaaccaactggaatatgagggtggctgagccccagggcaggtccctgaaaagtaggggctgtgcacagcagctcacacctgcaatctcagtgctttgagaggccagggcagagggatcgtttgagaccaggatgagaccaccctgggcaacacagtgagactccatctctacaaaataaaacattagccaggcatggtggtgcacacctgtagtcccagctatttaggaggccaagatgggaggatcacttgaggccaggagtgggagaccagtctgggcaacatagaaagacccatatctctacaaaaaaaaaataaaattagctgcatgtggcgccatgcacctgtggtcccagctacttgggaggctgaggcaggagaatcacttgaacctgggaggtggaggttgcagcaagccaagatcaagccactgcactccagcccgggtgataagagcagg

SEQ ID NO: 26453 - DNA, 5681 bp, Homo sapiens
cgcaccctccttccgcccctccttctccggggtcagccaggaagatgtcccgagctgctatccccggctcggcccgggcagccgccttctgagcccccgacccgaggcgccgagccgccgccgcccgatgggctgggccgtggagcgtctccgcagtcgtagctccagccgccgcgctcccagccccggcagcctcagcatcagcggcggcggcggcggcggcggcggcgtcttccgcatcgttcgccgcagcgtaacccggagccctttgctctttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggaatggatctcaaaagcagaagaggtgatcctcgccgaggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaagtgccctacacccaccaccagacacactcacacccacacacgttctcagacacacacaagagtgcttgccggttataccaaaccctactattactgcctgcagaaatcaatttaaaaaaataataataacaataaacaattttaaaaaggacaaaaaaattaatgattgagaaaagaggcatttttttctgacatttggtcctgcttgaaacaacaaaagaagaagaaaaacccaccatcaccaccgattcctttgcttcttttttccttttttcctaccttgtttgaaaaccgtgggcttgggactgtgaattattgcatgacattcaa

SEQ ID NO: 26454 - DNA, 1803 bp, Homo sapiens
cgcaccctccttccgcccctccttctccggggtcagccaggaagatgtcccgagctgctatccccggctcggcccgggcagccgccttctgagcccccgacccgaggcgccgagccgccgccgcccgatgggctgggccgtggagcgtctccgcagtcgtagctccagccgccgcgctcccagccccggcagcctcagcatcagcggcggcggcggcggcggcggcggcgtcttccgcatcgttcgccgcagcgtaacccggagccctttgctctttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggaatggatctcaaaagcaggtgaggccctttcatcctggggcccagggatggagatcccaggccacggagtacaaagagagtcatgcagtttggagaaggctaagctgggagggttatgatgggaggagaaagagaacctgaattggtagtcccaaattttatcaacaagaatccagagtctgatatgaagaagtctaagatgaagccaggatctgacatcacgtaacttgaattctgaaatcagacgctggtttacatcccggccctgccactttttacccatgcaccacacatccctgtacctccgtttcctcagctgttacatggaggcgatggtagtg

SEQ ID NO: 26455 - DNA, 329 bp, Homo sapiens
ccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttgtgagtatcacccagccccacccctgccaactccctgatccctccctcacaccctttttccacttctctttctctggtagtatgtgtatcttctttggtcctcattgaatctgccctttcctttagccattt

SEQ ID NO: 26456 - DNA, 398 bp, Homo sapiens
tcgctcccctctcttcctcccaatcccgtgtctcctttgattttgttgtatctttttttttgatttcctttgtttcaattttcgtgtagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgc

SEQ ID NO: 26457 - DNA, 1487 bp, Homo sapiens
gaggccgagggctgccgctaccaatttcgggtcgcgctgctgggggacgcggcggtgggcaagacgtcgctgctgcggagctacgtggcaggcgcgcctggcgccccggagccggagcccgagcccgagcccacggtgggcgccgagtgctaccgccgcgcgctgcagctgcgggccgggccgcgggtcaagctgcaactctgggacaccgcgggccacgagcgcttcaggtgcatcaccaggtccttttaccggaatgtggtgggtgtcctgctggtctttgatgtgacaaacaggaagtcctttgaacacatccaagactggcaccaggaggtcatggccactcagggcccggacaaggtcatcttcctgctggttggccacaagagtgacctgcagagcacccgctgtgtctcagcccaggaggccgaggagctagctgcctccctgggcatggccttcgtggagacctcggttaaaaacaactgcaatgtggacctggcctttgacaccctcgctgatgctatccagcaggccctgcagcagggggacatcaagctagaagagggctgggggggtgtccggctcatccacaagacccaaatccccaggtcccccagcaggaagcagcactcaggcccatgccagtgttgactctaggagagaaagggttaaagcagtcccagccttagcccacctggtgggatggggagtgttaatatctctctggaggacaaatgacagaagggttcatataaacagtatcctgacacagtcatgcttcctggattttggagtcgaggctttctacagaaaagaaagttctgatggccaggcatggtctcgaactccgcatctcaggtgatctgctcgccttggcctcccaaagtgatgggattgcaggcatgagccaccgtgcccggcttcacacccatttctttaaaaaggatcccgtagcaggcagaaaagccccttccatcctgctcctctgatactgtgcccccttggagatatttccgtcctccacccacgtgtctgtggctggaactgcccagcctgctcctggccccctggaagcctccccacagctggtaatctggacttaaggattgctgggccaccgcctctctgcctaccaccattccatatttaagtggagcccctacgtagaaaggccccggggctttattttagtctccttttcagggatgtcgtgggcgggggagggggttcttggtgctacagccctctccccacccctaaagggacgccgacgctgtttgctgccttcaccacatattagtgcttgaccctggcaggggaccccatggaaaagatggggaagagcaaaatacatggagacgacgcaccctccaggatgctcgctgggattcccacgcccaccactgtcccccaccccatggctgggaggggcctctgaacggaacagtgtccccacagagcgaataaagccaaggcttcttccc

SEQ ID NO: 26458 - DNA, 2788 bp, Homo sapiens
gaagaaatgagtgaggtggatgcttcagcgctgttagtctcctccccatgcccctcctcacttcatctagtttagtccctttatcctgtgaagtaggggtcatcattagcccccttttacagaggagagaattgaggcttcgagagagagaaacttggccaggagtttccactcggtccgacgccctcggtgccccgccgggtgcatcaccaggtccttttaccggaatgtggtgggtgtcctgctggtctttgatgtgacaaacaggaagtcctttgaacacatccaagactggcaccaggaggtcatggccactcagggcccggacaaggtcatcttcctgctggttggccacaagagtgacctgcagagcacccgctgtgtctcagcccaggaggccgaggagctagctgcctccctgggcatggccttcgtggagacctcggttaaaaacaactgcaatgtggacctggcctttgacaccctcgctgatgctatccagcaggccctgcagcagggggacatcaagctagaagagggctgggggggtgtccggctcatccacaagacccaaatccccaggtcccccagcaggaagcagcactcaggcccatgccagtgttgactctaggagagaaagggttaaagcagtcccagccttagcccacctggtgggatggggagtgttaatatctctctggaggacaaatgacagaagggttcatataaacagtatcctgacacagtcatgcttcctggattttggagtcgaggctttctacagaaaagaaagttctgatggccaggcatggtggctcacgcctgtaatcctagcatttttggaggccaaggacagtggatcacctgaggtcaggggttcgagaccagcctggccaacatggtgaaaccctgtctctactaaaaatacaaaaattagccaggcgtggtggtgcatgcctgtaatcccagttactccagaggctaaggcaggagaattgcttgaacctgggaggcagagattgcagtgagccaagactgcgccactgcactccagcctgggcaacagagtgagactctgtttcaaaaaaaaaaaagaaaagaaaagaaaggcctgagagaccagatgtgcaacttcctgtccttgagcctcagtgtccctatctatcgatggggctcataaaagatcccaccttgaagggaggtggtgaccacaaatgagacagtggacaggatgtgctcacccagagcctgccgcgctgtgaattgaatgacaaaagctctcattcccactccctttttcttggctgcgatgtggccactctggcagcattcctgggctcagacactgagaagccagcgtcaggaagctgatgcatgggcaaaggcaggtgcggggaattccagggggagcttggcttggaggcttcttatgtcctcaggctaaaatgattctgggcatgggattaatatgtgacgtcaaacccagggttgctggccaatgcccccccgaccaggcccaggggctgaaaaatggatgttggaggctgggatgaacatgaatgtgtagcaactatgttgggcacacagtggccactgtgatgagccaccaagatccccctttctggctggggaacccatcaaccctctccccagctgctggagtgccactggatgatggacttcagcttgccccactctctgggaaaggccctcccttcagggcagcttgtatccaaagttcatctcctggggggccttaaaggactccctcttgccccagctctggacaactctgaaagtcaaaaccaactttatcagtctctgtgggcttcattgaggacactgttgtgacatcatagccaagttatccccttgcccaatcctgcttccttttcttccccaaacaggtatccatttcaagaatatcccctaataaacatctgcacactcatctccatctcagaatctgcctcctggtaacctaacctatgatgggaactgctaggcagggaatgtcctgggagcaattagggaaggcttcatggaagagacactgtttatgttaggccgaatctcagcaggtgtagggcttagtgggtatcattgtgctgtagcaaaaagcacagccactttgctgggtgcagtggctcacgcctgtaatcccagcactttcggaggcctaggcaggcagttcacttgaggttgggagttcgagaccagtatggccaacacggcgaaaccctgtctatactaaaaatacaaaaattagctgggtgtggtggctcatgcctgtaatcccagcacttaggaggctgaagcatgagaattgcttgagcccaggaggcagaggttgcagcgagccacgatcccgccactgcactccagccctctaacttgggtggcagagcaacactccgtctcataaaaaaagaaaaaagcatagtcacttaactctcttttgtgaccttgagctagttacttggcctccttgagccttggtttcctcctcagtcagtaacatgagactgataatccctccctcctagggttcttagaaggttttcagaatgagtttcttagcttcctccccatggagagggggctgaggggtcttcctgtgcacttggtcctgcctctttttttttttaaacccataaaaattcacctgttttattttgtggggggtggggaatatccattacctcagacatttatattttatttgtattacaaacaatccagttatacgtttttatttctaaatgtacaataaattactgttgactgt

SEQ ID NO: 26459 - DNA, 2817 bp, Homo sapiens
gaggccgagggctgccgctaccaatttcgggtcgcgctgctgggggacgcggcggtgggcaagacgtcgctgctgcggagctacgtggcaggcgcgcctggcgccccggagccggagcccgagcccgagcccacggtgggcgccgagtgctaccgccgcgcgctgcagctgcgggccgggccgcgggtcaagctgcaactctgggacaccgcgggccacgagcgcttcaggtgcatcaccaggtccttttaccggaatgtggtgggtgtcctgctggtctttgatgtgacaaacaggaagtcctttgaacacatccaagactggcaccaggaggtcatggccactcagggcccggacaaggtcatcttcctgctggttggccacaagagtgacctgcagagcacccgctgtgtctcagcccaggaggccgaggagctagctgcctccctgggcatggccttcgtggagacctcggttaaaaacaactgcaatgtggacctggcctttgacaccctcgctgatgctatccagcaggccctgcagcagggggacatcaagctagaagagggctgggggggtgtccggctcatccacaagacccaaatccccaggtcccccagcaggaagcagcactcaggcccatgccagtgttgactctaggagagaaagggttaaagcagtcccagccttagcccacctggtgggatggggagtgttaatatctctctggaggacaaatgacagaagggttcatataaacagtatcctgacacagtcatgcttcctggattttggagtcgaggctttctacagaaaagaaagttctgatggccaggcatggtggctcacgcctgtaatcctagcatttttggaggccaaggacagtggatcacctgaggtcaggggttcgagaccagcctggccaacatggtgaaaccctgtctctactaaaaatacaaaaattagccaggcgtggtggtgcatgcctgtaatcccagttactccagaggctaaggcaggagaattgcttgaacctgggaggcagagattgcagtgagccaagactgcgccactgcactccagcctgggcaacagagtgagactctgtttcaaaaaaaaaaaagaaaagaaaagaaaggcctgagagaccagatgtgcaacttcctgtccttgagcctcagtgtccctatctatcgatggggctcataaaagatcccaccttgaagggaggtggtgaccacaaatgagacagtggacaggatgtgctcacccagagcctgccgcgctgtgaattgaatgacaaaagctctcattcccactccctttttcttggctgcgatgtggccactctggcagcattcctgggctcagacactgagaagccagcgtcaggaagctgatgcatgggcaaaggcaggtgcggggaattccagggggagcttggcttggaggcttcttatgtcctcaggctaaaatgattctgggcatgggattaatatgtgacgtcaaacccagggttgctggccaatgcccccccgaccaggcccaggggctgaaaaatggatgttggaggctgggatgaacatgaatgtgtagcaactatgttgggcacacagtggccactgtgatgagccaccaagatccccctttctggctggggaacccatcaaccctctccccagctgctggagtgccactggatgatggacttcagcttgccccactctctgggaaaggccctcccttcagggcagcttgtatccaaagttcatctcctggggggccttaaaggactccctcttgccccagctctggacaactctgaaagtcaaaaccaactttatcagtctctgtgggcttcattgaggacactgttgtgacatcatagccaagttatccccttgcccaatcctgcttccttttcttccccaaacaggtatccatttcaagaatatcccctaataaacatctgcacactcatctccatctcagaatctgcctcctggtaacctaacctatgatgggaactgctaggcagggaatgtcctgggagcaattagggaaggcttcatggaagagacactgtttatgttaggccgaatctcagcaggtgtagggcttagtgggtatcattgtgctgtagcaaaaagcacagccactttgctgggtgcagtggctcacgcctgtaatcccagcactttcggaggcctaggcaggcagttcacttgaggttgggagttcgagaccagtatggccaacacggcgaaaccctgtctatactaaaaatacaaaaattagctgggtgtggtggctcatgcctgtaatcccagcacttaggaggctgaagcatgagaattgcttgagcccaggaggcagaggttgcagcgagccacgatcccgccactgcactccagccctctaacttgggtggcagagcaacactccgtctcataaaaaaagaaaaaagcatagtcacttaactctcttttgtgaccttgagctagttacttggcctccttgagccttggtttcctcctcagtcagtaacatgagactgataatccctccctcctagggttcttagaaggttttcagaatgagtttcttagcttcctccccatggagagggggctgaggggtcttcctgtgcacttggtcctgcctctttttttttttaaacccataaaaattcacctgttttattttgtggggggtggggaatatccattacctcagacatttatattttatttgtattacaaacaatccagttatacgtttttatttctaaatgtacaataaattactgttgactgt

SEQ ID NO: 26460 - DNA, 549 bp, Homo sapiens
tttttttggagagagacggggtctcgctatgttgaccaacctgcttttgaaattcactgggataagaggcaaggtagagactaggctccctcagagaaactataagtcatttgtctccctaccttccttccctctaggtgctgtgagaagccatctttccgacttcaaaaaacaccgagctgctagaattgaccactatgttgtggaagtcaataaactaataatcaggttagagaaggtaaattttgttgtcttaaaacatttttttctacaaatacacattttctggggaaaaataatcacatttctatagcctgtgttgtatatatcatatacatctgatggtggcagagaaacaccttctctagagaggtgcaaaggacatggtggacagttctagcctgggccagcattccttaagagaatggcccaggttgacaaacttgccacatgcttagcttcccttttcccacctatgaatcccactcaggtgctggaaaacctttcttccttcagattcttcttttgggtgtcccaggcacaatcatc

SEQ ID NO: 26461 - DNA, 3675 bp, Homo sapiens
gagcgaccgatggagatggcggctgcggctgagtgacggacggtggaggcccagagcccgggcctgaagggggggacaaacctgggtgcccgcaggagcccggcagggtactgtgctaaaccctggggagacggcgaagtggaaaacatatagagtctgtgccctcccagattttacagtcttacttggtcacttcacgtatgtacctgcggttataaattgagatgagtgctgtgaaggagaagtccattctgatgctctgagtgtcttacaagtatcaagaacttactatatgtggttgaataaacaatcaaggtaaagagcatcaagtaaaaacttctgcttgttgataagtacttcagacattcccccagtggctgaagtggcatatgaattatgaagttggatcatttggaatgaatgtagagaatgccaagggctcctcctactccagagaggaaacctcatccagggccatgaagccacttcctcaccatctgtgtgctgcttaagctaatgctgcgggaaccatggttccttgggaggaatcaagctgactcttggcatgagattcctgccttcctagggttgagagcggcactgccatggcttctctggacgacccaggggaagtgagggagggcttcctctgccctctgtgcctgaaggatctgcagtctttctatcagcttcactcacattacgaggaagaacactcaggggaagaccgtgatgtcaaagggcaaattaaaagtcttgtccagaaggctaaaaaagcaaaggacaggttgttgaaacgagaaggggatgatcgagcagagtcagggacccaaggatatgagtctttcagctatggaggggttgatccttacatgtgggaaccccaggagcttggtgctgtgagaagccatctttccgacttcaaaaaacaccgagctgctagaattgaccactatgttgtggaagtcaataaactaataatcaggttagagaagctcactgcatttgacagaacaaatactgagtctgcaaagattcgagcaatagaaaagtctgtggtgccttgggtcaacgaccaggatgtccctttctgtccagactgtgggaataagttcagcatccggaaccgccgccaccactgccgcctctgcgggtctattatgtgcaagaagtgtatggagctcatcagccttcccttggcaaacaagctcaccagtgccagcaaggagtccctgagcacccacaccagccccagccagtcacccaacagtgtccatggctcccgccgaggcagcatcagcagcatgagcagtgtcagctcggtcctggatgagaaggacgatgaccggatccgctgctgtacacactgcaaggacacgctgctcaagagagagcagcagattgatgagaaggagcacacacctgacatcgtgaagctctacgagaaattacgactttgcatggagaaagttgaccagaaagctccagaatacatcaggatggcagcatcattaaatgctggggagacaacctacagtctggaacatgccagtgaccttcgagtggaagtgcagaaagtgtatgagctgatagacgctttaagtaagaagatcttaaccttgggcttgaaccaggaccctccaccacatccaagcaatttgcggctgcagagaatgatcagatactcagctacactttttgtgcaggaaaagttgcttggtttgatgtcactgccaaccaaagaacagtttgaggaactgaaaaagaaaaggaaggaggaaatggagaggaagagggccgtggagagacaagctgctctggagtcccagcgaaggcttgaggaaaggcagagtggcctggcttctcgagcggccaacggggaggtggcatctctccgcaggggccctgcccccttgagaaaggctgagggctggctcccactgtcaggaggtcaggggcagagtgaggactcagacccgctcctccagcagatccacaacatcacatcattcatcaggcaggccaaggccgcgggccgcatggatgaagtgcgcactctgcaggagaacctgcggcagctgcaggacgagtatgaccagcagcagacagagaaggccatcgagctgtcccggaggcaggctgaggaggaggacctgcagcgggaacagctgcagatgttgcgtgaacgggagttggaacgagaaagggagcagtttcgggtggcatccctgcacacacggactcggtccctggacttcagagaaatcggcccttttcagctggagcccagcagagagcctcgcacccaccttgcttatgctttggatctaggctcttccccagttccaagcagcacagctcccaagaccccttcacttagctcaactcaacccaccagagtgtggtctgggcccccagccgttggccaggagcgcttaccccagagcagcatgccacagcaacatgaggggccctccttaaacccctttgatgaggaagacctctccagccccatggaagaggccactactggtcctcctgctgcaggggtttccttagacccttcagcccgcatcctgaaagagtacaatcctttcgaggaagaggacgaggaggaggaagcagtggcagggaatccattcattcagccagacagcccagctcctaaccccttcagtgaggaagacgaacatccccagcagaggctctcaagccctctggttcctggtaacccctttgaggaacccacctgtatcaacccctttgagatggacagtgacagtgggccagaggctgaggagcccatagaggaagagctcctcctgcagcagatcgataacatcaaggcatacatctttgatgccaagcagtgcggccgcctggatgaggtagaggtgctgacagagaatctgcgggagctgaagcacaccctggccaagcagaaggggggcactgactgaccagcagtggagagggcacctttgggcccaggggtctggcaggagccagtggagcaggacagagggcaggcaggatggatggggaaggtggcagggtgagaactcagatgcacacaggtgaggggcaggaatctgctgttttgtgttgcgcactttgaggtatttccactacagttgaataataaaatagaaactagaacagggagaatcagcattcagttgctgcttttcctgtttattattactatcttttgtaatcggaggtttaccccttttgaagggactttacatttttactaccgagatataactaaatgcagctctgttgggcccagggcagaaatggctgctgtgtacctcttgggtccatttgctactgcctagtcttggttccttatgcagtattatagggcagcctttttagagcccttcctttagccaagacagagaagatagattccactgagctctattctgctctgacagaagtccatccctagtaggctgtgagttccatttcacctggggccgcctctcccctgctctgcacttcctgtctgtacaatagaagggggaggtgctgctatgaaggggagagtttagacccaggagagcccagcacctctttttaaggtggggtgatgggaatatttcaccagggtctattttctcagtttaagttcttttttgtctctttcaggaagttaagctccca

SEQ ID NO: 26462 - DNA, 2918 bp, Homo sapiens
tttttttggagagagacggggtctcgctatgttgaccaacctgcttttgaaattcactgggataagaggcaaggtagagactaggctccctcagagaaactataagtcatttgtctccctaccttccttccctctaggtgctgtgagaagccatctttccgacttcaaaaaacaccgagctgctagaattgaccactatgttgtggaagtcaataaactaataatcaggttagagaagctcactgcatttgacagaacaaatactgagtctgcaaagattcgagcaatagaaaagtctgtggtgccttgggtcaacgaccaggatgtccctttctgtccagactgtgggaataagttcagcatccggaaccgccgccaccactgccgcctctgcgggtctattatgtgcaagaagtgtatggagctcatcagccttcccttggcaaacaagctcaccagtgccagcaaggagtccctgagcacccacaccagccccagccagtcacccaacagtgtccatggctcccgccgaggcagcatcagcagcatgagcagtgtcagctcggtcctggatgagaaggacgatgaccggatccgctgctgtacacactgcaaggacacgctgctcaagagagagcagcagattgatgagaaggagcacacacctgacatcgtgaagctctacgagaaattacgactttgcatggagaaagttgaccagaaagctccagaatacatcaggatggcagcatcattaaatgctggggagacaacctacagtctggaacatgccagtgaccttcgagtggaagtgcagaaagtgtatgagctgatagacgctttaagtaagaagatcttaaccttgggcttgaaccaggaccctccaccacatccaagcaatttgcggctgcagagaatgatcagatactcagctacactttttgtgcaggaaaagttgcttggtttgatgtcactgccaaccaaagaacagtttgaggaactgaaaaagaaaaggaaggaggaaatggagaggaagagggccgtggagagacaagctgctctggagtcccagcgaaggcttgaggaaaggcagagtggcctggcttctcgagcggccaacggggaggtggcatctctccgcaggggccctgcccccttgagaaaggctgagggctggctcccactgtcaggaggtcaggggcagagtgaggactcagacccgctcctccagcagatccacaacatcacatcattcatcaggcaggccaaggccgcgggccgcatggatgaagtgcgcactctgcaggagaacctgcggcagctgcaggacgagtatgaccagcagcagacagagaaggccatcgagctgtcccggaggcaggctgaggaggaggacctgcagcgggaacagctgcagatgttgcgtgaacgggagttggaacgagaaagggagcagtttcgggtggcatccctgcacacacggactcggtccctggacttcagagaaatcggcccttttcagctggagcccagcagagagcctcgcacccaccttgcttatgctttggatctaggctcttccccagttccaagcagcacagctcccaagaccccttcacttagctcaactcaacccaccagagtgtggtctgggcccccagccgttggccaggagcgcttaccccagagcagcatgccacagcaacatgaggggccctccttaaacccctttgatgaggaagacctctccagccccatggaagaggccactactggtcctcctgctgcaggggtttccttagacccttcagcccgcatcctgaaagagtacaatcctttcgaggaagaggacgaggaggaggaagcagtggcagggaatccattcattcagccagacagcccagctcctaaccccttcagtgaggaagacgaacatccccagcagaggctctcaagccctctggttcctggtaacccctttgaggaacccacctgtatcaacccctttgagatggacagtgacagtgggccagaggctgaggagcccatagaggaagagctcctcctgcagcagatcgataacatcaaggcatacatctttgatgccaagcagtgcggccgcctggatgaggtagaggtgctgacagagaatctgcgggagctgaagcacaccctggccaagcagaaggggggcactgactgaccagcagtggagagggcacctttgggcccaggggtctggcaggagccagtggagcaggacagagggcaggcaggatggatggggaaggtggcagggtgagaactcagatgcacacaggtgaggggcaggaatctgctgttttgtgttgcgcactttgaggtatttccactacagttgaataataaaatagaaactagaacagggagaatcagcattcagttgctgcttttcctgtttattattactatcttttgtaatcggaggtttaccccttttgaagggactttacatttttactaccgagatataactaaatgcagctctgttgggcccagggcagaaatggctgctgtgtacctcttgggtccatttgctactgcctagtcttggttccttatgcagtattatagggcagcctttttagagcccttcctttagccaagacagagaagatagattccactgagctctattctgctctgacagaagtccatccctagtaggctgtgagttccatttcacctggggccgcctctcccctgctctgcacttcctgtctgtacaatagaagggggaggtgctgctatgaaggggagagtttagacccaggagagcccagcacctctttttaaggtggggtgatgggaatatttcaccagggtctattttctcagtttaagttcttttttgtctctttcaggaagttaagctccca

SEQ ID NO: 26463 - DNA, 3519 bp, Homo sapiens
gagcgaccgatggagatggcggctgcggctgagtgacggacggtggaggcccagagcccgggcctgaagggggggacaaacctgggtgcccgcaggagcccggcagggtgtcttacaagtatcaagaacttactatatgtggttgaataaacaatcaaggtaaagagcatcaagtaaaaacttctgcttgttgataagtacttcagacattcccccagtggctgaagtggcatatgaattatgaagttggatcatttggaatgaatgtagagaatgccaagggctcctcctactccagagaggaaacctcatccagggccatgaagccacttcctcaccatctgtgtgctgcttaagctaatgctgcgggaaccatggttccttgggaggaatcaagctgactcttggcatgagattcctgccttcctagggttgagagcggcactgccatggcttctctggacgacccaggggaagtgagggagggcttcctctgccctctgtgcctgaaggatctgcagtctttctatcagcttcactcacattacgaggaagaacactcaggggaagaccgtgatgtcaaagggcaaattaaaagtcttgtccagaaggctaaaaaagcaaaggacaggttgttgaaacgagaaggggatgatcgagcagagtcagggacccaaggatatgagtctttcagctatggaggggttgatccttacatgtgggaaccccaggagcttggtgctgtgagaagccatctttccgacttcaaaaaacaccgagctgctagaattgaccactatgttgtggaagtcaataaactaataatcaggttagagaagctcactgcatttgacagaacaaatactgagtctgcaaagattcgagcaatagaaaagtctgtggtgccttgggtcaacgaccaggatgtccctttctgtccagactgtgggaataagttcagcatccggaaccgccgccaccactgccgcctctgcgggtctattatgtgcaagaagtgtatggagctcatcagccttcccttggcaaacaagctcaccagtgccagcaaggagtccctgagcacccacaccagccccagccagtcacccaacagtgtccatggctcccgccgaggcagcatcagcagcatgagcagtgtcagctcggtcctggatgagaaggacgatgaccggatccgctgctgtacacactgcaaggacacgctgctcaagagagagcagcagattgatgagaaggagcacacacctgacatcgtgaagctctacgagaaattacgactttgcatggagaaagttgaccagaaagctccagaatacatcaggatggcagcatcattaaatgctggggagacaacctacagtctggaacatgccagtgaccttcgagtggaagtgcagaaagtgtatgagctgatagacgctttaagtaagaagatcttaaccttgggcttgaaccaggaccctccaccacatccaagcaatttgcggctgcagagaatgatcagatactcagctacactttttgtgcaggaaaagttgcttggtttgatgtcactgccaaccaaagaacagtttgaggaactgaaaaagaaaaggaaggaggaaatggagaggaagagggccgtggagagacaagctgctctggagtcccagcgaaggcttgaggaaaggcagagtggcctggcttctcgagcggccaacggggaggtggcatctctccgcaggggccctgcccccttgagaaaggctgagggctggctcccactgtcaggaggtcaggggcagagtgaggactcagacccgctcctccagcagatccacaacatcacatcattcatcaggcaggccaaggccgcgggccgcatggatgaagtgcgcactctgcaggagaacctgcggcagctgcaggacgagtatgaccagcagcagacagagaaggccatcgagctgtcccggaggcaggctgaggaggaggacctgcagcgggaacagctgcagatgttgcgtgaacgggagttggaacgagaaagggagcagtttcgggtggcatccctgcacacacggactcggtccctggacttcagagaaatcggcccttttcagctggagcccagcagagagcctcgcacccaccttgcttatgctttggatctaggctcttccccagttccaagcagcacagctcccaagaccccttcacttagctcaactcaacccaccagagtgtggtctgggcccccagccgttggccaggagcgcttaccccagagcagcatgccacagcaacatgaggggccctccttaaacccctttgatgaggaagacctctccagccccatggaagaggccactactggtcctcctgctgcaggggtttccttagacccttcagcccgcatcctgaaagagtacaatcctttcgaggaagaggacgaggaggaggaagcagtggcagggaatccattcattcagccagacagcccagctcctaaccccttcagtgaggaagacgaacatccccagcagaggctctcaagccctctggttcctggtaacccctttgaggaacccacctgtatcaacccctttgagatggacagtgacagtgggccagaggctgaggagcccatagaggaagagctcctcctgcagcagatcgataacatcaaggcatacatctttgatgccaagcagtgcggccgcctggatgaggtagaggtgctgacagagaatctgcgggagctgaagcacaccctggccaagcagaaggggggcactgactgaccagcagtggagagggcacctttgggcccaggggtctggcaggagccagtggagcaggacagagggcaggcaggatggatggggaaggtggcagggtgagaactcagatgcacacaggtgaggggcaggaatctgctgttttgtgttgcgcactttgaggtatttccactacagttgaataataaaatagaaactagaacagggagaatcagcattcagttgctgcttttcctgtttattattactatcttttgtaatcggaggtttaccccttttgaagggactttacatttttactaccgagatataactaaatgcagctctgttgggcccagggcagaaatggctgctgtgtacctcttgggtccatttgctactgcctagtcttggttccttatgcagtattatagggcagcctttttagagcccttcctttagccaagacagagaagatagattccactgagctctattctgctctgacagaagtccatccctagtaggctgtgagttccatttcacctggggccgcctctcccctgctctgcacttcctgtctgtacaatagaagggggaggtgctgctatgaaggggagagtttagacccaggagagcccagcacctctttttaaggtggggtgatgggaatatttcaccagggtctattttctcagtttaagttcttttttgtctctttcaggaagttaagctccca

SEQ ID NO: 26464 - DNA, 3122 bp, Homo sapiens
tcatcctagttgtgcttgttgtgtgtaacctggattgtgtgctgggcatagtagcaagcacaagtacagttctttatgtgtactttgtaaggcagaaatatgtggccagttttagggtccaggagcaccgtggagaatggagagttttctgttgctttcagtcgttgcccttacccatccttgcctacccctggttattgctaaaatgggtaactgacaataaagagattagaagtgggttataggaagcgaggtgggttctagatgcaaaactaataccctgtcccatgtgaaattgtttttgtgattttgtggcgttggggatgacagatgagacttgaggaatgcaaatgtgctaatttcccacttgatgtattggaaagtgtggagcatgtatacatcacctggttaatttcatttggcactattttcttccggtcagctcactgcatttgacagaacaaatactgagtctgcaaagattcgagcaatagaaaagtctgtggtgccttgggtcaacgaccaggatgtccctttctgtccagactgtgggaataagttcagcatccggaaccgccgccaccactgccgcctctgcgggtctattatgtgcaagaagtgtatggagctcatcagccttcccttggcaaacaagctcaccagtgccagcaaggagtccctgagcacccacaccagccccagccagtcacccaacagtgtccatggctcccgccgaggcagcatcagcagcatgagcagtgtcagctcggtcctggatgagaaggacgatgaccggatccgctgctgtacacactgcaaggacacgctgctcaagagagagcagcagattgatgagaaggagcacacacctgacatcgtgaagctctacgagaaattacgactttgcatggagaaagttgaccagaaagctccagaatacatcaggatggcagcatcattaaatgctggggagacaacctacagtctggaacatgccagtgaccttcgagtggaagtgcagaaagtgtatgagctgatagacgctttaagtaagaagatcttaaccttgggcttgaaccaggaccctccaccacatccaagcaatttgcggctgcagagaatgatcagatactcagctacactttttgtgcaggaaaagttgcttggtttgatgtcactgccaaccaaagaacagtttgaggaactgaaaaagaaaaggaaggaggaaatggagaggaagagggccgtggagagacaagctgctctggagtcccagcgaaggcttgaggaaaggcagagtggcctggcttctcgagcggccaacggggaggtggcatctctccgcaggggccctgcccccttgagaaaggctgagggctggctcccactgtcaggaggtcaggggcagagtgaggactcagacccgctcctccagcagatccacaacatcacatcattcatcaggcaggccaaggccgcgggccgcatggatgaagtgcgcactctgcaggagaacctgcggcagctgcaggacgagtatgaccagcagcagacagagaaggccatcgagctgtcccggaggcaggctgaggaggaggacctgcagcgggaacagctgcagatgttgcgtgaacgggagttggaacgagaaagggagcagtttcgggtggcatccctgcacacacggactcggtccctggacttcagagaaatcggcccttttcagctggagcccagcagagagcctcgcacccaccttgcttatgctttggatctaggctcttccccagttccaagcagcacagctcccaagaccccttcacttagctcaactcaacccaccagagtgtggtctgggcccccagccgttggccaggagcgcttaccccagagcagcatgccacagcaacatgaggggccctccttaaacccctttgatgaggaagacctctccagccccatggaagaggccactactggtcctcctgctgcaggggtttccttagacccttcagcccgcatcctgaaagagtacaatcctttcgaggaagaggacgaggaggaggaagcagtggcagggaatccattcattcagccagacagcccagctcctaaccccttcagtgaggaagacgaacatccccagcagaggctctcaagccctctggttcctggtaacccctttgaggaacccacctgtatcaacccctttgagatggacagtgacagtgggccagaggctgaggagcccatagaggaagagctcctcctgcagcagatcgataacatcaaggcatacatctttgatgccaagcagtgcggccgcctggatgaggtagaggtgctgacagagaatctgcgggagctgaagcacaccctggccaagcagaaggggggcactgactgaccagcagtggagagggcacctttgggcccaggggtctggcaggagccagtggagcaggacagagggcaggcaggatggatggggaaggtggcagggtgagaactcagatgcacacaggtgaggggcaggaatctgctgttttgtgttgcgcactttgaggtatttccactacagttgaataataaaatagaaactagaacagggagaatcagcattcagttgctgcttttcctgtttattattactatcttttgtaatcggaggtttaccccttttgaagggactttacatttttactaccgagatataactaaatgcagctctgttgggcccagggcagaaatggctgctgtgtacctcttgggtccatttgctactgcctagtcttggttccttatgcagtattatagggcagcctttttagagcccttcctttagccaagacagagaagatagattccactgagctctattctgctctgacagaagtccatccctagtaggctgtgagttccatttcacctggggccgcctctcccctgctctgcacttcctgtctgtacaatagaagggggaggtgctgctatgaaggggagagtttagacccaggagagcccagcacctctttttaaggtggggtgatgggaatatttcaccagggtctattttctcagtttaagttcttttttgtctctttcaggaagttaagctccca

SEQ ID NO: 26465 - DNA, 481 bp, Homo sapiens
atcagcaattaaaggcttgaggacagatacacagtcacttttcacagtcattgccagaacttgacacacagcttcacaaagtcacaagggtcaaaaatcactatcttcctctgttcaaaagggaaagagctggaaacattggccaagaacattaatgactcctacaatagggaaggactttgtaagcttaaaagcagtgtaagtgcagtggctcacgcctgtaatcctagcacttcaggaggccgaggcgggtggattgcctgagctcaggagttcaagaccagcctgggcaacatgggcctctctaccaaaatacaatacgttctcgggcgtgacggcatgtgcctgtaatcccagctgctcaggaggctgagataggagaattgcttgaacccgggaggcggaggttgcagcgagctgagattgtgccattgcattccagcctgggtgacagagcaggactccgtctcaaaaaaaaaaa

SEQ ID NO: 26466 - DNA, 394 bp, Homo sapiens
cctcctatatggtaagcaactgtaggcactgaggatacaatggggttatggactgaatgtttgtgtccctccccaaattcctgtgttgaagccctaaccccaaaggtggctatatttggagatgagacctctacagaagtaactaaggttaaatgggatcataagggtggggccctgattcaataagattagtgtccttgtaagaagagaaaccaaacagcttgctatctcacacgtgcacgctccctctctctgtgcatactcaccaaggaaagactatgtgaagacatggctatctacaggccaagagaaggaccctcatcagaaactgaacaggccagaatgttgatcttggacttctggcttccagaacggtgagaaaataaacttctgt

SEQ ID NO: 26467 - DNA, 568 bp, Homo sapiens
cagtggttaagtgtaaaatgtttattttagtgaaatacaagaaggtgagcaatttccaatttccgtttaacttgacttattaaaaataagtctcattcacattcttctagtattattgtatactgctataaaatttaaaccagaaaagtgcttctccttgtcagtagctatctgcccaaaaaaatgaatatgacaattccagatctcatctgccatctctaagaaagccacttggaaatgttagataggtcccatgggtcctgatccagggatctgtccctgggtccccatcaggctcggctgcaggcagttgcctaaggcgtcttccgccttcagccacgctgcaatccttgctccaggcactgcggcaggttctctccatgcccccaggaagactctccaaacccgaccagctcatttctcctgccccggaggatccagacgccctggcagctcctgggctccagaaccgagaatgggatgctgcctccaatcccaattgccctaagtttctttccagagggccgggagactgctccaagtttgctgtggcgggcgagcggccgcg

SEQ ID NO: 26468 - DNA, 576 bp, Homo sapiens
gcgtgagattggtattgtatcaccattttcctgatgaggaaattgagtgacacagattatgtggccatagtcaatgttcgttatatgtgggagttgtgcttctggaaagaatcttacagataaaaaagttgtaagatgggagaacccaatatcatgtaataggttttcacagaagctgcagagtgaatttttgtattttagcaacactaatgttcaaattagtttgggccttcttataaaatgaatcatgactgtcacacattgacccctctaaatctgctcagctcggttttatgctgattgtcagtattgagctgacttctataaaaccgatgagattgctacttttagcttcatttatttttagtttttttttttttcttctgaagctacattgaaacttatgtaaaaatccaactgaagcataaaacaagcactggtgtatgcttgcctgggagctgcctgggagcaagaggagacagtcttgtcttaccaagtatgagagggtgctgaaggtttcttggtggttttcttcaaagttgtatcttgaggatatataacaattgcaaaaaaaaa

SEQ ID NO: 26469 - DNA, 360 bp, Homo sapiens
ctgacaaatttctccagtgcacccatgcactgtcttgcctctgagaatccctttccacctccactttcctgtctcactccgattcattcttcaggcctctgcttaaattcacttccaccaggaagcttcccctgtgtgagctgctcccttggttgggttgggaacaccagctctgtgttcccatctcctagtatgcattgcatggtgctttcccattccccatggcactgactacagggacaaggcctggagctcgctctcctgggtatctcagtgtctagtaggagctggcacagagcaggtacttcgtaagatttgctgaatgaatgagtgtgccggagaaagctggccagggcttta

SEQ ID NO: 26470 - DNA, 783 bp, Homo sapiens
agcagggggcgctgtgtgtaccgagaatacgagaatacctcgtgggccctgaccttctctctgagagccgggcagaggctccggagccatgcaggccgaaggccggggcacagggggttcgacgggcgatgctgatggcccaggaggccctggcattcctgatggcccagggggcaatgctggcggcccaggagaggcgggtgccacgggcggcagaggtccccggggcgcaggggcagcaagggcctcggggccgggaggaggcgccccgcggggtccgcatggcggcgcggcttcagggctgaatggatgctgcagatgcggggccagggggccggagagccgcctgcttgagttctacctcgccatgcctttcgcgacacccatggaagcagagctggcccgcaggagcctggcccaggatgccccaccgcttcccgtgccaggggtgcttctgaaggagttcactgtgtccggcaacatactgactatccgactgactgctgcagaccaccgccaactgcagctctccatcagctcctgtctccagcagctttccctgttgatgtggatcacgcagtgctttctgcccgtgtttttggctcagcctccctcagggcagaggcgctaagcccagcctggcgccccttcctaggtcatgcctcctcccctagggaatggtcccagcacgagtggccagttcattgtgggggcctgattgtttgtcgctggaggaggacggcttacatgtttgtttctgtagaaaataaaactgagctacga

SEQ ID NO: 26471 - DNA, 1022 bp, Homo sapiens
agcagggggcgctgtgtgtaccgagaatacgagaatacctcgtgggccctgaccttctctctgagagccgggcagaggctccggagccatgcaggccgaaggccggggcacagggggttcgacgggcgatgctgatggcccaggaggccctggcattcctgatggcccagggggcaatgctggcggcccaggagaggcgggtgccacgggcggcagaggtccccggggcgcaggggcagcaagggcctcggggccgggaggaggcgccccgcggggtccgcatggcggcgcggcttcagggctgaatggatgctgcagatgcggggccagggggccggagagccgcctgcttgagttctacctcgccatgcctttcgcgacacccatggaagcagagctggcccgcaggagcctggcccaggatgccccaccgcttcccgtgccaggggtgcttctgaaggagttcactgtgtccggcaacatactgactatgtcagttcaggaccaggacagggatggggcctgggtgggtggcggtcacagcgtggcagggtgggggctgggatccgcctacaccccacggtcaggctgctagaaacctgggaacaccccagcacagggtctcagaacagagacctggtacaccaggcccgccgccacccgagggagcccagggagatgggtgcagaggtgtcgcctttaacgtgatgttctctgcccctcacatttagccgactgactgctgcagaccaccgccaactgcagctctccatcagctcctgtctccagcagctttccctgttgatgtggatcacgcagtgctttctgcccgtgtttttggctcagcctccctcagggcagaggcgctaagcccagcctggcgccccttcctaggtcatgcctcctcccctagggaatggtcccagcacgagtggccagttcattgtgggggcctgattgtttgtcgctggaggaggacggcttacatgtttgtttctgtagaaaataaaactgagctacga

SEQ ID NO: 26472 - DNA, 226 bp, Homo sapiens
ggcgtttgctacagaatggtgaatttatgtatttctcttccactttgacatggacattgcctcattcttcagtagtgtgcatattcaccttaatttattcaaaagctattttacctttttcaataacaccacatcaattaccttaacttattcacttacatcagtcttccccatctacaagaaatattgaaatctattaattactaagggtgttttcaaattaaaa

SEQ ID NO: 26473 - DNA, 210 bp, Homo sapiens
gtatattgtctctggaaagcttccattcctttttaaaaatggtatttgtaccctaggtaatgcctcaaagtgtcatttgtctctaccctgttgagcccttacaaataataataaattgtataattggatacaaattataagattataaaaagaacgataagtatgaaacatacaaagattattaaaaaatgaagaactgaatttacaata

SEQ ID NO: 26474 - DNA, 290 bp, Homo sapiens
accaggagtgtttgaaggcctgctttgtaaccaactgcatcaacattagggaaatcaccaggtgctttcatcattttcttctgtaaaataaaaatttataatgtgcttacaaactacatagctctttgggaagtaggcaaattgaatttttcaaattctcagtggcaagctgggcagtaaaacataattactgatttttaatatgtactttgtggcccttgtaattcaaagatgatgattttgactatcatcactatcagtgtgaaacaacaggagctcaaagagaatcc

SEQ ID NO: 26475 - DNA, 357 bp, Homo sapiens
gatcactggagcccaggagttctgggctgtagttcactatgccagtctggtgtctgcattaagtttggcatcaatatggtaacctccagagagcaggggaccaccaggttacctaaggaggagtgagccagcccaggttgaaaacggaacaggccaaaactctcatgctgattagtagtgagattgagcctttgaatagccactgcactctagcctgggcaacatcgtgagaccccatctcttttaaaaaagaagtggccaagaagcatatgaaaagatgctcaacatcactcatcattagggaaataggaatcaaaaccacagtgaaatactacttcacacccgttaggatggcta

SEQ ID NO: 26476 - DNA, 536 bp, Homo sapiens
aaactgctgttaaaatattgaggtatttacttccagactgatttttctatacatatttatatagctatatatagttattcttttgtaagagtgactataaactgttttgaaactggcttttttaacataacaatatatgtgagcacattttccacatccccaaatatttttgaaaaatatttcttttaaatatctgcatagttttgtacccattataatttggctctggaagaagttcaagatatgccaaatagtcttggcacaatggctcacacctgtaattctgacacttttgggggccgaggtaggaggatcacttgaggccaggagttcgagaccagcttggtcaacctagcaagagctatttccacaaaaaagtgaaaaaactacccgggcgtggtaacactcccatagtcctagctacttaggaggctgaggtcaaaggattgcttgagcccaggagtttgaggctgcagtgagctatggtcgcaccactgcactccagcctgggtgacagagcaagaccttgtctctaa

SEQ ID NO: 26477 - DNA, 381 bp, Homo sapiens
gagacaaagtcttgctctgttgcctaggctggagtgggctggcgcgatctcgccttacttcagcctctacctcccgggttcaagcgattttcctgccttagcttcccctgtagctgggattacaggcacgcaccaccacatccggctattttttgtatttttagtagggatggggtttcaccatgttggctaggctggtctcgaactcccaacctcaagtgatctgtccaccttggcttcccaaagtggtgggattacaggcgggagccactgtgcctggctcttcttctcatttgttagaaaaatttttaaccttagctatcaccagaaggaacattttttcctgcagccccatcttttatctatcaataaggcattaat

SEQ ID NO: 26478 - DNA, 427 bp, Homo sapiens
ggtgcgacggcatttactgaatagctcttatgccagcttgcttcctcaacacgcaagtctacagattcccgactctccaagagttttcacagtaattcctaaacaaggtaaagacagaacaacactgggagatgggtgacatgggtaataggagggtagtatttgtattatgtagtcttttctcccttctgaatcatagaacatccctacttcttggttgttaccactatgtgacttgcatattaattacttccttttccttacatttttctcacttttgaaagaaatttaaattcattatggagttttatgggatgctttctctatcttaaacctactgaaactaaaatcgagttaaatgtatctgctccctgtaatttgtgaagattgaaacaatctggttgaatagtgctcaatatgtgggaac

SEQ ID NO: 26479 - DNA, 411 bp, Homo sapiens
tcaccggtgtccacagtccttgagagcaaaggtggtcccagcagtggagcagagggcaagggtggggcatgtagagtctccagggagccactgttggttagagagggagcccgaagtgggctccggaccccagcagggacagcgtccccttccagcgggggcagccgattgatctgggcacacgagcaggaggagcggcgccacccagggctgacctcacggccctgctcacgtctcggggcattttggcagacccacctagacctgggggacagcctgatttcctgcagccatgacctacaagggtggcagctctctcaggcttgagtaaccaggacacagacctgggccatttaatgcgcaggcagccccaagtcccggcagggccagaagcagagacggcggctgggg

SEQ ID NO: 26480 - DNA, 176 bp, Homo sapiens
ctcaatcatcaaaagaacatctaggtcagattaactaaatctcctaggctgctgtaatgtcaagatttctggcttatctcttaacatcttattgaattttaaaaactgcaagttgaaagcagaaatagaaaatgtaataaaaacatggagaagaatagaattctaattgggatgtt

SEQ ID NO: 26481 - DNA, 466 bp, Homo sapiens
gagtgtgtgtcccactgcggtgcaggatacgggagtactggcagccaggcctcgggcagccctgggggtgcttatggggcaggatggagtcacaccgataacttggggggatcacacacatgcccctacttctccaccctcttcctcttgaacttattattattattattattttgagacggagtttcactcttgttgtccaggctggagtgcaatggcgcgatctcggctcaccacaacctccacctcccaggttcatgcgattctccggcctcagcctccggagtggctgggattgcaggcatgcgccaccacatgtggttaattttgtatttttagtagagacatggtttcaccatgttggccaggctggtctcaaactcccgacctcaggcgatccacctgcctcggcctcccaaagtgctgggattccagtcgtgagccaccacgcccggcccctcttgaa

SEQ ID NO: 26482 - DNA, 379 bp, Homo sapiens
caaaaatagcactggtctgtacatgttgttctggatgtttatttttccatttaacaggtttccaatttatcatgatggctttttacctttatcagtatttaccgggatacttattagtttaatggttgcatgacaatgcactgtatgaatatatataaaattattagtctatttgaccaattcctgattgatagacatttctttttctgtaacaaataatactgcattgaaacttcatgtgtctttgtatatttggaaaaatatttctgtagattaattcttttttttttttttttttttgagacgcagtcttgctctgccgccagactggagtgcagtggcatgatctcagcccactgcaacctctgcctcctggatt

SEQ ID NO: 26483 - DNA, 814 bp, Homo sapiens
accatctgtttctcacacacatccatgagggaagaatcattcccatttaacagacaatgtaactgggcctgaatatagctcagcgacttgccccaggcccaccaggaagtggataaagccatgctcaacccagcacttcttctctctaccttccaccgatcctgcctgctcatcttccctccttggtgaaggcatgtgtgctgtgctctgcttaactaatttccctcagatattcgcatttctgtctttacaatttggcatcccagtgaggtttccctttgtatattttccggttcctatattcccattattcaggtatcatcactcaataaccatttgacagcagtaatgcttttcacatggaaagaattgggtttttattgatggcaaatgttgtgatgaactttcatgcccacttggagccggagcacttttttatagaatgaaccacaatgagaagcgtttccaagaaatgtctttggagtgtggactgagatgtacgtttaggaacaggtcctgtggccagagtggggagagaggggccttcccattgtcaaaatctcatcaatcaaaatgtataatagcaacattattaataaccctatagttgcattgcacttggtgctcttccaagcacttccctagaatcctaaaatgaaggcagggcagatattatatccatgttacaggttaaacaacattgtaacaggactgataacaccatgaatgagaagtcatttgatcaatgggtaagtgtctcatgagaaagagacttttagtaggcctgaaatctgtctttgggggtcatagatgc

SEQ ID NO: 26484 - DNA, 411 bp, Homo sapiens
atattgaaatattatgagctgaataaagtttccaaaaattccataaggctgatgagactctgtcttctctacatcaccaaggtaatcaagggatagactggtgtcccaaagtcattaatataaagaaggtgatttttaaattcttttaattctttgtggctgtattattaaatggataccagatgattatcttggagtagatcatatcttgtagcagatcataatctattttccccatctcatttctctattactttccttccttattcctttatattttgccttcaataaggtacctcttgaatagagtgttatctaaaaaataaattttgtggccagacctaaaaaggcaaatcgagtcaactagcagctaacaggcagattagctgtcaggcagttcatactgcccga

SEQ ID NO: 26485 - DNA, 343 bp, Homo sapiens
ggtgcctgtagtcccagctacttgggaggctgcagcagaattgcttgaacctaggaggcagaggttgcagtgagcagagattgtgccattgcactccagcctgagcaacaaagtgagactcaatctcaaaaaaaaaaaacaaaaaaaggaggaggagaggtgtgtgataagtcctgatggccttaggtgtcctgactgtctaggcagccaaagggcacatggtaagccatccaaaagtgccttcagggcaaaagaatagaaagggggtcgctctgctcgtggggtacacggcagaggagtaagttttatgtcaaagcaggaatctgatcagaggttccgaatt

SEQ ID NO: 26486 - DNA, 1373 bp, Homo sapiens
tagctgggattagaggcatgcgccaccatgcccggctaatgttttgtatttttggtagagatggggtttcgccgtgttggccaggctggtcttgaactcctgacctcatgatccatctgcctgggcctcccaaggtgctgggattataggcgtgagccacgacgcctggccaacaatgtagtattttttctcttttctgaacctctcttccaatccttatatcttctctgactctgatcttcctgcctctcacttaaaaggactcttgtgattactttgcatgcattgggatcatctaggataatctccacatctcaatatgtttaagttaatcacatctggaaagttcctttaaccatgtaaagtaacatattcaaaagttttggagattaggatctgtagatctttgaggatgggaggcattattcagcctactgcagatgtaatttgataaatttttgcttggaatttttgcatctacataaggatattggtctgaagttttcttttgtttaatgtctttatctttggtatcggggtaatgctgacctcatagaatgggttgggaagtgtttcctgtttttggaagagtctgtgtacaattggtatcatttcttaaattttagagtttaccagtaagttttatttgtgggaaggtttaagactacaatttcaatttttaaaatatatatagggctattcaggttatatttcttcttgtgtgaggattggtaattagtattttaaagaaagttcttcatttcatgtagtttatcaaattaatttttgtaaagttgttaatatcctcttatcattttgtataaattgttaaaacgattctaaaattgataagaaaatgcaaagtagttagaatgtagtcaaagcaactctgaaaaaggaacaaagttggaagactaacacaatgtgataccacatttgtcattcctgatattaatagtttgtgcctttttccccttgatcatctggctaaagatttatcaattgtattgatcatctcaaagaatcacattttggtttaattgattttctctgttttctgttttctaattcattggtttctgctttatctttattgtttcgttttgcttattatccaaaaagtttatgatttttgtattacttagaactgtgttatttaacttccacatatttggacattttccagagatctttctgctattgacttctaatttaattacattatggtaaaggaatgtactttatatgacttgaatatgttaaaacatatcaaaacttgtttcatggcccagaatatggtctgtattggtaatatgtttcatgtgcacttgagaagaataaattttgctgttgttgagtagtcttctataaat

SEQ ID NO: 26487 - DNA, 378 bp, Homo sapiens
atccaccctgcctgccaggtggccatagggaccctcgccatactgtctgcttgtggcagtgccctccggcctggggggtcttccagagcagatctctggccaagcgcagtggctcatgcctgtaatctcagcactttcagaggctaaggcaggtggatcacctgaggtcaggagttcgagaccagccttgctaacatggtgaaaccccgtctctactaaaaatacaaaaattagccaggtgtggtggtgcacgcctgtagtcccagctactcaggaggctgaggtaggagaatctcttggacccgggaggtggaggttgcagtgagccgaaatggtgccactgcactccagcctgggcaacagtgagactctgtctta

SEQ ID NO: 26488 - DNA, 356 bp, Homo sapiens
tttttttttgagactgagtctctctcttgcccaggctggagtgcaatggcactatctcggctcacctcagcctccgcttaccgggttcaagcgattctcctgcctcaacctcccgcgtagctgggattacaggcatgcgccaccatgctcggctaattttgtatttttagtagaggcggggtttctccctgttgttcaggctggtctccaactcctgacctcgggtgatccacccgcctcggcctcccaaagtgctgggattacaggcgtgagccaccgcccccggccaccagttcatttttcaagtaatcagcttaaccttcttgccagtcaggccagagccatttaattcagtt

SEQ ID NO: 26489 - DNA, 334 bp, Homo sapiens
acaggtacattttatttattttcaaaaatcacttgcagaaatttagctaatgaactagtaagcaagaaaagtttccttttcttaataaaagcaaaaatacattatttagtgaaaatagaccaaaaagtttcattaacctaaagattaaaaacatatttatttagtttgatagtttatcaaaagcagaagcaggattgtaggattagcataatgatttcctcatctgctgtttcatagttataaagattttgcttacaaaggaagaagtcagattgtccttgtttgcagatgatatgatgttatatatggaaaaacctgaagactctacaaaaaa

SEQ ID NO: 26490 - DNA, 340 bp, Homo sapiens
  misc_feature (97)..(97): n is a, c, g, or t
  misc_feature (102)..(102): n is a, c, g, or t
  misc_feature (113)..(113): n is a, c, g, or t
  misc_feature (124)..(124): n is a, c, g, or t
taatattttcactccatggttggttgaatctgtggatgtggaaactgcagatacaaaggggcctattgtacagggtctatagactttattattagancctcnggagcttatantacaagtaatnatctaatgtggtgataaggataatgctgggattacaggcgtgagccaccgtgcctggcccatatcagctttttaatatcctgcctctttcacgtggccaaatgcatgttttctacagatactgcattattttaaataactgcataatatttcattaaagggatttaccatatcacagtttacccattctcctattattagactttagctcatttcc

SEQ ID NO: 26491 - DNA, 734 bp, Homo sapiens
ggaaaaggcaaaaacgaatggctttttctgcgagaaactaggactaatatagatatttgggagcactgaacatggaggatagagttaaacttgaaaagacatacagagatagaaaagcagcaactgccctttcatttgtatgcaagcacacgatatatgtatgggttttttattttttgcttgatgtattcatttccaaatcaaactataatgtgctctaattgggtctctttgttcagcacgtggttgttgatttgagtactttctccagttgaaaaactgacattttaattttgttattcaatgtgtgatagatttaaataaaaacacccaagattgtgtattgtagatttccttcaacaataattatatataattattttatcaaaataaacaagttaaagtagttttagttattttgtctcattttacatttgggaaaaaaattacaaatcaggggccagagtctggtcatgtttgtcagtgaggaaagacaatttctgattgccagtcccaccaaagcgttggcagattaacacagcattgtagattactttcctaggaagagatgctccttttttctccctttccattattttgctttccttctttccatggtgcattgtccttttgttttcttccctcttatttcgatgcatgtataaacttgagcctttctgctctcacattctttctccccatgatcataattgtttcttcactttattcttaaa

SEQ ID NO: 26492 - DNA, 472 bp, Homo sapiens
agcttaaaccaaaagctattgggttaggaaaaaatgagttagggaaaatggattgggggaacgggttagggaaaaaaccacgagacaaacccaagtttttttggtcctgttttttttgtttgtttgtttgtttttgagacagggtcttgctctgttgcagtggcgcaatcatggttcactgcagctttgacttcctgggctcaagtgatcctcccacctcagcctcctgaatagctgggactacaggcatatgtcaccacacccagctcatttttaaaattatttttttagagatggggtcttgctatgctgtccagactggtctggaacaatgagttcaagcaatcctcacgacttagcttcccaaggtgctgggattacgggtgtgagccaccatgcctggccagtcctaaatgttatacattttgtggaactctctttaaggatagaaaaaaacattaggtatgaaaca

SEQ ID NO: 26493 - DNA, 386 bp, Homo sapiens
gggacaactggaatgctgacccaccccttatgatgacaaatggtggcttcatcttctcacataggtttctcctggaaccccagttactggcagctcttgactcatattgtcataacttgagacggaaaagaaatgattccctcttcaagtcttccttcctgcaaccatttattaatagaaaaatcccagggagagaacggtctgaatcaaacatgtgccaatcattattgagctgcactaactcccaagattgggcaagaagttgtaagcccttgtaccaattacttagccagggaggcccaggttatgatgacagctcacaacagaactcagggaatagaaagggaaaagtacttccaaaagaacagaaaatacattttctgaaa

SEQ ID NO: 26494 - DNA, 466 bp, Homo sapiens
gcaagcaaccttatgaggtaggtcttattagcaagctcatttaaataggaaggagccaagtagggcagaataggtatcttgcactaggtcacatatctaattagtgagcccatgctatgggactctaaggctttgttcttgtacagcctcccaggattatttattctgttttttttaagcttgtctttaggtgcaaattctcaagttcacctctttgcctcattaaattatcatttttaccttctgttttcatctcttttacctccttgaaaatccatctgtacttgtatttctaagaaaacagtaaactaattgaagctccagttactttagattttataatactttcttggctgggtgtggtggctcatgcttgtaatcacactttaggaggccagggtgggaggatagtttgaggccaccctggacaatatagtgagaccccatctcaattgaaaaaaaaaaa

SEQ ID NO: 26495 - DNA, 2193 bp, Homo sapiens
ggtggccgagcgggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtgtgggtgaatggggtcgacacgctagagcatgaggggggctacctccccttcgaggccgacatcagcaacctggtccaggtggggcccctgccctcccggctccgaatcactatcgccatcaacaacacactcacccccaccaccctgccaccagggaccatccaatacctgactgacacctccaagtatcccaagggttactttgtccagaacacatattttgactttttcaactacgctggactgcagcggtctgtacttctgtacacgacacccaccacctacatcgatgacatcaccgtcaccaccagcgtggagcaagacagtgggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcattggaggtgcagctgactgcacagacgtcactggggcctgtgtctgacttctacacactccctgtggggatccgcactgtggctgtcaccaagagccagttcctcatcaatgggaaacctttctatttccacggtgtcaacaagcatgaggatgcggacatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagatggtgatcgctcacaccaaatccttggacccctcccggcctgtgacctttgtgagcaactctaactatgcagcagacaagggggctccgtatgtggatgtgatctgtttgaacagctactactcttggtatcacgactacgggcacctggagttgattcagctgcagctggccacccagtttgagaactggtataagaagtatcagaagcccattattcagagcgagtatggagcagaaacgattgcagggtttcaccaggatccacctctgatgttcactgaagagtaccagaaaagtctgctagagcagtaccatctgggtctggatcaaaaacgcagaaaatacgtggttggagagctcatttggaattttgccgatttcatgactgaacagtcaccgacgagagtgctggggaataaaaaggggatcttcactcggcagagacaaccaaaaagtgcagcgttccttttgcgagagagatactggaagattgccaatgaaaccaggtatccccactcagtagccaagtcacaatgtttggaaaacagcccgtttacttgagcaagactgataccacctgcgtgtcccttcctccccgagtcagggcgacttccacagcagcagaacaagtgcctcctggactgttcacggcagaccagaacgtttctggcctgggttttgtggtcatctattctagcagggaacactaaaggtggaaataaaagattttctattatggaaataaagagttggcatgaaagtggctactgaa

SEQ ID NO: 26496 - DNA, 495 bp, Homo sapiens
  misc_feature (86)..(86): n is a, c, g, or t
  misc_feature (298)..(298): n is a, c, g, or t
  misc_feature (301)..(301): n is a, c, g, or t
ttcatgtacagacctttcatcccttcttgaaaatgccaaacaatatactaactcagagtcatcaccttcccctaggcatgaagggnctcgacatgattcatgtcgagggttcctccccgagtcagggcgacttccacagcagcagaacaagtgcctcctggactgttcacggcagaccagaacgtttctggcctgggttttgtggtcatctattctagcagggaacactaaaggtggaaataaaagattttctattatggaaataaagagttggcatgaaagtggctactgaacactnganatgaatcatatcgagtgctttcatgccgggaaggcgacagtgcctaagacagaaattcgggaaaaactagccaaaatgtacaagaccacaccggatgtcatctttgtatttggattcagaactcattttggtggtgcagacaactggctgtggcatgaagccctcgacataagggatcctctagatcgtctcag

SEQ ID NO: 26497 - DNA, 529 bp, Homo sapiens
  misc_feature (97)..(97): n is a, c, g, or t
ttcatgtcagtgcttcatcccccacaacctcatggttcctagtcagattcgttaaccactgcgccacgagggaactcccttcttgggcatgaagggnctcgacatgattcatgtcgagggttcctccccgagtcagggcgacttccacagcagcagaacaagtgcctcctggactgttcacggcagaccagaacgtttctggcctgggttttgtggtcatctattctagcagggaacactaaaggtggaaataaaagattttctattatggaaataaagagttggcatgaaagtggctactgaacgctcgacatgattcatgtcgagggctttcatccctacttgtggatcattcccaatattggggaaaaactttagaaatccaagataaaggagggggttgacgtaggaagttatctaagttgcaaaaagggaagttaacagagtctctgcacaattcagaagaaggagagttagaagaaacatttgtcatgcaaggctacctacatatggcatgaaggccctcgat

SEQ ID NO: 26498 - DNA, 473 bp, Homo sapiens
  misc_feature (242)..(242): n is a, c, g, or t
ttcatatccagtgcttcatgccatgattataagtttcccgagactttcccagccatgtagaactgtgagtcaattaaacctcttttctttacaaatcacccagtctgggtatctcttcatagcagcatgagaacggactaacacagcaaccatattcagaatgcatggaagggggctaagattctggaggtggggaaatcagaagattgatgcaagtgtcccagcagaagggcatgaagggnctcgacatgattcatgtcgagggttcctccccgagtcagggcgacttccacagcagcagaacaagtgcctcctggactgttcacggcagaccagaacgtttctggcctgggttttgtggtcatctattctagcagggaacactaaaggtggaaataaaagattttctattatggaaataaagagttggcatgaaagtggctactgaaaagtggctactgaaaagcatctga

SEQ ID NO: 26499 - DNA, 230 bp, Homo sapiens
gaggtgacgctagcagtttacttcatgtcagcccttcatgcccgtattcctccccgagtcagggcgacttccacagcagcagaacaagtgcctcctggactgttcacggcagaccagaacgtttctggcctgggttttgtggtcatctattctagcagggaacactaaaggtggaaataaaagattttctattatggaaataaagagttggcatgaaagtggctactgaa

SEQ ID NO: 26500 - DNA, 365 bp, Homo sapiens
tcggcctcccaaagtgctgggattacaggtgtgaaccatcgtgcctggccccgtgttgtgttctggcggtggaagatgggacagagaggatgggagggtgtctgagccattcctggactgatggaacctgtttcttctgccttttgtggacaggatggtgatcgctcacaccaaatccttggacccctcccggcctgtgacctttgtgagcaactctaactatgcagcagacaagggggtgagcctgggggtccccaccccacttctccctgcctttgcctgggcttgtcctgaagcctggtcatgggaacagccaggaagaaccatgcgctgccagtctgggtgacagcaagaccccgtctcta

SEQ ID NO: 26501 - DNA, 1524 bp, Homo sapiens
gggtttccccggaaacggtaggccattgttcggaatcgagctcggtccggtaagcattccaagcgcgcgaagaaacacagtggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcattggaggtgcagctgactgcacagacgtcactggggcctgtgtctgacttctacacactccctgtggggatccgcactgtggctgtcaccaagagccagttcctcatcaatgggaaacctttctatttccacggtgtcaacaagcatgaggatgcggacatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagatggtgatcgctcacaccaaatccttggacccctcccggcctgtgacctttgtgagcaactctaactatgcagcagacaagggggctccgtatgtggatgtgatctgtttgaacagctactactcttggtatcacgactacgggcacctggagttgattcagctgcagctggccacccagtttgagaactggtataagaagtatcagaagcccattattcagagcgagtatggagcagaaacgattgcagggtttcaccaggatccacctctgatgttcactgaagagtaccagaaaagtctgctagagcagtaccatctgggtctggatcaaaaacgcagaaaatacgtggttggagagctcatttggaattttgccgatttcatgactgaacagtcaccgacgagagtgctggggaataaaaaggggatcttcactcggcagagacaaccaaaaagtgcagcgttccttttgcgagagagatactggaagattgccaatgaaaccaggtatccccactcagtagccaagtcacaatgtttggaaaacagcccgtttacttgagcaagactgataccacctgcgtgtcccttcctccccgagtcagggcgacttccacagcagcagaacaagtgcctcctggactgttcacggcagaccagaacgtttctggcctgggttttgtggtcatctattctagcagggaacactaaaggtggaaataaaagattttctattatggaaataaagagttggcatgaaagtggctactgaa

SEQ ID NO: 26502 - DNA, 2407 bp, Homo sapiens
ggtggccgagcgggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtgtgggtgaatggggtcgacacgctagagcatgaggggggctacctccccttcgaggccgacatcagcaacctggtccaggtggggcccctgccctcccggctccgaatcactatcgccatcaacaacacactcacccccaccaccctgccaccagggaccatccaatacctgactgacacctccaagtatcccaagggttactttgtccagaacacatattttgactttttcaactacgctggactgcagcggtctgtacttctgtacacgacacccaccacctacatcgatgacatcaccgtcaccaccagcgtggagcaagacagtgggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcattggaggtgcagctgactgcacagacgtcactggggcctgtgtctgacttctacacactccctgtggggatccgcactgtggctgtcaccaagagccagttcctcatcaatgggaaacctttctatttccacggtgtcaacaagcatgaggatgcggacgtgtgttggggctcctgggtccttgtgggggctgcttctggtcaccctccactttcgccttccctgtgtcctgcagttgagggcagctcagggcaatgaggcaaatggctccaaatggagagggggctcatggggtggctctccagggtcctggctctcagaggaagtgcagcttcgacagggacaggggtcacttggctctgctatctcctagatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagatggtgatcgctcacaccaaatccttggacccctcccggcctgtgacctttgtgagcaactctaactatgcagcagacaagggggctccgtatgtggatgtgatctgtttgaacagctactactcttggtatcacgactacgggcacctggagttgattcagctgcagctggccacccagtttgagaactggtataagaagtatcagaagcccattattcagagcgagtatggagcagaaacgattgcagggtttcaccaggatccacctctgatgttcactgaagagtaccagaaaagtctgctagagcagtaccatctgggtctggatcaaaaacgcagaaaatacgtggttggagagctcatttggaattttgccgatttcatgactgaacagtcaccgacgagagtgctggggaataaaaaggggatcttcactcggcagagacaaccaaaaagtgcagcgttccttttgcgagagagatactggaagattgccaatgaaaccaggtatccccactcagtagccaagtcacaatgtttggaaaacagcccgtttacttgagcaagactgataccacctgcgtgtcccttcctccccgagtcagggcgacttccacagcagcagaacaagtgcctcctggactgttcacggcagaccagaacgtttctggcctgggttttgtggtcatctattctagcagggaacactaaaggtggaaataaaagattttctattatggaaataaagagttggcatgaaagtggctactgaa

SEQ ID NO: 26503 - DNA, 1119 bp, Homo sapiens
gtacaaaacacaaacaaaaaacaacaaacaaacaaaaaccaaaacaaaaaacccacgcgtacgacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagatggtgatcgctcacaccaaatccttggacccctcccggcctgtgacctttgtgagcaactctaactatgcagcagacaagggggctccgtatgtggatgtgatctgtttgaacagctactactcttggtatcacgactacgggcacctggagttgattcagctgcagctggccacccagtttgagaactggtataagaagtatcagaagcccattattcagagcgagtatggagcagaaacgattgcagggtttcaccaggatccacctctgatgttcactgaagagtaccagaaaagtctgctagagcagtaccatctgggtctggatcaaaaacgcagaaaatacgtggttggagagctcatttggaattttgccgatttcatgactgaacagtcaccgacgagagtgctggggaataaaaaggggatcttcactcggcagagacaaccaaaaagtgcagcgttccttttgcgagagagatactggaagattgccaatgaaaccaggtatccccactcagtagccaagtcacaatgtttggaaaacagcccgtttacttgagcaagactgataccacctgcgtgtcccttcctccccgagtcagggcgacttccacagcagcagaacaagtgcctcctggactgttcacggcagaccagaacgtttctggcctgggttttgtggtcatctattctagcagggaacactaaaggtggaaataaaagattttctattatggaaataaagagttggcatgaaagtggctactgaa

SEQ ID NO: 26504 - DNA, 2491 bp, Homo sapiens
ggtggccgagcgggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtgtgggtgaatggggtcgacacgctagagcatgaggggggctacctccccttcgaggccgacatcagcaacctggtccaggtggggcccctgccctcccggctccgaatcactatcgccatcaacaacacactcacccccaccaccctgccaccagggaccatccaatacctgactgacacctccaagtatcccaagggttactttgtccagaacacatattttgactttttcaactacgctggactgcagcggtctgtacttctgtacacgacacccaccacctacatcgatgacatcaccgtcaccaccagcgtggagcaagacagtgggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcattggaggtgcagctgactgcacagacgtcactggggcctgtgtctgacttctacacactccctgtggggatccgcactgtggctgtcaccaagagccagttcctcatcaatgggaaacctttctatttccacggtgtcaacaagcatgaggatgcggacgtgtgttggggctcctgggtccttgtgggggctgcttctggtcaccctccactttcgccttccctgtgtcctgcagttgagggcagctcagggcaatgaggcaaatggctccaaatggagagggggctcatggggtggctctccagggtcctggctctcagaggaagtgcagcttcgacagggacaggggtcacttggctctgctatctcctagatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgtgagtctctgctgtgcacctgctccgcctgcccagcccgggggcgtcaccgtgaccctctgtcccttccctcctggcccgcaggcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagatggtgatcgctcacaccaaatccttggacccctcccggcctgtgacctttgtgagcaactctaactatgcagcagacaagggggctccgtatgtggatgtgatctgtttgaacagctactactcttggtatcacgactacgggcacctggagttgattcagctgcagctggccacccagtttgagaactggtataagaagtatcagaagcccattattcagagcgagtatggagcagaaacgattgcagggtttcaccaggatccacctctgatgttcactgaagagtaccagaaaagtctgctagagcagtaccatctgggtctggatcaaaaacgcagaaaatacgtggttggagagctcatttggaattttgccgatttcatgactgaacagtcaccgacgagagtgctggggaataaaaaggggatcttcactcggcagagacaaccaaaaagtgcagcgttccttttgcgagagagatactggaagattgccaatgaaaccaggtatccccactcagtagccaagtcacaatgtttggaaaacagcccgtttacttgagcaagactgataccacctgcgtgtcccttcctccccgagtcagggcgacttccacagcagcagaacaagtgcctcctggactgttcacggcagaccagaacgtttctggcctgggttttgtggtcatctattctagcagggaacactaaaggtggaaataaaagattttctattatggaaataaagagttggcatgaaagtggctactgaa

SEQ ID NO: 26505 - DNA, 818 bp, Homo sapiens
gtgaccaagcagatcgttttggggtagccacttaacaagtatcgtgttaagtggctaccccaaatccttggacccctcccggcctgtgacctttgtgagcaactctaactatgcagcagacaagggggctccgtatgtggatgtgatctgtttgaacagctactactcttggtatcacgactacgggcacctggagttgattcagctgcagctggccacccagtttgagaactggtataagaagtatcagaagcccattattcagagcgagtatggagcagaaacgattgcagggtttcaccaggatccacctctgatgttcactgaagagtaccagaaaagtctgctagagcagtaccatctgggtctggatcaaaaacgcagaaaatacgtggttggagagctcatttggaattttgccgatttcatgactgaacagtcaccgacgagagtgctggggaataaaaaggggatcttcactcggcagagacaaccaaaaagtgcagcgttccttttgcgagagagatactggaagattgccaatgaaaccaggtatccccactcagtagccaagtcacaatgtttggaaaacagcccgtttacttgagcaagactgataccacctgcgtgtcccttcctccccgagtcagggcgacttccacagcagcagaacaagtgcctcctggactgttcacggcagaccagaacgtttctggcctgggttttgtggtcatctattctagcagggaacactaaaggtggaaataaaagattttctattatggaaataaagagttggcatgaaagtggctactgaa

SEQ ID NO: 26506 - DNA, 2192 bp, Homo sapiens
ggtggccgagcgggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtgtgggtgaatggggtcgacacgctagagcatgaggggggctacctccccttcgaggccgacatcagcaacctggtccaggtggggcccctgccctcccggctccgaatcactatcgccatcaacaacacactcacccccaccaccctgccaccagggaccatccaatacctgactgacacctccaagtatcccaagggttactttgtccagaacacatattttgactttttcaactacgctggactgcagcggtctgtacttctgtacacgacacccaccacctacatcgatgacatcaccgtcaccaccagcgtggagcaagacagtgggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcattggaggtgcagctgactgcacagacgtcactggggcctgtgtctgacttctacacactccctgtggggatccgcactgtggctgtcaccaagagccagttcctcatcaatgggaaacctttctatttccacggtgtcaacaagcatgaggatgcggacatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgtgagtctctgctgtgcacctgctccgcctgcccagcccgggggcgtcaccgtgaccctctgtcccttccctcctggcccgcaggcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagctccgtatgtggatgtgatctgtttgaacagctactactcttggtatcacgactacgggcacctggagttgattcagctgcagctggccacccagtttgagaactggtataagaagtatcagaagcccattattcagagcgagtatggagcagaaacgattgcagggtttcaccaggatccacctctgatgttcactgaagagtaccagaaaagtctgctagagcagtaccatctgggtctggatcaaaaacgcagaaaatacgtggttggagagctcatttggaattttgccgatttcatgactgaacagtcaccgacgagagtgctggggaataaaaaggggatcttcactcggcagagacaaccaaaaagtgcagcgttccttttgcgagagagatactggaagattgccaatgaaaccaggtatccccactcagtagccaagtcacaatgtttggaaaacagcccgtttacttgagcaagactgataccacctgcgtgtcccttcctccccgagtcagggcgacttccacagcagcagaacaagtgcctcctggactgttcacggcagaccagaacgtttctggcctgggttttgtggtcatctattctagcagggaacactaaaggtggaaataaaagattttctattatggaaataaagagttggcatgaaagtggctactgaa

SEQ ID NO: 26507 - DNA, 2571 bp, Homo sapiens
  misc_feature (2274)..(2275): n is a, c, g, or t
ggtggccgagcgggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtgtgggtgaatggggtcgacacgctagagcatgaggggggctacctccccttcgaggccgacatcagcaacctggtccaggtggggcccctgccctcccggctccgaatcactatcgccatcaacaacacactcacccccaccaccctgccaccagggaccatccaatacctgactgacacctccaagtatcccaagggttactttgtccagaacacatattttgactttttcaactacgctggactgcagcggtctgtacttctgtacacgacacccaccacctacatcgatgacatcaccgtcaccaccagcgtggagcaagacagtgggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcattggaggtgcagctgactgcacagacgtcactggggcctgtgtctgacttctacacactccctgtggggatccgcactgtggctgtcaccaagagccagttcctcatcaatgggaaacctttctatttccacggtgtcaacaagcatgaggatgcggacatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagatggtgatcgctcacaccaaatccttggacccctcccggcctgtgacctttgtgagcaactctaactatgcagcagacaagggggctccgtatgtggatgtgatctgtttgaacagctactactcttggtatcacgactacgggcacctggagttgattcagctgcagctggccacccagtttgagaactggtataagaagtatcagaagcccattattcagagcgagtatggagcagaaacgattgcagggtttcaccaggatccacctctgatgttcactgaagagtaccagaaaagtctgctagagcagtaccatctgggtctggatcaaaaacgcagaaaatacgtggttggagagctcatttggaattttgccgatttcatgactgaacagtcaccgacgagagtgctggggaataaaaaggggatcttcactcggcagagacaaccaaaaagtgcagcgttccttttgcgagagagatactggaagattgccaatgaaaccaggtatccccactcagtagccaagtcacaatgtttggaaaacagcccgtttacttgagcaagactgataccacctgcgtgtcccttcctccccgagtcagggcgacttccacagcagcagaacaagtgcctcctggactgttcacggcagaccagaacgtttctggcctgggttttgtggtcatctattctagcagggaacactaaaggtggaaataaaagattttctattatggaaataaagagttggcatgaaagtggctactgaaaaaaaaaaaaaaaaaaaaaaaaaaaaaaaaaaaaaaaaaaaaaaaacaaaaaaaaaaaaaaaaaaaaaaaaaaaaaaaaannccctttgggggccttttggcccaattcttttttaatttgagcaatgtttttcttggggcccgaatttggcctatttgggcaatttgcccttatggggggtcgtttaaaaattaatggcccgggttttaacaaacgggatatggaaaaaccctgggggttcccaatttaattccttttggaaaaatccccttttcgccgttgtggataaaagaaaaagggcccgccccatatcgcttttccaaaaatttccccaccttaatgggaaaggggaaaatttgagcggtaatttttttgaa

SEQ ID NO: 26508 - DNA, 2247 bp, Homo sapiens
ggtggccgagcgggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtgtgggtgaatggggtcgacacgctagagcatgaggggggctacctccccttcgaggccgacatcagcaacctggtccaggtggggcccctgccctcccggctccgaatcactatcgccatcaacaacacactcacccccaccaccctgccaccagggaccatccaatacctgactgacacctccaagtatcccaagggttactttgtccagaacacatattttgactttttcaactacgctggactgcagcggtctgtacttctgtacacgacacccaccacctacatcgatgacatcaccgtcaccaccagcgtggagcaagacagtgggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcattggaggtgcagctgactgcacagacgtcactggggcctgtgtctgacttctacacactccctgtggggatccgcactgtggctgtcaccaagagccagttcctcatcaatgggaaacctttctatttccacggtgtcaacaagcatgaggatgcggacatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagatggtgatcgctcacaccaaatccttggacccctcccggcctgtgacctttgtgagcaactctaactatgcagcagacaagggggctccgtatgtggatgtgatctgtttgaacagctactactcttggtatcacgactacgggcacctggagttgattcagctgcagctggccacccagtttgagaactggtataagaagtatcagaagcccattattcagagcgagtatggagcagaaacgattgcagggtttcaccaggatccacctctgatgttcactgaagagtaccagaaaagtctgctagagcagtaccatctgggtctggatcaaaaacgcagaaaatacgtggttggagagctcatttggaattttgccgatttcatgactgaacagtcaccgacgagagtgctggggaataaaaaggggatcttcactcggcagagacaaccaaaaagtgcagcgttccttttgcgagagagatactggaagattgccaatgaaaccaggtatccccactcagtagccaagtcacaatgtttggaaaacagcccgtttacttgagcaagactgataccacctgcgtgtcccttcctccccgagtcagggcgacttccacagcagcagaacaagtgcctcctggactgttcacggcagaccagaacgtttctggcctgggttttgtggtcatctattctagcagggaacactaaaggtggaaataaaagattttctattatggaaataaagagttggcatgaaagtggctactgaaagatgcggccgactcccccctccctcccccccacccgcgccgcccacatcaccc

SEQ ID NO: 26509 - DNA, 2263 bp, Homo sapiens
ggtggccgagcgggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtgtgggtgaatggggtcgacacgctagagcatgaggggggctacctccccttcgaggccgacatcagcaacctggtccaggtggggcccctgccctcccggctccgaatcactatcgccatcaacaacacactcacccccaccaccctgccaccagggaccatccaatacctgactgacacctccaagtatcccaagggttactttgtccagaacacatattttgactttttcaactacgctggactgcagcggtctgtacttctgtacacgacacccaccacctacatcgatgacatcaccgtcaccaccagcgtggagcaagacagtgggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcattggaggtgcagctgactgcacagacgtcactggggcctgtgtctgacttctacacactccctgtggggatccgcactgtggctgtcaccaagagccagttcctcatcaatgggaaacctttctatttccacggtgtcaacaagcatgaggatgcggacatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagatggtgatcgctcacaccaaatccttggacccctcccggcctgtgacctttgtgagcaactctaactatgcagcagacaagggggctccgtatgtggatgtgatctgtttgaacagctactactcttggtatcacgactacgggcacctggagttgattcagctgcagctggccacccagtttgagaactggtataagaagtatcagaagcccattattcagagcgagtatggagcagaaacgattgcagggtttcaccaggatccacctctgatgttcactgaagagtaccagaaaagtctgctagagcagtaccatctgggtctggatcaaaaacgcagaaaatacgtggttggagagctcatttggaattttgccgatttcatgactgaacagtcaccgacgagagtgctggggaataaaaaggggatcttcactcggcagagacaaccaaaaagtgcagcgttccttttgcgagagagatactggaagattgccaatgaaaccaggtatccccactcagtagccaagtcacaatgtttggaaaacagcccgtttacttgagcaagactgataccacctgcgtgtcccttcctccccgagtcagggcgacttccacagcagcagaacaagtgcctcctggactgttcacggcagaccagaacgtttctggcctgggttttgtggtcatctattctagcagggaacactaaaggtggaaataaaagattttctattatggaaataaagagttggcatgaaagtggctactgaaagggcggtgacaccggtcatggacgtgagctcatcacgacgctctcacattcgactaatataagccagca

SEQ ID NO: 26510 - DNA, 1855 bp, Homo sapiens
ggtggccgagcgggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtgtgggtgaatggggtcgacacgctagagcatgaggggggctacctccccttcgaggccgacatcagcaacctggtccaggtggggcccctgccctcccggctccgaatcactatcgccatcaacaacacactcacccccaccaccctgccaccagggaccatccaatacctgactgacacctccaagtatcccaagggttactttgtccagaacacatattttgactttttcaactacgctggactgcagcggtctgtacttctgtacacgacacccaccacctacatcgatgacatcaccgtcaccaccagcgtggagcaagacagtgggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcattggaggtgcagctgactgcacagacgtcactggggcctgtgtctgacttctacacactccctgtggggatccgcactgtggctgtcaccaagagccagttcctcatcaatgggaaacctttctatttccacggtgtcaacaagcatgaggatgcggacatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagatggtgatcgctcacaccaaatccttggacccctcccggcctgtgacctttgtgagcaactctaactatgcagcagacaagggggctccgtatgtggatgtgatctgtttgaacagctactactcttggtatcacgactacgggcacctggagttgattcagctgcagctggccacccagtttgagaactggtataagaagtatcagaagcccattattcagagcgagtatggagcagaaacgattgcagggtttcaccaggatccacctctgatgttcactgaagagtaccagaaaagtctgctagagcagtaccatctgggtctggatcaaaaacgattgcagggtttcaccaggatccacctctgatgttcactgaagagtaccagaaaagtctgctagagcagtaccatctgcgtttatgatccagacccaga

SEQ ID NO: 26511 - DNA, 1895 bp, Homo sapiens
ggtggccgagcgggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtgtgggtgaatggggtcgacacgctagagcatgaggggggctacctccccttcgaggccgacatcagcaacctggtccaggtggggcccctgccctcccggctccgaatcactatcgccatcaacaacacactcacccccaccaccctgccaccagggaccatccaatacctgactgacacctccaagtatcccaagggttactttgtccagaacacatattttgactttttcaactacgctggactgcagcggtctgtacttctgtacacgacacccaccacctacatcgatgacatcaccgtcaccaccagcgtggagcaagacagtgggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcattggaggtgcagctgactgcacagacgtcactggggcctgtgtctgacttctacacactccctgtggggatccgcactgtggctgtcaccaagagccagttcctcatcaatgggaaacctttctatttccacggtgtcaacaagcatgaggatgcggacatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgtgagtctctgctgtgcacctgctccgcctgcccagcccgggggcgtcaccgtgaccctctgtcccttccctcctggcccgcaggcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagtgagtgctccctccctgccctcggctagagtgggaaggagaccctggcaggtggctggcctcggtgggcatgtgctgttcaagatcggcctcgtgtccagcccaatgggaaggccgtccatacccagatagttcaggggaccaaatatctacccacccaaattgtggttttcttttttgttctttttttttctttttgagatggagtctcactatatggcccaggctggagtgcagtggggtgatctccgctcattacaacctctgcctcctgggttcaagtgattctcctgcctcagtctcctgagtagctaggattacaggcacccatgaaccactgtgctggggctgtttttttttttcaaaatgggttctcactctggttgcccaggtt

SEQ ID NO: 26512 - DNA, 304 bp, Homo sapiens
  misc_feature (97)..(97): n is a, c, g, or t
ttcatgtcagtgcttcatcccccacaacctcatggttcctagtcagattcgttaaccactgcgccacgagggaactcccttcttgggcatgaagggnctcgacatgattcatgtcgagggttcctccccgagtcagggcgacttccacagcagcagaacaagtgcctcctggactgttcacggcagaccagaacgtttctggcctgggttttgtggtcatctattctagcagggaacactaaaggtggaaataaaagattttctattatggaaataaagagttggcatgaaagtggctactgaa

SEQ ID NO: 26513 - DNA, 975 bp, Homo sapiens
ggtggccgagcgggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtgtgggtgaatggggtcgacacgctagagcatgaggggggctacctccccttcgaggccgacatcagcaacctggtccaggtggggcccctgccctcccggctccgaatcactatcgccatcaacaacacactcacccccaccaccctgccaccagggaccatccaatacctgactgacacctccaagtatcccaagggttactttgtccagaacacatattttgactttttcaactacgctggactgcagcggtctgtacttctgtacacgacacccaccacctacatcgatgacatcaccgtcaccaccagcgtggagcaagacagtgggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcattggagatccgaggaaggcttgactgccgcgctgaatctacgg

SEQ ID NO: 26514 - DNA, 291 bp, Homo sapiens
ttatctaacatttacaattctgccagttctgactcttacattctctttgccttgaatcctaggatccacctctgatgttcactgaagagtaccagaaaagtctgctagagcagtaccatctgggtctggatcaaaaacgcagaaaatacgtggttggagagctcatttggaattttgccgatttcatgactgaacagtgtaagtggcagtttggctcatgggataacgtacccgtcctcattttttcaggttgcctttccaattctggccatttcaattgtaagaatattg

SEQ ID NO: 26515 - DNA, 424 bp, Homo sapiens
tccatccaccgagccagcttctttccacacgaatcatctcttcttccttctctaccatctcttcctgctgccctgcaatcagtctgtccctcttctctcttaaagccttattttgtccttgaacactgtgagaagcccgggcagcaagttacagctctcagctctctgaggacactgtctgggcatttatcctccctttgttacccggccctgcccgaggtcagaaagatccagttcacatctatgtccaccggttactagcggtatcaagtccactggttactagcggtatcaagtttcttagcttctgtgagtctcaggttgatggaaatgaacctcacaagtttgctgtgaagattaaaaatagactgaaaaaaaaaaagtgccctcctcacccaatgtcaatacatgatttctgccagta

SEQ ID NO: 26516 - DNA, 599 bp, Homo sapiens
  misc_feature (1)..(2): n is a, c, g, or t
  misc_feature (5)..(5): n is a, c, g, or t
nnacngcaactctgcttcacaaggaggccctgtgttttcactggaagaaaaaaaaaaaaaggtggcatacaggggtgccttcccaaagtgccaatataccccacccctaccctctcaacagattccccatttcccattttaaataaattttgtctcctaggagccatatcaaggggacctctgtctctgggttgcaactataactacaggggtctgcagatctgttactgttttctcttttccctgctactctgagagttacatttgcacagtgccaacaccctattacttatttattgataaattgattgtcataacattctacaatacactgctccctcacaatgatttctactcaagaacctgcatttattttctactatcccaaatttactctcagttcttccctcaagacttttagaagtcaggagcaccagggtgaggagcagtagcaaggagcccggactgagtgcacactcacagggctttaggacacagagagagtgtctcagaggatgctaactcaacaaccaggctgaggtgctgggtaatagtccacagaattagaaaacttaaacatctgtctaagggattgattg

SEQ ID NO: 26517 - DNA, 1927 bp, Homo sapiens
aaccaattgcaccacgaccggatggaagagcccagctgacacaaccaagacgagtctcagtgtctagggaagcttggggttctgctccttttacttcaggcgaacctgaactcagttaatgcaattttgaagcatgccctgaatagattcagtcattatcaagtcaaactaaaaacggtgaaaggttgcgactattaccaaataggaaaaacctgaagacataagaactacacatgaggaatatgtcatttagcactttcactttttgatctccacagaagacaatgagaagtcataccataacaatgacgacaacttcagtcagcagctggccttactcctcccacagaatgcgctttataaccaatcatagcgaccaaccgccacaaaacttctcagcaacaccaaatgttactacctgtcccatggatgaaaaattgctatctactgtgttaaccacatcctactctgttattttcatcgtgggactggttgggaacataatcgccctctatgtatttctgggtattcaccgtaaaagaaattccattcaaatttatctacttaacgtagccattgcagacctcctactcatcttctgcctccctttccgaataatgtatcatattaaccaaaacaagtggacactaggtgtgattctgtgcaaggttgtgggaacactgttttatatgaacatgtacattagcattattttgcttggattcatcagtttggatcgctatataaaaattaatcggtctatacagcaacggaaggcaataacaaccaaacaaagtatttatgtctgttgtatagtatggatgcttgctcttggtggattcctaactatgattattttaacacttaagaaaggagggcataattccacaatgtgtttccattacagagataagcataacgcaaaaggagaagccatttttaacttcattcttgtggtaatgttctggctaattttcttactaataatcctttcatatattaagattgggaagaatctattgaggatttctaaaaggaggtcaaaatttcctaattctggtaaatatgccactacagctcgtaactcctttattgtacttatcatttttactatatgttttgttccctatcatgcctttcgattcatctacatttcttcacagctaaatgtatcatcttgctactggaaagaaattgttcacaaaaccaatgagatcatgctggttctctcatctttcaatagttgcttagatccagtcatgtatttcctgatgtccagtaacattcgcaaaataatgtgccaacttctttttagacgatttcaaggtgaaccaagtaggagtgaaagcacttcagaatttaaaccaggatactccctgcatgatacatctgtggcagtgaaaatacagtctagttctaaaagtacttgaggtaaacatactaaaatgaattatataatgcagcctcttaattctttgaagaactaaaaaattaggaaacaaagttctagcatttacaaaactcagatctcaaagctctgcttgtatttgtgatatttcatttgcttaactgtaaaccatttcaaggtactatcttttaaatctgtatgtaaaatcttttcaaaatacatttttaagctaatactcttaacatagattatgaagttaagtgaaatttatggctctaacagcaaaataattaaagtgccatagtttctcaagtgactaaagtagttattaaaatcaagcacttgatactaatttgaagtgtgtttaaaagtaaatgatttgggaactgacaatgtgtcagaaaatatatgttcatttatcattttaaaatcttgtataatttgccactgtattcatttatgcctaaatctctataacagatgaaaagataattaataaaatcctaattaaaaaatgag

SEQ ID NO: 26518 - DNA, 1946 bp, Homo sapiens
aaagagatggggtcttgttctgttgcccaggctggagtgcagtggctcaattatagctcactacagccttgaactcctgggttcaagcaatccttctgctgtagcctcccgagtagctaggaccataggcgtgtgctgggaagcccagcctattatttacacttttagttaaagtaactgttattaaaatagcaaatgactcaatgtttggcattccgttgtaggaaaaacctgaagacataagaactacacatgaggaatatgtcatttagcactttcactttttgatctccacagaagacaatgagaagtcataccataacaatgacgacaacttcagtcagcagctggccttactcctcccacagaatgcgctttataaccaatcatagcgaccaaccgccacaaaacttctcagcaacaccaaatgttactacctgtcccatggatgaaaaattgctatctactgtgttaaccacatcctactctgttattttcatcgtgggactggttgggaacataatcgccctctatgtatttctgggtattcaccgtaaaagaaattccattcaaatttatctacttaacgtagccattgcagacctcctactcatcttctgcctccctttccgaataatgtatcatattaaccaaaacaagtggacactaggtgtgattctgtgcaaggttgtgggaacactgttttatatgaacatgtacattagcattattttgcttggattcatcagtttggatcgctatataaaaattaatcggtctatacagcaacggaaggcaataacaaccaaacaaagtatttatgtctgttgtatagtatggatgcttgctcttggtggattcctaactatgattattttaacacttaagaaaggagggcataattccacaatgtgtttccattacagagataagcataacgcaaaaggagaagccatttttaacttcattcttgtggtaatgttctggctaattttcttactaataatcctttcatatattaagattgggaagaatctattgaggatttctaaaaggaggtcaaaatttcctaattctggtaaatatgccactacagctcgtaactcctttattgtacttatcatttttactatatgttttgttccctatcatgcctttcgattcatctacatttcttcacagctaaatgtatcatcttgctactggaaagaaattgttcacaaaaccaatgagatcatgctggttctctcatctttcaatagttgcttagatccagtcatgtatttcctgatgtccagtaacattcgcaaaataatgtgccaacttctttttagacgatttcaaggtgaaccaagtaggagtgaaagcacttcagaatttaaaccaggatactccctgcatgatacatctgtggcagtgaaaatacagtctagttctaaaagtacttgaggtaaacatactaaaatgaattatataatgcagcctcttaattctttgaagaactaaaaaattaggaaacaaagttctagcatttacaaaactcagatctcaaagctctgcttgtatttgtgatatttcatttgcttaactgtaaaccatttcaaggtactatcttttaaatctgtatgtaaaatcttttcaaaatacatttttaagctaatactcttaacatagattatgaagttaagtgaaatttatggctctaacagcaaaataattaaagtgccatagtttctcaagtgactaaagtagttattaaaatcaagcacttgatactaatttgaagtgtgtttaaaagtaaatgatttgggaactgacaatgtgtcagaaaatatatgttcatttatcattttaaaatcttgtataatttgccactgtattcatttatgcctaaatctctataacagatgaaaagataattaataaaatcctaattaaaaaatgag

SEQ ID NO: 26519 - DNA, 1854 bp, Homo sapiens
aaccaattgcaccacgaccggatggaagagcccagctgacacaaccaagacgagtctcagtgtctagggaagcttggggttctgctccttttacttcaggcgaacctgaactcagttaatgcaattttgaagcatgccctgaatagattcagtcattatcaagtcaaactaaaaacggtgaaaggttgcgactattaccaaatagaagacaatgagaagtcataccataacaatgacgacaacttcagtcagcagctggccttactcctcccacagaatgcgctttataaccaatcatagcgaccaaccgccacaaaacttctcagcaacaccaaatgttactacctgtcccatggatgaaaaattgctatctactgtgttaaccacatcctactctgttattttcatcgtgggactggttgggaacataatcgccctctatgtatttctgggtattcaccgtaaaagaaattccattcaaatttatctacttaacgtagccattgcagacctcctactcatcttctgcctccctttccgaataatgtatcatattaaccaaaacaagtggacactaggtgtgattctgtgcaaggttgtgggaacactgttttatatgaacatgtacattagcattattttgcttggattcatcagtttggatcgctatataaaaattaatcggtctatacagcaacggaaggcaataacaaccaaacaaagtatttatgtctgttgtatagtatggatgcttgctcttggtggattcctaactatgattattttaacacttaagaaaggagggcataattccacaatgtgtttccattacagagataagcataacgcaaaaggagaagccatttttaacttcattcttgtggtaatgttctggctaattttcttactaataatcctttcatatattaagattgggaagaatctattgaggatttctaaaaggaggtcaaaatttcctaattctggtaaatatgccactacagctcgtaactcctttattgtacttatcatttttactatatgttttgttccctatcatgcctttcgattcatctacatttcttcacagctaaatgtatcatcttgctactggaaagaaattgttcacaaaaccaatgagatcatgctggttctctcatctttcaatagttgcttagatccagtcatgtatttcctgatgtccagtaacattcgcaaaataatgtgccaacttctttttagacgatttcaaggtgaaccaagtaggagtgaaagcacttcagaatttaaaccaggatactccctgcatgatacatctgtggcagtgaaaatacagtctagttctaaaagtacttgaggtaaacatactaaaatgaattatataatgcagcctcttaattctttgaagaactaaaaaattaggaaacaaagttctagcatttacaaaactcagatctcaaagctctgcttgtatttgtgatatttcatttgcttaactgtaaaccatttcaaggtactatcttttaaatctgtatgtaaaatcttttcaaaatacatttttaagctaatactcttaacatagattatgaagttaagtgaaatttatggctctaacagcaaaataattaaagtgccatagtttctcaagtgactaaagtagttattaaaatcaagcacttgatactaatttgaagtgtgtttaaaagtaaatgatttgggaactgacaatgtgtcagaaaatatatgttcatttatcattttaaaatcttgtataatttgccactgtattcatttatgcctaaatctctataacagatgaaaagataattaataaaatcctaattaaaaaatgag

SEQ ID NO: 26520 - DNA, 468 bp, Homo sapiens
tcaagacagaaagttaactttctgaaaatattcaggacctgaactcagccctggataaagtgaccttatagatagctacagaactgtccccccaaaaacaaaagaatataaattcttctcatcaccacatggcactttgtctaaaactgatcacataatcggaagcaaaacactcctcagcaaatgcataagaactgaaatcataacaaacagtctcttacaccacagcacaatcaaattagaactcaagatttaaacattcactgaaaaccacacaactatatggaaattgaacaacctgctcctgaatgactcttgggtaaataatgaaattaaggtagaaatcaagaattatttgaaactaatgagaactaagagataacatatcagaatctgggatgcagctaaagcattgttaagagggaaatttatagtactaaatgcccacatcaaaaagctagaaagatc

SEQ ID NO: 26521 - DNA, 578 bp, Homo sapiens
gacggctgcaaggagggaaaaattgtgcacctgattccaatacagcaggatgacttaacacaatgacttaccaggaggtcttagctgtgaaaaatcagtcccgtttcagcacgtggatctccttgtcttctctccctacccgctttcctctctttcttaacccaagaagttatccttaatgacccttagatgaaggatcaagaggagagttgaaaagacccccccaggtgaaaaagagtaaacccccatttctggcatcccagggctttagtgaaaacaaacttttttattcctagttctgtccttgaaagctaagaaacctgttctagttatttttatataattaggcagtgggtttcagattttgtcagatattttcagctcaaaatgtattcactgagcagcaaaacgcagggttgtttaatttgtaatttcagttatatattcctgagtacctttctgttctttcatttttgagtactgtgaaataatcatgttagtttttaattcatatattaaaaacaacctgtgcccccacctccccccaaaaaagtcccatagtagtcactgttacccaa

SEQ ID NO: 26522 - DNA, 351 bp, Homo sapiens
gcttgaacctgggaggcggaggttgcagtgagccaagatcacgccactgcactccagcctcggtgaccgagtgagactccagtttgtctaatataaaaatatgtatatatatatagtctaatataaatatatattttgtctaatataagtatatattatatacattttgtctaatgtaaatatatatattttgtctaatataaatatatatatttttgtctaatagaaatacaaatatattttgtctaatatatatattagacaaaagagtgaagaaatataatttcaacattttaaaaaggaaggaaactcattgtttgtaagggatctgatcacatcattgaaatgtgc

SEQ ID NO: 26523 - DNA, 323 bp, Homo sapiens
atggcgtgaacccagaaggcggagcttgcagtgagccgagattgcaccactgcactccagcctgggtgacagagtgagactctgcctcataaaaaaaacaaaaacaaaaacaaaacaaaaaactcccaaacacctaatatatgtttcatgttcttttgagaaagcttaattaggctgggcgtggtggctcatgcctataatcccagctactcaggaggctgaggcaggagaatggcttgaacccagaaggcggagcttgcagtgagccgagattgcaccactgcactccagcctgggtgacagagtgagactctgcctcagaa

SEQ ID NO: 26524 - DNA, 318 bp, Homo sapiens
gcacaatctcgaaccataccccaaacctatcaaatcagaatctctgggataggaatccaagaatctgagttttaacaagtccttcaggtaattccagggcacactaatgaagccataccctagaaatccttgcacacgtgagaataaccagctgtaaatgtttatgaagtgaaaagcagcattaccaaacccagctattagaggaaagtggctgactgagcaagccggctgaatcagtatcagctcctgatggcagagtgcccttactcacggaggaaagataatgtagagttgaaatgggacttggaaagcttgatg

SEQ ID NO: 26525 - DNA, 160 bp, Homo sapiens
aaaaaaggtagtgggggaggacccaggaggtttacactgatggtttttaaatatctgtgaagactattgatttgttttgacctaggaggaaaaactaaaggcaaagccattatgggagatcattaactgtggaaaggagctcagacaggcaggctagatt

SEQ ID NO: 26526 - DNA, 1083 bp, Homo sapiens
gtccagaatgctggagcgtaggtgaaaggacggattggcgacacatttcaacatgagggacccactgacagattgtccgtataataaagtatacaagaacctaaaggagttttctcaaaatggagagaatttctgcaaacaggtcacatctgttcttcagcaaagggcaaacctggaaattagctatgccaaaggacttcagaaactggcaagcaagctgagcaaagcattacagaacacgagaaaaagttgtgttagcagtgcctgggcctgggcctcagagggaatgaaatccacagcggacctgcatcaaaaacttggcaaagcaattgaattggaagcaataaaaccgacttatcaagtcctaaatgtacaagagaagaagagaaaatcacttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccagagcattctggagctggagaaggaaagaattcaacttttatgcaataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgaagaagatcctaacagtgcaatggataaagagagacgaaagtctttactaaaaccaaaattattgagactgcagagagacattgaaaaagcctcaaaagacaaggaaggcctggaacgaatgcttaaaacgtactccagcacctcctccttctctgatgcaaagagccagaaaga

SEQ ID NO: 26527 - DNA, 847 bp, Homo sapiens
ctgaataggtgttccataacacactattttatttccccagaaagtaatttggaaagtagatgtaaacgctgatattatgctgtgtcttttatgttttatttccagaaaacttggcaaagcaattgaattggaagcaataaaaccgacttatcaagtcctaaatgtacaagagaagaagagaaaatcacttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccagagcattctggagctggagaaggaaagaattcaacttttatgcaataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgtgagtatgaaatggaaaaaaaaagttacattaatggagaatcttaggtactgagggacttacattgaaaaaattgaaagcaaatatcatgttttatcaatgaaaatgatttctcataccccatataaatttaaaaaacccagcatt

SEQ ID NO: 26528 - DNA, 979 bp, Homo sapiens
tgttcctgacacatttcccacagtcctcccccagccctttgctcccgccatttttcctgcctggagtgccctttgccatctttccttgactagacagttacgtcttcttgcctcctcgaagctgtcagctgcctgcactcgtggtgtctgtagcattcgtgaatgcatgtggtcttgtattgctagtttctttaatgttatgcttcaaggcctaactaaatcataaacccattctggaaagagcatatgtgttttagctcacatcttcccagtactgagccaacacagaactcagtcaaaatgtcttccactcctgaggcagtcatagcctgaaacacatacatgatattacatttgggccattaaaggactctaacttgaacaaaagtaaataaggaagcagtaagtatacaacaaatagatttatcaagaaaatgaaatagctatagcaagggtccatcctcaaagaacaatctgctctattaaaaagtgctcggccatgtgacttaaaagttgtgaacaagacaatattttcttattcatcaggtctcgaacaggtagaacaatgtgtgtaaaactaaagattatcctgcttaaaaattttgttttattttataaagttaaaattaaatgcagccagtggaagtatcagaatggacagggaatagcaactcttacttcttcccccttgttagacatccttcttttttcctaaaggaagaagatcctaacagtgcaatggataaagagagacgaaagtctttactaaaaccaaaattattgagactgcagagagacattgaaaaagcctcaaaagacaaggaaggtgtgtaaccatctctttgaatggccagaaaagggaccatatgatgctcagaggtttcattcagagttaggattgatctgcttttgctatttggcaggggtcttctcatttaaagaaccatatatcaaacttcagttgtgtgaacaaaaaaaa

SEQ ID NO: 26529 - DNA, 678 bp, Homo sapiens
gtccagaatgctggagcgtaggtgaaaggacggattggcgacacatttcaacatgagggacccactgacagattgtccgtataataaagtatacaagaacctaaaggagttttctcaaaatggagagaatttctgcaaacaggtcacatctgttcttcagcaaagggcaaacctggaaattagctatgccaaaggacttcagaaactggcaagcaagctgagcaaagcattacagaacacgagaaaaagttgtgttagcagtgcctgggcctgggcctcagagggaatgaaatccacagcggacctgcatcaaaaacttggcaaagcaattgaaatggtcgccaatccgggattggcgaccatttcaatcaggtgatcactgctgaagagaaagtctcctttactagctgcttctgagccctctttgaggtggacggcgaagaagccatcattttgtgagctcattgataccttggtcacatccaccagtggaacctctgacttgatttgtccagacttttggtcagcaagaaggagattattgtttgttaagaggaaaatccgagatgtactcttcccattagcacggttaattcttgttcacgacttcagcaatgatgatcttttcttcaatggcatctctgagtttctgataatagggttcttgttgaattccag

SEQ ID NO: 26530 - DNA, 1169 bp, Homo sapiens
gtccagaatgctggagcgtaggtgaaaggacggattggcgacacatttcaacatgagggacccactgacagattgtccgtataataaagtatacaagaacctaaaggagttttctcaaaatggagagaatttctgcaaacaggtcacatctgttcttcagcaaagggcaaacctggaaattagctatgccaaaggacttcagaaactggcaagcaagctgagcaaagcattacagaacacgagaaaaagttgtgttagcagtgcctgggcctgggcctcagagggaatgaaatccacagcggacctgcatcaaaaacttggcaaagcaattgaattggaagcaataaaaccgacttatcaagtcctaaatgtacaagagaagaagagaaaatcacttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccagagcattctggagctggagaaggaaagaattcaacttttatgcaataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgaagaagatcctaacagtgcaatggataaagagagacgaaagtctttactaaaaccaaaattattgagactgcagagagacattgaaaaagcctcaaaagacaaggaaggtgtgtaaccatctctttgaatggccagaaaagggaccatatgatgctcagaggtttcattcagagttaggattgatctgcttttgctatttggcaggggtcttctcatttaaagaaccatatatcaaacttcagttgtgtgaacaaaaaaaa

SEQ ID NO: 26531 - DNA, 1054 bp, Homo sapiens
gtccagaatgctggagcgtaggtgaaaggacggattggcgacacatttcaacatgagggacccactgacagattgtccgtataataaagtatacaagaacctaaaggagttttctcaaaatggagagaatttctgcaaacaggtcacatctgttcttcagcaaagggcaaacctggaaattagctatgccaaaggacttcagaaactggcaagcaagctgagcaaagcattacagaacacgagaaaaagttgtgttagcagtgcctgggcctgggcctcagagggaatgaaatccacagcggacctgcatcaaaaacttggcaaagcaattgaattggaagcaataaaaccgacttatcaagtcctaaatgtacaagagaagaagagaaaatcacttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccagagcattctggagctggagaaggaaagaattcaacttttatgcaataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgtgagtatgaaatggaaaaaaaaagttacattaatggagaatcttaggtactgagggacttacattgaaaaaattgaaagcaaatatcatgttttatcaatgaaaatgatttctcataccccatataaatttaaaaaacccagcatt

SEQ ID NO: 26532 - DNA, 939 bp, Homo sapiens
gtccagaatgctggagcgtaggtgaaaggacggattggcgacacatttcaacatgagggacccactgacagattgtccgtataataaagtatacaagaacctaaaggagttttctcaaaatggagagaatttctgcaaacaggtcacatctgttcttcagcaaagggcaaacctggaaattagctatgccaaaggacttcagaaactggcaagcaagctgagcaaagcattacagaacacgagaaaaagttgtgttagcagtgcctgggcctgggcctcagagggaatgaaatccacagcggacctgcatcaaaaacttggcaaagcaattgaattggaagcaataaaaccgacttatcaagtcctaaatgtacaagagaagaagagaaaatcacttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccagtaccagcccaaaggctaggacagcaagaactggaaggaacgaatgaagaacaaattgtcatgatgcttgggccccagacaggctctaaatctgctgaaatctgaatctttctggataactccttgaccacactttgttcatatatactattgtggaacctcaagaggacagtttgaggtcctccagagtatcttgcttctctaccacctattttatataaaaagaacaagataataaaaagcaaaaaatcattagat

SEQ ID NO: 26533 - DNA, 1106 bp, Homo sapiens
gtccagaatgctggagcgtaggtgaaaggacggattggcgacacatttcaacatgagggacccactgacagattgtccgtataataaagtatacaagaacctaaaggagttttctcaaaatggagagaatttctgcaaacaggtcacatctgttcttcagcaaagggcaaacctggaaattagctatgccaaaggacttcagaaactggcaagcaagctgagcaaagcattacagaacacgagaaaaagttgtgttagcagtgcctgggcctgggcctcagagggaatgaaatccacagcggacctgcatcaaaaacttggcaaagcaattgaattggaagcaataaaaccgacttatcaagtcctaaatgtacaagagaagaagagaaaatcagccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccagagcattctggagctggagaaggaaagaattcaacttttatgcaataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgaagaagatcctaacagtgcaatggataaagagagacgaaagtctttactaaaaccaaaattattgagactgcagagagacattgaaaaagcctcaaaagacaaggaaggtgtgtaaccatctctttgaatggccagaaaagggaccatatgatgctcagaggtttcattcagagttaggattgatctgcttttgctatttggcaggggtcttctcatttaaagaaccatatatcaaacttcagttgtgtgaacaaaaaaaa

SEQ ID NO: 26534 - DNA, 1131 bp, Homo sapiens
cccgggtgtccgggatgagggacccactgacagattgtccgtataataaagtatacaagaacctaaaggagttttctcaaaatggagagaatttctgcaaacaggtcacatctgttcttcagcaaagggcaaacctggaaattagctatgccaaaggacttcagaaactggcaagcaagctgagcaaagcattacagaacacgagaaaaagttgtgttagcagtgcctgggcctgggcctcagagggaatgaaatccacagcggacctgcatcaaaaacttggcaaagcaattgaattggaagcaataaaaccgacttatcaagtcctaaatgtacaagagaagaagagaaaatcacttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccagagcattctggagctggagaaggaaagaattcaacttttatgcaataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgaagaagatcctaacagtgcaatggataaagagagacgaaagtctttactaaaaccaaaattattgagactgcagagagacattgaaaaagcctcaaaagacaaggaaggtgtgtaaccatctctttgaatggccagaaaagggaccatatgatgctcagaggtttcattcagagttaggattgatctgcttttgctatttggcaggggtcttctcatttaaagaaccatatatcaaacttcagttgtgtgaacaaaaaaaa

SEQ ID NO: 26535 - DNA, 1182 bp, Homo sapiens
aatagatcagcttcatttttgaaaagttctcctgggtctttcatatccaggtagaagagacttcatctttattttaagaactcatccaaaagtataataaagtatacaagaacctaaaggagttttctcaaaatggagagaatttctgcaaacaggtcacatctgttcttcagcaaagggcaaacctggaaattagctatgccaaaggacttcagaaactggcaagcaagctgagcaaagcattacagaacacgagaaaaagttgtgttagcagtgcctgggcctgggcctcagagggaatgaaatccacagcggacctgcatcaaaaacttggcaaagcaattgaattggaagcaataaaaccgacttatcaagtcctaaatgtacaagagaagaagagaaaatcacttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccagagcattctggagctggagaaggaaagaattcaacttttatgcaataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgaagaagatcctaacagtgcaatggataaagagagacgaaagtctttactaaaaccaaaattattgagactgcagagagacattgaaaaagcctcaaaagacaaggaaggtgtgtaaccatctctttgaatggccagaaaagggaccatatgatgctcagaggtttcattcagagttaggattgatctgcttttgctatttggcaggggtcttctcatttaaagaaccatatatcaaacttcagttgtgtgaacaaaaaaaa

SEQ ID NO: 26536 - DNA, 1083 bp, Homo sapiens
gtccagaatgctggagcgtaggtgaaaggacggattggcgacacatttcaacatgagggacccactgacagattgtccgggcaaacctggaaattagctatgccaaaggacttcagaaactggcaagcaagctgagcaaagcattacagaacacgagaaaaagttgtgttagcagtgcctgggcctgggcctcagagggaatgaaatccacagcggacctgcatcaaaaacttggcaaagcaattgaattggaagcaataaaaccgacttatcaagtcctaaatgtacaagagaagaagagaaaatcacttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccagagcattctggagctggagaaggaaagaattcaacttttatgcaataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgaagaagatcctaacagtgcaatggataaagagagacgaaagtctttactaaaaccaaaattattgagactgcagagagacattgaaaaagcctcaaaagacaaggaaggtgtgtaaccatctctttgaatggccagaaaagggaccatatgatgctcagaggtttcattcagagttaggattgatctgcttttgctatttggcaggggtcttctcatttaaagaaccatatatcaaacttcagttgtgtgaacaaaaaaaa

SEQ ID NO: 26537 - DNA, 5084 bp, Homo sapiens
  misc_feature (2194)..(2194): n is a, c, g, or t
  misc_feature (2286)..(2286): n is a, c, g, or t
  misc_feature (3750)..(3750): n is a, c, g, or t
  misc_feature (3948)..(3948): n is a, c, g, or t
agcggggggagcaagacggcagcatctacggttctttctgctcaggaatgggaacccagagtgggcagtagagcggaggcaagccatgcagaggcaggagcagatgagaccctagatgccacgagaagctaaacatgtggggaaaataaagagcagattaactcaggaaaattatatggggagctcttatgctactctgaagatctgagactcgttggagaatttacaatcccaaattaactcagggagaattccaactagactctgaaatgaattagatggagatttaaaatagggcaatttagtgggaagagatacttaatttgaagacagaatcatgaataaactggaggataagcaggaccagatgataccatgaagagaagtttacaggccctctattgccaactgttaagtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacaccgacaccccgtgcagaggggcaccctcctacgcacaccatctccaccatcgctgcgacagtaaccgccccccattctgaaagctccctgtccacagggcccgctccagcagccatggcaaccacatcctccaagccagagggccgccctcgagggcaggctgcccccaccatcctgctgacaaagccaccgggggccaccagccgccccaccacagcgcccccccgcactaccacacgcaggccccccaggcccccaggctcttcccgaaaaggggctggtaattcatcacgccctgtcccgcctgcacctggtggccactccaggagtaaagaaggacagcgaggacgaaatccaagctccacacctctggggcagaagcggcccctggggaaaatctttcagatctacaagggcaacttcacagggtctgtggaaccggagccctctaccctcacccccaggaccccactctggggctactcctcttcaccacagccccagacagtggctgcgaccacagtgcccagcaatacctcatgggcacccaccaccacctccctggggcctgcaaaggacaagccaggccttcgcagagcagcccaggggggtggttctaccttcaccagccaaggagggacaccagatgccacagcagcctcaggtgcccctgtcagtccacaagctgccccagtgccttctcagcgcccccaccacggtgacccacaggatggccccagccatagtgactcttggcttactgttacccctggcaccagcagacctctgtctaccagctctggggtcttcacggctgccacggggcccaccccagctgccttcgataccagtgtctcagccccttcccaggggattcctcagggagcatccacaaccccacaagctccaacccatccctccagggtctcagaaagcactatttctggagccaaggaggagactgtggccaccctcaccatgaccgaccgggtgcccagtcctctctccacagtggtatccacagccacaggcaatttcctcaaccgcctggtccccgccgggacctggaagcctgggacagcagggaacatctcccatgtggccgagggggacaaaccgcagcacagagccaccatctgcctgagcaagatggatatcgcctgggtgatcctggccatcagcgtgcccatctcctcctgctcagatcctatcacctgaaagcatgcccttccacaaatgtgaatacagtactcagggctccatctgaaaatggagtgacccctcttcttcctgtcacacatctgacaagccatggatgactcccagtgacattcctgggaacccaagagagcttaattcccaactctgttttaaaactcaaggaaattgggactccatgacctcctccagagtcttgatggctactgcctcaggagaaacagagcagttgaagcttttcaactaaatgggaaagggaacagttaacatcttgtgtttgcatagagctgcgcagtttacaaaacgcttctgcatatgtcatctctataccctccggtgttcaggacaatanaggatagtggatatcaacttgaagatcatcaagacctggactcaagttgcagtaattagttgggtgatcaagatcaatactattagcttctntgaccttcagttacctgttctgaaaatgggaagagcaatagtgccttcctcaggcagttatcatgtgggctaaataagcttcaaagtgcctgggtcagtgctgggaatatagtagagaccctgtaagtctgacttgtacttttctttcttggatgaaaggtgagaccactgaaatagtgaatgttctaacccctaggtggagctttgtccttgagccacccaatagtcatataacacagtttttctttctagatctctcttgtagaggatgttgggagaacaagaagagaactgtcattaattaagcatccattgtgtgtcaggcattgtgtttggcattttgcatccatgatctctttaattctcattacaagcctatgaagttcatcttaagtgactttccaggtggaatacatggcagagtcacaatttgaacctaggtctttctgtagccaggctggctttcagtaagtaaatgaaatggtgtttgagaagcactggaaactccctgagagaaatataatcaggccaggagcatgaacatgtgaggggaagacagcgtggagcagaactttctgttctgactcccaggccttcccgcagggcaggatctctgcatctggcattctaacaacatgggctgttagagcactggactcgggggcggaggacttggattctgcaacctctaccagcccaggttagcagcatggccttgagcaagttcacctctctaggtttccatgccccaccttctagaataagaatgtaggctgggggaaggggctgatttgtttcagcacctactgtgcaccagggacaatttgaagtgctggcagatgtatgactgcatttaatcttcccaaggaagctgacgctgagagaggttaagtaacttactcaagtcatgcaagtaatagattgtcacctagattctaattctaaattcgatgtcccttttgccctattgactaggcctaagatggcatctgtcactttgattctgtttgcttataactgctcagtagatcagaggcacaaatatctttctaccttagagaggcgtgcaaactatacaaatctgactcacagatacacttttcccctgccagcctgtgttctgtgtctatggcagtgttttgtggggcatgatgggatgtgcccctacaggctgataactgaagagctgttctgtttgtcctgattgctcccctccctctagctctaactctaccaaaactgagctggagctgaggaaacagcacttttcccacttcccagatggttccctctttatggcttctgtcacaccagctagaactcctccaggtgtttcaccatgccagctgcaggagcagagtgaaaggtagtgacaatgaagaacagagacaccagagaaggggacaggggacccgggatcttgtcccagctctgccactcacatacctgtgacctgtggcaagncggccagcactttaggccacagtttttcctctagaataaggaggcggcctgaattagcaagtttcaggctgagcaccacagccccctccttgcccctttcctcttcaaccatctgaagaaagggttttttggaaggaagggagggaaagaggaaagagatccacaatatttgaaaagttctgtaccagctaatctctnaaatccccgttagccctaacactcagaaattccttctatgttttaaagattttttaaaaaggatctagaagactgaaaagcaaattagaagtctttttgatcaaagcagataagataaagtagaaacttaccctatctcctaaccttgtacagagacctttccaggttgagaggccagcaaggctggcagctggaaagaaagctacagaattccccaggcagcctacagggccctgggctctgggctgtgaggtctcagcctatacaggtgccagcttgtgcaactgccccacaccctggcatgaacccacccctgatgctggccagaccctcaggctgctgcgaacagagctggccctctgccaacccccggtgctggcctctctggacagcccagcctgggaccccgactccccagcacagagatggttggcaccaccaggatgtcagatgtggctcttggcttcagctctcctcatccccagaggctctggtgatgatgaacctggggcaggatatactcagtcctcacttcatggcttctccccaagaggcctctgtcacccttgtccttgtgttacccttctgcagtgtgaatctggacaggccaccccacctctctgacctcagaagccttccctgctcacaagccactcaattcacacatggttaatcaacaatatcgagacataattcttcctcctgggccctgggagtctcagggatgaacagacagggtcacatgtcacactgtgctcagtcaagctgtgtggagcccacctcaggccatctgtgcaggtgggcttttgcatcaatctaaggcaggaatcagctggtaagagcatagactggccaggtgcagtggctcacacctgtaatcaatcccagcactttaggaggctgaggcaggcggattacctgaggtcaggagttcgagaccagcctaaccaacatggcaaaaccctgtctctactaaaaatacaaaaattagccagacatggtggcaggcacctgtaatatcccagcttcttgggaggctgaggcaggagaatcgcttgatcccaggaggcagaggttgcagtgagccaagattgcgccactgcactccagcctgggcaacggagctagactccatc

SEQ ID NO: 26538 - DNA, 3834 bp, Homo sapiens
acgctgacggacaaggccggggcgggccagagcctggtcggaggggcgcgcgcgggggcccgaggggcgaaggcgcgagtgcgcgagagcgcgtgcgcgagcggtggggctttctcctgagccgtcggagggagccggagcgcttctcccgagttggtgatagattggtggtcatccaacatgcagaaatgaatgagcagtgaaaagcagcagagccgatgggtcatgaggatgtaagtgcgtttgaaggcttccacaccctctactccaggacagaatcatgaataaactggaggataagcaggaccagatgataccatgaagagaagtttacaggccctctattgccaactgttaagtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacaccgacaccccgtgcagaggggcaccctcctacgcacaccatctccaccatcgctgcgacagtaaccgccccccattctgaaagctccctgtccacagggcccgctccagcagccatggcaaccacatcctccaagccagagggccgccctcgagggcaggctgcccccaccatcctgctgacaaagccaccgggggccaccagccgccccaccacagcgcccccccgcactaccacacgcaggccccccaggcccccaggctcttcccgaaaaggggctggtaattcatcacgccctgtcccgcctgcacctggtggccactccaggagtaaagaaggacagcgaggacgaaatccaagctccacacctctggggcagaagcggcccctggggaaaatctttcagatctacaagggcaacttcacagggtctgtggaaccggagccctctaccctcacccccaggaccccactctggggctactcctcttcaccacagccccagacagtggctgcgaccacagtgcccagcaatacctcatgggcacccaccaccacctccctggggcctgcaaaggacaagccaggccttcgcagagcagcccaggggggtggttctaccttcaccagccaaggagggacaccagatgccacagcagcctcaggtgcccctgtcagtccacaagctgccccagtgccttctcagcgcccccaccacggtgacccacaggatggccccagccatagtgactcttggcttactgttacccctggcaccagcagacctctgtctaccagctctggggtcttcacggctgccacggggcccaccccagctgccttcgataccagtgtctcagccccttcccaggggattcctcagggagcatccacaaccccacaagctccaacccatccctccagggtctcagaaagcactatttctggagccaaggaggagactgtggccaccctcaccatgaccgaccgggtgcccagtcctctctccacagtggtatccacagccacaggcaatttcctcaaccgcctggtccccgccgggacctggaagcctgggacagcagggaacatctcccatgtggccgagggggacaaaccgcagcacagagccaccatctgcctgagcaagatggatatcgcctgggtgatcctggccatcagcgtgcccatctcctcctgctctgtcctgctgacggtgtgctgcatgaagaggaagaagaagaccgccaacccggagaacaacctgagctactggaacaacaccatcaccatggactacttcaacaggcatgctgtggagctgcccagggagatccagtcccttgaaacctctgaggaccagctctcagagccccgctccccagccaatggcgactatagagacactgggatggtccttgttaaccccttctgtcaagaaacactgtttgtgggaaacgatcaagtatctgagatctaactacagcaggcatcactttgccattccgtatttttcgtctctaaattataaatatacaaatatatatattataaatataacctttgtgtaaccctgacttaatgagaaacattttcagctttttttcctatgaattgtcaacatcttttttacaagtgtggtttaaaaaaaaaaaaactttacagaatgatctgtggctttataaaataaaggtatttctaagcaaagcagttgcattgattgcttctcttaataactattcttgagcacctggggatcccaggaaccctggtcaggtgaggtaagagactgacctcctgtagaagctgaatgttacagtggtcaagcgcacgattctttgagtgattcttaaagctctggttcctcttgatttggtgtgaccccatttcctcccttctcatacgcacacctgtaaagggaactggaccgcctcaggggaagacggcagactcatgcacagagaaggaaaagggaacatctcatcacctccgaggatgagtaccctggagccttatgacggcaccattggatgtcatgtttaattccatccaagttgtggatggcaggcaggagcatggagccctcaggaatccatggaggacatcaaggcatcccaaggccatattcccctaacattacttccactgctaacaacaggactgcctttccctggtgggaaaatgctccctttatgcccattcctgtatcccctccaacacccacatctgcattaaacacccgtgcctttctcttggagagggtttagatgcagatcccggccctggagctttaaaatgcttgcccttccttcttcaaggatcaaatgtttattggggttcagctttgttttctcaaaaggccatggtatcgtgcccctgaggaacatgtttatctaagaagctttgaggtagtagagcgataatttttgaaaccttcctcctgcaatctttaaaaaagaaaaaaaagattgcccaaacaaatcatttgggagaagacatcattatactcctacttggcactgcaaacctgctcgcagcaccagccggtggacttgccatccagctctcagcttccactgctccccttgttcccggccggctggctgcctccccgtgctgtgtccagcacggccaacaacgtcagaccctcagagacgcccaaggggcttccagaggtggccgcttctctattttttcctgattgtggctgagagagatgattactgctttgacacttcctttctctaaaagaaaaatagtttgatagtatattttgaatatagatgctcttatagtcagattgggaattgaacttgaatattgggtcatatgtttgtgttgttgctgtagtctatcatgacttttttctttctgcattttccttaaaaaaaaaaaaaagatggccttcaaaagtgtgttctcaatgttgtatgaacctccttcacatgagttcggttgttgtctctcttcaaagactcttcaacccacaaagaagcaactaaatgtttctctaagtttaattttctagcgtgttgttgtcttacctttttaaccttaccataatatttctgttaactgttacatttaatataccaatgtgtgtaagtatacagagaaaaatctgtttgtaaagtaaaatttatatataatatatgtaatcaaagatacatatgttatatatacatatgtggatgtatgacttatttttccttatccacagatttcagctaccatgtatatataaataaacttattttattagccagag

SEQ ID NO: 26539 - DNA, 3900 bp, Homo sapiens
acgctgacggacaaggccggggcgggccagagcctggtcggaggggcgcgcgcgggggcccgaggggcgaaggcgcgagtgcgcgagagcgcgtgcgcgagcggtggggctttctcctgagccgtcggagggagccggagcgcttctcccgagctagtctacacacatggatgggactatggaaatatacatgtgacttttaaacctgaacagtagctgttggtgatagattggtggtcatccaacatgcagaaatgaatgagcagtgaaaagcagcagagccgatgggtcatgaggatgtaagtgcgtttgaaggcttccacaccctctactccaggacagaatcatgaataaactggaggataagcaggaccagatgataccatgaagagaagtttacaggccctctattgccaactgttaagtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacaccgacaccccgtgcagaggggcaccctcctacgcacaccatctccaccatcgctgcgacagtaaccgccccccattctgaaagctccctgtccacagggcccgctccagcagccatggcaaccacatcctccaagccagagggccgccctcgagggcaggctgcccccaccatcctgctgacaaagccaccgggggccaccagccgccccaccacagcgcccccccgcactaccacacgcaggccccccaggcccccaggctcttcccgaaaaggggctggtaattcatcacgccctgtcccgcctgcacctggtggccactccaggagtaaagaaggacagcgaggacgaaatccaagctccacacctctggggcagaagcggcccctggggaaaatctttcagatctacaagggcaacttcacagggtctgtggaaccggagccctctaccctcacccccaggaccccactctggggctactcctcttcaccacagccccagacagtggctgcgaccacagtgcccagcaatacctcatgggcacccaccaccacctccctggggcctgcaaaggacaagccaggccttcgcagagcagcccaggggggtggttctaccttcaccagccaaggagggacaccagatgccacagcagcctcaggtgcccctgtcagtccacaagctgccccagtgccttctcagcgcccccaccacggtgacccacaggatggccccagccatagtgactcttggcttactgttacccctggcaccagcagacctctgtctaccagctctggggtcttcacggctgccacggggcccaccccagctgccttcgataccagtgtctcagccccttcccaggggattcctcagggagcatccacaaccccacaagctccaacccatccctccagggtctcagaaagcactatttctggagccaaggaggagactgtggccaccctcaccatgaccgaccgggtgcccagtcctctctccacagtggtatccacagccacaggcaatttcctcaaccgcctggtccccgccgggacctggaagcctgggacagcagggaacatctcccatgtggccgagggggacaaaccgcagcacagagccaccatctgcctgagcaagatggatatcgcctgggtgatcctggccatcagcgtgcccatctcctcctgctctgtcctgctgacggtgtgctgcatgaagaggaagaagaagaccgccaacccggagaacaacctgagctactggaacaacaccatcaccatggactacttcaacaggcatgctgtggagctgcccagggagatccagtcccttgaaacctctgaggaccagctctcagagccccgctccccagccaatggcgactatagagacactgggatggtccttgttaaccccttctgtcaagaaacactgtttgtgggaaacgatcaagtatctgagatctaactacagcaggcatcactttgccattccgtatttttcgtctctaaattataaatatacaaatatatatattataaatataacctttgtgtaaccctgacttaatgagaaacattttcagctttttttcctatgaattgtcaacatcttttttacaagtgtggtttaaaaaaaaaaaaactttacagaatgatctgtggctttataaaataaaggtatttctaagcaaagcagttgcattgattgcttctcttaataactattcttgagcacctggggatcccaggaaccctggtcaggtgaggtaagagactgacctcctgtagaagctgaatgttacagtggtcaagcgcacgattctttgagtgattcttaaagctctggttcctcttgatttggtgtgaccccatttcctcccttctcatacgcacacctgtaaagggaactggaccgcctcaggggaagacggcagactcatgcacagagaaggaaaagggaacatctcatcacctccgaggatgagtaccctggagccttatgacggcaccattggatgtcatgtttaattccatccaagttgtggatggcaggcaggagcatggagccctcaggaatccatggaggacatcaaggcatcccaaggccatattcccctaacattacttccactgctaacaacaggactgcctttccctggtgggaaaatgctccctttatgcccattcctgtatcccctccaacacccacatctgcattaaacacccgtgcctttctcttggagagggtttagatgcagatcccggccctggagctttaaaatgcttgcccttccttcttcaaggatcaaatgtttattggggttcagctttgttttctcaaaaggccatggtatcgtgcccctgaggaacatgtttatctaagaagctttgaggtagtagagcgataatttttgaaaccttcctcctgcaatctttaaaaaagaaaaaaaagattgcccaaacaaatcatttgggagaagacatcattatactcctacttggcactgcaaacctgctcgcagcaccagccggtggacttgccatccagctctcagcttccactgctccccttgttcccggccggctggctgcctccccgtgctgtgtccagcacggccaacaacgtcagaccctcagagacgcccaaggggcttccagaggtggccgcttctctattttttcctgattgtggctgagagagatgattactgctttgacacttcctttctctaaaagaaaaatagtttgatagtatattttgaatatagatgctcttatagtcagattgggaattgaacttgaatattgggtcatatgtttgtgttgttgctgtagtctatcatgacttttttctttctgcattttccttaaaaaaaaaaaaaagatggccttcaaaagtgtgttctcaatgttgtatgaacctccttcacatgagttcggttgttgtctctcttcaaagactcttcaacccacaaagaagcaactaaatgtttctctaagtttaattttctagcgtgttgttgtcttacctttttaaccttaccataatatttctgttaactgttacatttaatataccaatgtgtgtaagtatacagagaaaaatctgtttgtaaagtaaaatttatatataatatatgtaatcaaagatacatatgttatatatacatatgtggatgtatgacttatttttccttatccacagatttcagctaccatgtatatataaataaacttattttattagccagag

SEQ ID NO: 26540 - DNA, 4041 bp, Homo sapiens
acgctgacggacaaggccggggcgggccagagcctggtcggaggggcgcgcgcgggggcccgaggggcgaaggcgcgagtgcgcgagagcgcgtgcgcgagcggtggggctttctcctgagccgtcggagggagccggagcgcttctcccgagttggtgatagattggtggtcatccaacatgcagaaatgaatgagcagtgaaaagcagcagagccgatgggtcatgaggatgtaagtgcgtttgaaggcttccacaccctctactccaggacagaatcatgaataaactggaggataagcaggaccagatgataccatgaagagaagtttacaggccctctattgccaactgttaaatctccatcagacacctgggaatcacagctggggcccctgctttggccgtttgtcctgctggaatctgatggaggaaagacgctctgagagagtaattagacgcagacagagatctctctccatagtcagaggcagcctagcaggggctgaaggaactgcctgaggatgacaaagaaggggatccatgaacaaggaggtgctaacaggtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacaccgacaccccgtgcagaggggcaccctcctacgcacaccatctccaccatcgctgcgacagtaaccgccccccattctgaaagctccctgtccacagggcccgctccagcagccatggcaaccacatcctccaagccagagggccgccctcgagggcaggctgcccccaccatcctgctgacaaagccaccgggggccaccagccgccccaccacagcgcccccccgcactaccacacgcaggccccccaggcccccaggctcttcccgaaaaggggctggtaattcatcacgccctgtcccgcctgcacctggtggccactccaggagtaaagaaggacagcgaggacgaaatccaagctccacacctctggggcagaagcggcccctggggaaaatctttcagatctacaagggcaacttcacagggtctgtggaaccggagccctctaccctcacccccaggaccccactctggggctactcctcttcaccacagccccagacagtggctgcgaccacagtgcccagcaatacctcatgggcacccaccaccacctccctggggcctgcaaaggacaagccaggccttcgcagagcagcccaggggggtggttctaccttcaccagccaaggagggacaccagatgccacagcagcctcaggtgcccctgtcagtccacaagctgccccagtgccttctcagcgcccccaccacggtgacccacaggatggccccagccatagtgactcttggcttactgttacccctggcaccagcagacctctgtctaccagctctggggtcttcacggctgccacggggcccaccccagctgccttcgataccagtgtctcagccccttcccaggggattcctcagggagcatccacaaccccacaagctccaacccatccctccagggtctcagaaagcactatttctggagccaaggaggagactgtggccaccctcaccatgaccgaccgggtgcccagtcctctctccacagtggtatccacagccacaggcaatttcctcaaccgcctggtccccgccgggacctggaagcctgggacagcagggaacatctcccatgtggccgagggggacaaaccgcagcacagagccaccatctgcctgagcaagatggatatcgcctgggtgatcctggccatcagcgtgcccatctcctcctgctctgtcctgctgacggtgtgctgcatgaagaggaagaagaagaccgccaacccggagaacaacctgagctactggaacaacaccatcaccatggactacttcaacaggcatgctgtggagctgcccagggagatccagtcccttgaaacctctgaggaccagctctcagagccccgctccccagccaatggcgactatagagacactgggatggtccttgttaaccccttctgtcaagaaacactgtttgtgggaaacgatcaagtatctgagatctaactacagcaggcatcactttgccattccgtatttttcgtctctaaattataaatatacaaatatatatattataaatataacctttgtgtaaccctgacttaatgagaaacattttcagctttttttcctatgaattgtcaacatcttttttacaagtgtggtttaaaaaaaaaaaaactttacagaatgatctgtggctttataaaataaaggtatttctaagcaaagcagttgcattgattgcttctcttaataactattcttgagcacctggggatcccaggaaccctggtcaggtgaggtaagagactgacctcctgtagaagctgaatgttacagtggtcaagcgcacgattctttgagtgattcttaaagctctggttcctcttgatttggtgtgaccccatttcctcccttctcatacgcacacctgtaaagggaactggaccgcctcaggggaagacggcagactcatgcacagagaaggaaaagggaacatctcatcacctccgaggatgagtaccctggagccttatgacggcaccattggatgtcatgtttaattccatccaagttgtggatggcaggcaggagcatggagccctcaggaatccatggaggacatcaaggcatcccaaggccatattcccctaacattacttccactgctaacaacaggactgcctttccctggtgggaaaatgctccctttatgcccattcctgtatcccctccaacacccacatctgcattaaacacccgtgcctttctcttggagagggtttagatgcagatcccggccctggagctttaaaatgcttgcccttccttcttcaaggatcaaatgtttattggggttcagctttgttttctcaaaaggccatggtatcgtgcccctgaggaacatgtttatctaagaagctttgaggtagtagagcgataatttttgaaaccttcctcctgcaatctttaaaaaagaaaaaaaagattgcccaaacaaatcatttgggagaagacatcattatactcctacttggcactgcaaacctgctcgcagcaccagccggtggacttgccatccagctctcagcttccactgctccccttgttcccggccggctggctgcctccccgtgctgtgtccagcacggccaacaacgtcagaccctcagagacgcccaaggggcttccagaggtggccgcttctctattttttcctgattgtggctgagagagatgattactgctttgacacttcctttctctaaaagaaaaatagtttgatagtatattttgaatatagatgctcttatagtcagattgggaattgaacttgaatattgggtcatatgtttgtgttgttgctgtagtctatcatgacttttttctttctgcattttccttaaaaaaaaaaaaaagatggccttcaaaagtgtgttctcaatgttgtatgaacctccttcacatgagttcggttgttgtctctcttcaaagactcttcaacccacaaagaagcaactaaatgtttctctaagtttaattttctagcgtgttgttgtcttacctttttaaccttaccataatatttctgttaactgttacatttaatataccaatgtgtgtaagtatacagagaaaaatctgtttgtaaagtaaaatttatatataatatatgtaatcaaagatacatatgttatatatacatatgtggatgtatgacttatttttccttatccacagatttcagctaccatgtatatataaataaacttattttattagccagag

SEQ ID NO: 26541 - DNA, 3612 bp, Homo sapiens
ggtgaggcggcagcttcatgaggaaggagaatgcattgggaagcaagaaaacagaatcatgaataaactggaggataagcaggaccagatgataccatgaagagaagtttacaggccctctattgccaactgttaagtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacaccgacaccccgtgcagaggggcaccctcctacgcacaccatctccaccatcgctgcgacagtaaccgccccccattctgaaagctccctgtccacagggcccgctccagcagccatggcaaccacatcctccaagccagagggccgccctcgagggcaggctgcccccaccatcctgctgacaaagccaccgggggccaccagccgccccaccacagcgcccccccgcactaccacacgcaggccccccaggcccccaggctcttcccgaaaaggggctggtaattcatcacgccctgtcccgcctgcacctggtggccactccaggagtaaagaaggacagcgaggacgaaatccaagctccacacctctggggcagaagcggcccctggggaaaatctttcagatctacaagggcaacttcacagggtctgtggaaccggagccctctaccctcacccccaggaccccactctggggctactcctcttcaccacagccccagacagtggctgcgaccacagtgcccagcaatacctcatgggcacccaccaccacctccctggggcctgcaaaggacaagccaggccttcgcagagcagcccaggggggtggttctaccttcaccagccaaggagggacaccagatgccacagcagcctcaggtgcccctgtcagtccacaagctgccccagtgccttctcagcgcccccaccacggtgacccacaggatggccccagccatagtgactcttggcttactgttacccctggcaccagcagacctctgtctaccagctctggggtcttcacggctgccacggggcccaccccagctgccttcgataccagtgtctcagccccttcccaggggattcctcagggagcatccacaaccccacaagctccaacccatccctccagggtctcagaaagcactatttctggagccaaggaggagactgtggccaccctcaccatgaccgaccgggtgcccagtcctctctccacagtggtatccacagccacaggcaatttcctcaaccgcctggtccccgccgggacctggaagcctgggacagcagggaacatctcccatgtggccgagggggacaaaccgcagcacagagccaccatctgcctgagcaagatggatatcgcctgggtgatcctggccatcagcgtgcccatctcctcctgctctgtcctgctgacggtgtgctgcatgaagaggaagaagaagaccgccaacccggagaacaacctgagctactggaacaacaccatcaccatggactacttcaacaggcatgctgtggagctgcccagggagatccagtcccttgaaacctctgaggaccagctctcagagccccgctccccagccaatggcgactatagagacactgggatggtccttgttaaccccttctgtcaagaaacactgtttgtgggaaacgatcaagtatctgagatctaactacagcaggcatcactttgccattccgtatttttcgtctctaaattataaatatacaaatatatatattataaatataacctttgtgtaaccctgacttaatgagaaacattttcagctttttttcctatgaattgtcaacatcttttttacaagtgtggtttaaaaaaaaaaaaactttacagaatgatctgtggctttataaaataaaggtatttctaagcaaagcagttgcattgattgcttctcttaataactattcttgagcacctggggatcccaggaaccctggtcaggtgaggtaagagactgacctcctgtagaagctgaatgttacagtggtcaagcgcacgattctttgagtgattcttaaagctctggttcctcttgatttggtgtgaccccatttcctcccttctcatacgcacacctgtaaagggaactggaccgcctcaggggaagacggcagactcatgcacagagaaggaaaagggaacatctcatcacctccgaggatgagtaccctggagccttatgacggcaccattggatgtcatgtttaattccatccaagttgtggatggcaggcaggagcatggagccctcaggaatccatggaggacatcaaggcatcccaaggccatattcccctaacattacttccactgctaacaacaggactgcctttccctggtgggaaaatgctccctttatgcccattcctgtatcccctccaacacccacatctgcattaaacacccgtgcctttctcttggagagggtttagatgcagatcccggccctggagctttaaaatgcttgcccttccttcttcaaggatcaaatgtttattggggttcagctttgttttctcaaaaggccatggtatcgtgcccctgaggaacatgtttatctaagaagctttgaggtagtagagcgataatttttgaaaccttcctcctgcaatctttaaaaaagaaaaaaaagattgcccaaacaaatcatttgggagaagacatcattatactcctacttggcactgcaaacctgctcgcagcaccagccggtggacttgccatccagctctcagcttccactgctccccttgttcccggccggctggctgcctccccgtgctgtgtccagcacggccaacaacgtcagaccctcagagacgcccaaggggcttccagaggtggccgcttctctattttttcctgattgtggctgagagagatgattactgctttgacacttcctttctctaaaagaaaaatagtttgatagtatattttgaatatagatgctcttatagtcagattgggaattgaacttgaatattgggtcatatgtttgtgttgttgctgtagtctatcatgacttttttctttctgcattttccttaaaaaaaaaaaaaagatggccttcaaaagtgtgttctcaatgttgtatgaacctccttcacatgagttcggttgttgtctctcttcaaagactcttcaacccacaaagaagcaactaaatgtttctctaagtttaattttctagcgtgttgttgtcttacctttttaaccttaccataatatttctgttaactgttacatttaatataccaatgtgtgtaagtatacagagaaaaatctgtttgtaaagtaaaatttatatataatatatgtaatcaaagatacatatgttatatatacatatgtggatgtatgacttatttttccttatccacagatttcagctaccatgtatatataaataaacttattttattagccagag

SEQ ID NO: 26542 - DNA, 3811 bp, Homo sapiens
  misc_feature (45)..(45): n is a, c, g, or t
gtttgcaaagacagagcctctcatgagaacttggatggtggagtntaaacactcatttaaaaataaatccagatgtagttggctgcagtcatctgacagaaccctgattctctcttcaataatgacgttcatttgtccctcattaattgagagttcttaataatttctccagggtaagaaaactgagtcacacaaggatatatttgtgtaacacaatttcaaaaaggcaaactcttgctcttgttaacgacagaatcatgaataaactggaggataagcaggaccagatgataccatgaagagaagtttacaggccctctattgccaactgttaagtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacaccgacaccccgtgcagaggggcaccctcctacgcacaccatctccaccatcgctgcgacagtaaccgccccccattctgaaagctccctgtccacagggcccgctccagcagccatggcaaccacatcctccaagccagagggccgccctcgagggcaggctgcccccaccatcctgctgacaaagccaccgggggccaccagccgccccaccacagcgcccccccgcactaccacacgcaggccccccaggcccccaggctcttcccgaaaaggggctggtaattcatcacgccctgtcccgcctgcacctggtggccactccaggagtaaagaaggacagcgaggacgaaatccaagctccacacctctggggcagaagcggcccctggggaaaatctttcagatctacaagggcaacttcacagggtctgtggaaccggagccctctaccctcacccccaggaccccactctggggctactcctcttcaccacagccccagacagtggctgcgaccacagtgcccagcaatacctcatgggcacccaccaccacctccctggggcctgcaaaggacaagccaggccttcgcagagcagcccaggggggtggttctaccttcaccagccaaggagggacaccagatgccacagcagcctcaggtgcccctgtcagtccacaagctgccccagtgccttctcagcgcccccaccacggtgacccacaggatggccccagccatagtgactcttggcttactgttacccctggcaccagcagacctctgtctaccagctctggggtcttcacggctgccacggggcccaccccagctgccttcgataccagtgtctcagccccttcccaggggattcctcagggagcatccacaaccccacaagctccaacccatccctccagggtctcagaaagcactatttctggagccaaggaggagactgtggccaccctcaccatgaccgaccgggtgcccagtcctctctccacagtggtatccacagccacaggcaatttcctcaaccgcctggtccccgccgggacctggaagcctgggacagcagggaacatctcccatgtggccgagggggacaaaccgcagcacagagccaccatctgcctgagcaagatggatatcgcctgggtgatcctggccatcagcgtgcccatctcctcctgctctgtcctgctgacggtgtgctgcatgaagaggaagaagaagaccgccaacccggagaacaacctgagctactggaacaacaccatcaccatggactacttcaacaggcatgctgtggagctgcccagggagatccagtcccttgaaacctctgaggaccagctctcagagccccgctccccagccaatggcgactatagagacactgggatggtccttgttaaccccttctgtcaagaaacactgtttgtgggaaacgatcaagtatctgagatctaactacagcaggcatcactttgccattccgtatttttcgtctctaaattataaatatacaaatatatatattataaatataacctttgtgtaaccctgacttaatgagaaacattttcagctttttttcctatgaattgtcaacatcttttttacaagtgtggtttaaaaaaaaaaaaactttacagaatgatctgtggctttataaaataaaggtatttctaagcaaagcagttgcattgattgcttctcttaataactattcttgagcacctggggatcccaggaaccctggtcaggtgaggtaagagactgacctcctgtagaagctgaatgttacagtggtcaagcgcacgattctttgagtgattcttaaagctctggttcctcttgatttggtgtgaccccatttcctcccttctcatacgcacacctgtaaagggaactggaccgcctcaggggaagacggcagactcatgcacagagaaggaaaagggaacatctcatcacctccgaggatgagtaccctggagccttatgacggcaccattggatgtcatgtttaattccatccaagttgtggatggcaggcaggagcatggagccctcaggaatccatggaggacatcaaggcatcccaaggccatattcccctaacattacttccactgctaacaacaggactgcctttccctggtgggaaaatgctccctttatgcccattcctgtatcccctccaacacccacatctgcattaaacacccgtgcctttctcttggagagggtttagatgcagatcccggccctggagctttaaaatgcttgcccttccttcttcaaggatcaaatgtttattggggttcagctttgttttctcaaaaggccatggtatcgtgcccctgaggaacatgtttatctaagaagctttgaggtagtagagcgataatttttgaaaccttcctcctgcaatctttaaaaaagaaaaaaaagattgcccaaacaaatcatttgggagaagacatcattatactcctacttggcactgcaaacctgctcgcagcaccagccggtggacttgccatccagctctcagcttccactgctccccttgttcccggccggctggctgcctccccgtgctgtgtccagcacggccaacaacgtcagaccctcagagacgcccaaggggcttccagaggtggccgcttctctattttttcctgattgtggctgagagagatgattactgctttgacacttcctttctctaaaagaaaaatagtttgatagtatattttgaatatagatgctcttatagtcagattgggaattgaacttgaatattgggtcatatgtttgtgttgttgctgtagtctatcatgacttttttctttctgcattttccttaaaaaaaaaaaaaagatggccttcaaaagtgtgttctcaatgttgtatgaacctccttcacatgagttcggttgttgtctctcttcaaagactcttcaacccacaaagaagcaactaaatgtttctctaagtttaattttctagcgtgttgttgtcttacctttttaaccttaccataatatttctgttaactgttacatttaatataccaatgtgtgtaagtatacagagaaaaatctgtttgtaaagtaaaatttatatataatatatgtaatcaaagatacatatgttatatatacatatgtggatgtatgacttatttttccttatccacagatttcagctaccatgtatatataaataaacttattttattagccagag

SEQ ID NO: 26543 - DNA, 3924 bp, Homo sapiens
acgctgacggacaaggccggggcgggccagagcctggtcggaggggcgcgcgcgggggcccgaggggcgaaggcgcgagtgcgcgagagcgcgtgcgcgagcggtggggctttctcctgagccgtcggagggagccggagcgcttctcccgagttggtgatagattggtggtcatccaacatgcagaaatgaatgagcagtgaaaagcagcagagccgatgggtcatgaggatgtaagtgcgtttgaaggcttccacaccctctactccaggacagaatcatgaataaactggaggataagcaggaccagatgataccatgaagagaagtttacaggccctctattgccaactgttaagtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacaccgacaccccgtgcagaggggcaccctcctacgcacaccatctccaccatcgctgcgacagtaaccgccccccattctgaaagctccctgtccacagggcccgctccagcagccatggcaaccacatcctccaagccagagggccgccctcgagggcaggctgcccccaccatcctgctgacaaagccaccgggggccaccagccgccccaccacagcgcccccccgcactaccacacgcaggccccccaggcccccaggctcttcccgaaaaggggctggtaattcatcacgccctgtcccgcctgcacctggtggccactccaggagtaaagaaggacagcgaggacgaaatccaagctccacacctctggggcagaagcggcccctggggaaaatctttcagatctacaagggcaacttcacagggtctgtggaaccggagccctctaccctcacccccaggaccccactctggggctactcctcttcaccacagccccagacagtggctgcgaccacagtgcccagcaatacctcatgggcacccaccaccacctccctggggcctgcaaaggacaagccaggccttcgcagagcagcccaggggggtggttctaccttcaccagccaaggagggacaccagatgccacagcagcctcaggtgcccctgtcagtccacaagctgccccagtgccttctcagcgcccccaccacggtgacccacaggatggccccagccatagtgactcttggcttactgttacccctggcaccagcagacctctgtctaccagctctggggtcttcacggctgccacggggcccaccccagctgccttcgataccagtgtctcagccccttcccaggggattcctcagggagcatccacaaccccacaagctccaacccatccctccagggtctcagaaagcactatttctggagccaaggaggagactgtggccaccctcaccatgaccgaccgggtgcccagtcctctctccacagtggtatccacagccacaggcaatttcctcaaccgcctggtccccgccgggacctggaagcctgggacagcagggaacatctcccatgtggccgagggggacaaaccgcagcacagagccaccatctgcctgagcaagatggatatcgcctgggtgatcctggccatcagcgtgcccatctcctcctgctctgtcctgctgacggtgtgctgcatgaagaggaagaagaagaccgccaacccggagaacaacctgagctactggaacaacaccatcaccatggactacttcaacaggcatgctgtggagctgcccagggagatccagtcccttgaaacctctgaggaccagctctcagagccccgctccccagccaatggcgactatagagacactgggatggtccttgttaaccccttctgtcaagaaacactgtttgtgggaaacgatcaagtatctgagatctaactacagcaggcatcactttgccattccgtatttttcgtctctaaattataaatatacaaatatatatattataaatataacctttgtgtaaccctgacttaatgagaaacattttcagctttttttcctatgaattgtcaacatcttttttacaagtgtggtttaaaaaaaaaaaaactttacagaatgatctgtggctttataaaataaaggtatttctaagcaaagcagttgcattgattgcttctcttaataactattcttgagcacctggggatcccaggaaccctggtcaggtgaggtaagagactgacctcctgtagaagctgaatgttacagtggtcaagcgcacgattctttgagtgattcttaaagctctggttcctcttgatttggtgtgaccccatttcctcccttctcatacgcacacctgtaaagggaactggaccgcctcaggggaagacggcagactcatgcacagagaaggaaaagggaacatctcatcacctccgaggatgagtaccctggagccttatgacggcaccattggatgtcatgtttaattccatccaagttgtggatggcaggcaggagcatggagccctcaggaatccatggaggacatcaaggcatcccaaggccatattcccctaacattacttccactgctaacaacaggactgcctttccctggtgggaaaatgctccctttatgcccattcctgtatcccctccaacacccacatctgcattaaacacccgtgcctttctcttggagagggtttagatgcagatcccggccctggagctttaaaatgcttgcccttccttcttcaaggatcaaatgtttattggggttcagctttgttttctcaaaaggccatggtatcgtgcccctgaggaacatgtttatctaagaagctttgaggtagtagagcgataatttttgaaaccttcctcctgcaatctttaaaaaagaaaaaaaagattgcccaaacaaatcatttgggagaagacatcattatactcctacttggcactgcaaacctgctcgcagcaccagccggtggacttgccatccagctctcagcttccactgctccccttgttcccggccggctggctgcctccccgtgctgtgtccagcacggccaacaacgtcagaccctcagagacgcccaaggggcttccagaggtggccgcttctctattttttcctgattgtggctgagagagatgattactgctttgacacttcctttctctaaaagaaaaatagtttgatagtatattttgaatatagatgctcttatagtcagattgggaattgaacttgaatattgggtcatatgtttgtgttgttgctgtagtctatcatgacttttttctttctgcattttccttaaaaaaaaaaaaaagatggccttcaaaagtgtgttctcaatgttgtatgaacctccttcacatgagttcggttgttgtctctcttcaaagactcttcaacccacaaagaagcaactaaatgtttctctaagtttaattttctagcgtgttgttgtcttacctttttaaccttaccataatatttctgttaactgttacatttaatataccaatgtgtgtaagtatacagagaaaaatctgtttgtaaagtaaaatttatatataatatatgtaatcaaagatacatatgttatatatacatatgtggatgtatgacttatttttccttatccacagatttcagctaccatgtatatataaataaacttattttattagccagaggattctgttgctaatacattttgcattcttttcaagataagctctaagtcttccttaagcagtaccaacaccactttatatccatctgta

SEQ ID NO: 26544 - DNA, 3891 bp, Homo sapiens
agcggggggagcaagacggcagcatctacggttctttctgctcaggaatgggaacccagagtgggcagtagagcggaggcaagccatgcagaggcaggagcagatgagaccctagatgccacgagaagctaaacatgtggggaaaataaagagcagattaactcaggaaaattatatggggagctcttatgctactctgaagatctgagactcgttggagaatttacaatcccaaattaactcagggagaattccaactagactctgaaatgaattagatggagatttaaaatagggcaatttagtgggaagagatacttaatttgaagacagaatcatgaataaactggaggataagcaggaccagatgataccatgaagagaagtttacaggccctctattgccaactgttaagtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacaccgacaccccgtgcagaggggcaccctcctacgcacaccatctccaccatcgctgcgacagtaaccgccccccattctgaaagctccctgtccacagggcccgctccagcagccatggcaaccacatcctccaagccagagggccgccctcgagggcaggctgcccccaccatcctgctgacaaagccaccgggggccaccagccgccccaccacagcgcccccccgcactaccacacgcaggccccccaggcccccaggctcttcccgaaaaggggctggtaattcatcacgccctgtcccgcctgcacctggtggccactccaggagtaaagaaggacagcgaggacgaaatccaagctccacacctctggggcagaagcggcccctggggaaaatctttcagatctacaagggcaacttcacagggtctgtggaaccggagccctctaccctcacccccaggaccccactctggggctactcctcttcaccacagccccagacagtggctgcgaccacagtgcccagcaatacctcatgggcacccaccaccacctccctggggcctgcaaaggacaagccaggccttcgcagagcagcccaggggggtggttctaccttcaccagccaaggagggacaccagatgccacagcagcctcaggtgcccctgtcagtccacaagctgccccagtgccttctcagcgcccccaccacggtgacccacaggatggccccagccatagtgactcttggcttactgttacccctggcaccagcagacctctgtctaccagctctggggtcttcacggctgccacggggcccaccccagctgccttcgataccagtgtctcagccccttcccaggggattcctcagggagcatccacaaccccacaagctccaacccatccctccagggtctcagaaagcactatttctggagccaaggaggagactgtggccaccctcaccatgaccgaccgggtgcccagtcctctctccacagtggtatccacagccacaggcaatttcctcaaccgcctggtccccgccgggacctggaagcctgggacagcagggaacatctcccatgtggccgagggggacaaaccgcagcacagagccaccatctgcctgagcaagatggatatcgcctgggtgatcctggccatcagcgtgcccatctcctcctgctctgtcctgctgacggtgtgctgcatgaagaggaagaagaagaccgccaacccggagaacaacctgagctactggaacaacaccatcaccatggactacttcaacaggcatgctgtggagctgcccagggagatccagtcccttgaaacctctgaggaccagctctcagagccccgctccccagccaatggcgactatagagacactgggatggtccttgttaaccccttctgtcaagaaacactgtttgtgggaaacgatcaagtatctgagatctaactacagcaggcatcactttgccattccgtatttttcgtctctaaattataaatatacaaatatatatattataaatataacctttgtgtaaccctgacttaatgagaaacattttcagctttttttcctatgaattgtcaacatcttttttacaagtgtggtttaaaaaaaaaaaaactttacagaatgatctgtggctttataaaataaaggtatttctaagcaaagcagttgcattgattgcttctcttaataactattcttgagcacctggggatcccaggaaccctggtcaggtgaggtaagagactgacctcctgtagaagctgaatgttacagtggtcaagcgcacgattctttgagtgattcttaaagctctggttcctcttgatttggtgtgaccccatttcctcccttctcatacgcacacctgtaaagggaactggaccgcctcaggggaagacggcagactcatgcacagagaaggaaaagggaacatctcatcacctccgaggatgagtaccctggagccttatgacggcaccattggatgtcatgtttaattccatccaagttgtggatggcaggcaggagcatggagccctcaggaatccatggaggacatcaaggcatcccaaggccatattcccctaacattacttccactgctaacaacaggactgcctttccctggtgggaaaatgctccctttatgcccattcctgtatcccctccaacacccacatctgcattaaacacccgtgcctttctcttggagagggtttagatgcagatcccggccctggagctttaaaatgcttgcccttccttcttcaaggatcaaatgtttattggggttcagctttgttttctcaaaaggccatggtatcgtgcccctgaggaacatgtttatctaagaagctttgaggtagtagagcgataatttttgaaaccttcctcctgcaatctttaaaaaagaaaaaaaagattgcccaaacaaatcatttgggagaagacatcattatactcctacttggcactgcaaacctgctcgcagcaccagccggtggacttgccatccagctctcagcttccactgctccccttgttcccggccggctggctgcctccccgtgctgtgtccagcacggccaacaacgtcagaccctcagagacgcccaaggggcttccagaggtggccgcttctctattttttcctgattgtggctgagagagatgattactgctttgacacttcctttctctaaaagaaaaatagtttgatagtatattttgaatatagatgctcttatagtcagattgggaattgaacttgaatattgggtcatatgtttgtgttgttgctgtagtctatcatgacttttttctttctgcattttccttaaaaaaaaaaaaaagatggccttcaaaagtgtgttctcaatgttgtatgaacctccttcacatgagttcggttgttgtctctcttcaaagactcttcaacccacaaagaagcaactaaatgtttctctaagtttaattttctagcgtgttgttgtcttacctttttaaccttaccataatatttctgttaactgttacatttaatataccaatgtgtgtaagtatacagagaaaaatctgtttgtaaagtaaaatttatatataatatatgtaatcaaagatacatatgttatatatacatatgtggatgtatgacttatttttccttatccacagatttcagctaccatgtatatataaataaacttattttattagccagag

SEQ ID NO: 26545 - DNA, 3692 bp, Homo sapiens
gaggtaaactgtgtgactgcatggagagccatgagctgcaatagtcacctgagaggaagctgagtaactaaagcaaggcaaagcaaggataatgaagagaagaaaagaaattttaaaagacattcgtgcgacagaatcatgaataaactggaggataagcaggaccagatgataccatgaagagaagtttacaggccctctattgccaactgttaagtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacaccgacaccccgtgcagaggggcaccctcctacgcacaccatctccaccatcgctgcgacagtaaccgccccccattctgaaagctccctgtccacagggcccgctccagcagccatggcaaccacatcctccaagccagagggccgccctcgagggcaggctgcccccaccatcctgctgacaaagccaccgggggccaccagccgccccaccacagcgcccccccgcactaccacacgcaggccccccaggcccccaggctcttcccgaaaaggggctggtaattcatcacgccctgtcccgcctgcacctggtggccactccaggagtaaagaaggacagcgaggacgaaatccaagctccacacctctggggcagaagcggcccctggggaaaatctttcagatctacaagggcaacttcacagggtctgtggaaccggagccctctaccctcacccccaggaccccactctggggctactcctcttcaccacagccccagacagtggctgcgaccacagtgcccagcaatacctcatgggcacccaccaccacctccctggggcctgcaaaggacaagccaggccttcgcagagcagcccaggggggtggttctaccttcaccagccaaggagggacaccagatgccacagcagcctcaggtgcccctgtcagtccacaagctgccccagtgccttctcagcgcccccaccacggtgacccacaggatggccccagccatagtgactcttggcttactgttacccctggcaccagcagacctctgtctaccagctctggggtcttcacggctgccacggggcccaccccagctgccttcgataccagtgtctcagccccttcccaggggattcctcagggagcatccacaaccccacaagctccaacccatccctccagggtctcagaaagcactatttctggagccaaggaggagactgtggccaccctcaccatgaccgaccgggtgcccagtcctctctccacagtggtatccacagccacaggcaatttcctcaaccgcctggtccccgccgggacctggaagcctgggacagcagggaacatctcccatgtggccgagggggacaaaccgcagcacagagccaccatctgcctgagcaagatggatatcgcctgggtgatcctggccatcagcgtgcccatctcctcctgctctgtcctgctgacggtgtgctgcatgaagaggaagaagaagaccgccaacccggagaacaacctgagctactggaacaacaccatcaccatggactacttcaacaggcatgctgtggagctgcccagggagatccagtcccttgaaacctctgaggaccagctctcagagccccgctccccagccaatggcgactatagagacactgggatggtccttgttaaccccttctgtcaagaaacactgtttgtgggaaacgatcaagtatctgagatctaactacagcaggcatcactttgccattccgtatttttcgtctctaaattataaatatacaaatatatatattataaatataacctttgtgtaaccctgacttaatgagaaacattttcagctttttttcctatgaattgtcaacatcttttttacaagtgtggtttaaaaaaaaaaaaactttacagaatgatctgtggctttataaaataaaggtatttctaagcaaagcagttgcattgattgcttctcttaataactattcttgagcacctggggatcccaggaaccctggtcaggtgaggtaagagactgacctcctgtagaagctgaatgttacagtggtcaagcgcacgattctttgagtgattcttaaagctctggttcctcttgatttggtgtgaccccatttcctcccttctcatacgcacacctgtaaagggaactggaccgcctcaggggaagacggcagactcatgcacagagaaggaaaagggaacatctcatcacctccgaggatgagtaccctggagccttatgacggcaccattggatgtcatgtttaattccatccaagttgtggatggcaggcaggagcatggagccctcaggaatccatggaggacatcaaggcatcccaaggccatattcccctaacattacttccactgctaacaacaggactgcctttccctggtgggaaaatgctccctttatgcccattcctgtatcccctccaacacccacatctgcattaaacacccgtgcctttctcttggagagggtttagatgcagatcccggccctggagctttaaaatgcttgcccttccttcttcaaggatcaaatgtttattggggttcagctttgttttctcaaaaggccatggtatcgtgcccctgaggaacatgtttatctaagaagctttgaggtagtagagcgataatttttgaaaccttcctcctgcaatctttaaaaaagaaaaaaaagattgcccaaacaaatcatttgggagaagacatcattatactcctacttggcactgcaaacctgctcgcagcaccagccggtggacttgccatccagctctcagcttccactgctccccttgttcccggccggctggctgcctccccgtgctgtgtccagcacggccaacaacgtcagaccctcagagacgcccaaggggcttccagaggtggccgcttctctattttttcctgattgtggctgagagagatgattactgctttgacacttcctttctctaaaagaaaaatagtttgatagtatattttgaatatagatgctcttatagtcagattgggaattgaacttgaatattgggtcatatgtttgtgttgttgctgtagtctatcatgacttttttctttctgcattttccttaaaaaaaaaaaaaagatggccttcaaaagtgtgttctcaatgttgtatgaacctccttcacatgagttcggttgttgtctctcttcaaagactcttcaacccacaaagaagcaactaaatgtttctctaagtttaattttctagcgtgttgttgtcttacctttttaaccttaccataatatttctgttaactgttacatttaatataccaatgtgtgtaagtatacagagaaaaatctgtttgtaaagtaaaatttatatataatatatgtaatcaaagatacatatgttatatatacatatgtggatgtatgacttatttttccttatccacagatttcagctaccatgtatatataaataaacttattttattagccagag

SEQ ID NO: 26546 - DNA, 414 bp, Homo sapiens
agagctaggcaagcagaagagaaaggacaccagcccagacttacaggaaccctgtgactgattcacagaggcatttttttgtgtgtttattttaattttgttcttattcaagtaacattagaataaaaaataatccaactataaaaaaataaaataaataaataaaagtggcagagaacttggccaaattgtgttccagtgttttgtggaaattagaccttttgatgatatttagctgaggggatttctaaacaaagaattaaaggtacagccagttttcttcttgctactgtgataaaatgaaaggagacagataaatggaagaagaaacaactaagcaactaaaaaaaagtaacacttaatgatttggaagattctcagcctatccagatagcatgctctggacacagtgac

SEQ ID NO: 26547 - DNA, 444 bp, Homo sapiens
ctcatcacctgtggatacctgtcacatcaccgcagtcattccatatgacaacccccatgttcctctcacttctaatttttaaaagtcagtctcaaatctttaactcacagctgcaaactgtactcttaaaatatttgtgaaattgtgcagatgttatttccatctgtccttttgagaactactgatagtgtgatttgggaatatttccaattctggctgaggcagggcagggcgagggccaaacgctagggctggactgggcatagtttacatcagccacaggtgtcaccccgccggtgtcagagggtttgcttccctgaaatagtaactgtttatatcactctgcacttgtaataacatcctgccaaagggccccactttcccacaacttttacactacgcagagatctgacgtcagcgtgtgctgtgagcaaaacatcttcg

SEQ ID NO: 26548 - DNA, 1499 bp, Homo sapiens
catatttgacttggatcatttccctgactgggctaatgtgacacatattgagacttaggaagagccacaagaccacacacacagcccttaccctcctcaggactaccgaaccttctggcacaccttgtacagagttttggggttcacaccccaaaatgacccaacgatgtccacacaccaccaaaacccagccaatgggccacctcttcctccaagcccagatgcagagatggtcatgggcagctggagggtaggctcagaaatgaagggaacccctcagtgggctgctggacccatctttcccaagccttgccattatctctgtgagggaggccaggtagccgagggatcaggatgcaggctgctgtacccgctctgcctcaagcatcccccacacagggctctggttttcactcgcttcgtcctagatagtttaaatgggaatcagatcccctggttgagagctaagacaaccacctaccagtgcccatgtcccttccagctcaccttgagcagcctcagatcatctctgtcactctggaagggacaccccagccagggacggaatgcctggtcttgagcaacctcccactgctggagtgcgagtgggaatcagagcctcctgaagcctctgggaactcctcctgtggccaccaccaaaggatgaggaatctgagttgccaacttcaggacgacacctggcttgccacccacagtgcaccacaggccaacctactcccttcatcacttggttctgttttaatcgactggccccctgtcccacctctccagtgagcctccttcaactccttggtcccctgttgtctgggtcaacatttgccgagacgccttggctggcaccctctggggtcccccttttcttcccaggcaggtcatcttttctgggagatgcttcccctgccatccccaaatagctaggatcacactccaagtatgggcagtgatggcgctctgggggccacagtgggctatctaggtcctccctcacctgaggcccagagtggacacagctgttaatttccactggctatgccacttcagagtctttcatgccagcgtttgagctcctctgggatcgttgagattgagcagcgcttggtgatctctcagcaaacaacccctgcccgtgggccaatctacttgaagttactcggacaaagaccccaaagtggggcaacaactccagagaggctgtgggaatcttcagaagcccccctgtaagagacagacatgagagacaagcatcttctttcccccgcaagtccattttatttccttcttgtgctgctctggaagagaggcagtagcaaagagatgagctcctggatggcattttccagggcaggagaaagtatgagagcctcaggaaaccccatcaaggaccgagtatgtgtctggttccttgggtgggacgattcctgaccacactgtccagctcttgctctcattaaatgctctgtctcccgcggaaagctcca

SEQ ID NO: 26549 - DNA, 1554 bp, Homo sapiens
catatttgacttggatcatttccctgactgggctaatgtgacacatattgagacttaggaagagccacaagaccacacacacagcccttaccctcctcaggactaccgaaccttctggcacaccttgtacagagttttggggttcacaccccaaaatgacccaacgatgtccacacaccaccaaaacccagccaatgggccacctcttcctccaagcccagatgcagagatggtcatgggcagctggagggtaggctcagaaatgaagggaacccctcagtgggctgctggacccatctttcccaagccttgccattatctctgtgagggaggccaggtagccgagggatcaggatgcaggctgctgtacccgctctgcctcaagcatcccccacacagggctctggttttcactcgcttcgtcctagatagtttaaatgggaatcagatcccctggttgagagctaagacaaccacctaccagtgcccatgtcccttccagctcaccttgagcagcctcagatcatctctgtcactctggaagggacaccccagccagggacggaatgcctggtcttgagcaacctcccactgctggagtgcgagtgggaatcagagcctcctgaagcctctgggaactcctcctgtggccaccaccaaaggatgaggaatctgagttgccaacttcaggacgacacctggcttgccacccacagtgcaccacaggccaacctactcccttcatcacttggttctgttttaatcgactggccccctgtcccacctctccagtgagcctccttcaactccttggtcccctgttgtctgggtcaacatttgccgagacgccttggctggcaccctctggggtcccccttttcttcccaggcaggtcatcttttctgggagatgcttcccctgccatccccaaatagctaggatcacactccaagtatgggcagtgatggcgctctgggggccacagtgggctatctaggtcctccctcacctgaggcccagagtggacacagctgttaatttccactggctatgccacttcagagtctttcatgccagcgtttgagctcctctgggtaaaatcttccctttgttgactggccttcacagccatggctggtgacaacagaggatcgttgagattgagcagcgcttggtgatctctcagcaaacaacccctgcccgtgggccaatctacttgaagttactcggacaaagaccccaaagtggggcaacaactccagagaggctgtgggaatcttcagaagcccccctgtaagagacagacatgagagacaagcatcttctttcccccgcaagtccattttatttccttcttgtgctgctctggaagagaggcagtagcaaagagatgagctcctggatggcattttccagggcaggagaaagtatgagagcctcaggaaaccccatcaaggaccgagtatgtgtctggttccttgggtgggacgattcctgaccacactgtccagctcttgctctcattaaatgctctgtctcccgcggaaagctcca

SEQ ID NO: 26550 - DNA, 120 bp, Homo sapiens
aaacctcaagttaggatagcctcatagaaaggctgatgtagagagtctggcaaaactgtctctcccagaaccaggttctgtatcctctctgagtggtgccaggtattgcctgcagccctg

SEQ ID NO: 26551 - DNA, 438 bp, Homo sapiens
ttttttgagacagagtttcgctcatgttgcccaggctggagtacaactgcgcaatcgcgactcactgcaacctccgcctcccggattcaagcggttctcctgcctcagcctgccgagtagctggggctaccggtatgcgccactacgcctggctaattttttagtatttttaatagagacggggtttcgccatgttggccaggctggtctagaacgcctgacctcaggtgatccacccgcctcggcctcccaaaatgccaggattacaggcgtgagccaccactcctggccacattacttgtacttctatttggcatttaggttgttatacatttaggctactagaatgtgcttttaggatcaaccacccctagttccttgcagatttcaagaaggtacttctcgcctggtgttccccatccctggggccagtagtgg

SEQ ID NO: 26552 - DNA, 642 bp, Homo sapiens
gtctgaatccccgcatttcgccaatttgcttggagcgcagaacgccctccgcgaaaggcggctgctgatcccgactttgctccggtatcgcgcagcttgttggcctccgggtcccccgtgccatgcccccgggaggctctccacagacaccgcttgcgccgaattatacgagactgaatgggtttttttggtgtgtgtgtgcaacacaacaatttgtcagctgctgttcacaatgcgctccgccgggcggtggaaacttggctgcggtaacgcacagcaggttggagggcacgacccggaaggaaggaagaggcgaggagggaaaggcggcgaccctaggcccgctggccagccgtttccagcatcaattcagcactgagccggccgcagcagcacagggctgggggctcccggagctgcgtgccagccggggtttcggccagagccgcggaggctgcccggtggtaggtgcgactcttcacctctccggggagcggcggccgacgacccaacccacccgcagcgctgccgtcggcccggctggtcccccgcgcgggcacaaaaacaggcggcagttcgccagctctcttttcccaaacctgaaccgccaagccgaaggttcttccaaagtcgcggttcccc

SEQ ID NO: 26553 - DNA, 501 bp, Homo sapiens
ccttgccacaagtcccaggactaacacaagcaaaagactagatttaaacttgagtctttttgatgctattgcccatgagaatcactcaatttaattatacctgagtggttcactttggttcctttttcccatattatctcctcctccttcatcttttatgcatcctagagacttcttagatcctttgacaaaatgcccaggttgatcaacattgaatatgagtttttccctgaagtgtgaacagatttgtcaatccttttgtaagagaaagtttctggaaagtagttgtgaaagtggagataactttttttctttacagtttcttgctttttataaggagggtacattctaaggcaaggattctttgcttggtaagctggttattggatgtgagacaatgattaacacagcacatgtatacatatgtaacaaaccgcacgttgtgcacatgtaccctagaacttaaataaataaataaataaataaataaataaaaagaaa

SEQ ID NO: 26554 - DNA, 216 bp, Homo sapiens
tacaagcagtgatatgtacagatcttaagtgcacaattaaatgagtttagacaaatgcatatgctcatataataccatctcaattaagatacagaccactgggctgggcacagtggctcatgcctgtaatcccagcacattggggaggccaaggtgggaggatcgcttgagctcaggagtttgagaccagcctgggtaacacggagaaaccatgtc

SEQ ID NO: 26555 - DNA, 302 bp, Homo sapiens
ccttgggtattccattatagcaacagaaaatggactaaaacaagattaacttctattttgaatcatacattattgaactatgtatagatccaggacaaaccttgctccccgatattttcatccaatatacagactttatgcactgcatgggatgctcctctcttcgggattctaaccaacttcttacattttaaactctcagctcaaatgctgcactctctgtgacactgcacttgacacccctaaggcaaacttaggtgcctcttctctctctactgcacttggcatacacatcattacag

SEQ ID NO: 26556 - DNA, 1280 bp, Homo sapiens
  misc_feature (930)..(931): n is a, c, g, or t
aggggaggaagagaggacgagaggccctaagaatcagcaaccataaatcaagaaaagctctctcagccatctgacgtggctagaagctgtattgcagctttgagtgggatttgaaaaagtgaaaacagttcattcaatcaagaaagttgtttttgaaatttgataactacaggggcatggtacttgtaccgtgtcacccagtattgctagtcctggtccattttcagctcatacctgccttctagattgaaattgaggctgtgactttattttcagatcctcaaattgctcatctaagaaacatacacgttataaactgggaacagtggctcacgcctgtaatcccagcactttgggaggccaaggcgggtagatcatttgaggtcggaggttgggaccagcctggccaacatggtgaaactctatctctctgaaaatacaaaaattagctgggcatggtggcatgtgcctgtaatccgagctactcaggaggctgagataggagaatcgcttgaaccctggaggaggaggttgcagtgagccaagatggcgctactactctccaacctgggcagtagagtgagactctgtctcaaaaagaaaaaaagaaatatacaccttataaatgattgcttgtttttaaagcacaccaacttagattttcatagagaaaagtataattccatgaagtccttgccttccagagggagaatacattgtttaaaactgtatccaggcccagaaccatggctcaggactgtatttccagcactttgggaggccaaggcaggtggatcacctgagatcaggagttcgagaccagcctggccaacatggtgaacccgttttataaaatccaaagtggccaggcattgtggtgccacctgagtccaggtcttagagctgggcagaaaatgttgaccctggaanntagttgagaccaaatcaccactgcttcaactggtacaaacagatgtttgggaaaaaataaaaaaaatttgccaatcccttaaggggcgttcacaacctgcgggttaaaaggggctggaacctcgttccactatggcttggaaaaccttttcaggggataaacaaggccccgttctttccaagggggcccttgtgggggaatagggccaattttaaaacgggaattttaaacctttttttaccagcctgggatactttattaaacccccttggtggttccttcgaccctttcgctcccttctgatacctactctcttactgtggtgcgccttccttctctctgtggcgcc

SEQ ID NO: 26557 - DNA, 131 bp, Homo sapiens
ctaccatgtgggttagtttaggagtaaagctggcaacatgtgaaagtttagccctggaccctgtgactgagaggcatatcaactaactctgaattcacaccaagaataccaccttaaagcctgttatatga

SEQ ID NO: 26558 - DNA, 370 bp, Homo sapiens
tcgctagtgtgagtaatgcttctctgaacatcagtgcacaaatatttgttcaaatttctttcaattctatggggagtatgtccagaagtggaattgctggatcaaacggtaatttattgtttaattttttgagaaacagcacaccaatttttacagtggctataacatttcccattcccatcagcaatgcactagagctccaatttttccatctgcttgaaaacacctgttgttttgtgttgctgtcattgttgttgtttatcaaagccatcctaaagtgtgtgaggtggtgtaacattgtggttttgatttgcacatctctaagtattcatgatgctgaggaactttgcatgggcttactggatatttg

SEQ ID NO: 26559 - DNA, 367 bp, Homo sapiens
cataatttattgaataattcatcctttccacactgatttatagtggaatcttaattatataataatttttcatatagatatatctgttctgggctctttattctgttctagtgatcatttttgtatctctgtataatcaatatcatgatgtcttaattactctggctttattatgagttttctataagtcatagaaatgttgtacttgttctagcagctaacatttccttaattaaatacaacagtaatattcattactttttggaaccattgaccttctttcactttatatgtaaaaaattaatatgttaacattgcagttttatagagaaaaatcaaattatgaattaaattacttctaaacgta

SEQ ID NO: 26560 - DNA, 382 bp, Homo sapiens
tcttctgtcattagacattattcattcttctattttattcattgttgtaacactgcaatcataattattaaacttaaggatgtggaacaattggaaccttcatacatttctggtgagaatgtaaaatcatgcagctgctgtggaaaagtttggtggttcctcaaaaagttaaacatagaattaccacatgacccagcaattccactcctgggtgtatacctatattagtctgcttgggttaccataacaaaatacctcagactggctggctcaaacaatgggaatttttctctcacaattctggaggctggaagtccaagatagaggtgcgagaagggatggtttctggtgaggcctctccccctggcttgcagatggctgc

SEQ ID NO: 26561 - DNA, 296 bp, Homo sapiens
agtgcaaaaattggtacgggggaaacctaattttacaaaaatagaggaaataaaacagacaaattttctgtatccatggcatggagaatcatgcatgcattagaaatgctatttttaaaaagaggctttagtgggaaaactttaaaaactaaaaaataaatttagtaaagttgcagaatacaaaataaacatccaaaaataagtaggatttataaatgacaatagcaaacttcctgaaaaaacaaatcagaaacgcagttgcatttataatagctaccaaaaaaaaaaaatagatg

SEQ ID NO: 26562 - DNA, 404 bp, Homo sapiens
gtttctcagcatctcatctgtttgtatgtctcctggaagccttgcaaccctgaccctactgatagagcccagctgttgtctcttacctgttcatgacacccaccttccttgttaactgtctgatgataggctcaacggagactgaggtgtttgtaacaagggtgatagcaaacatggagcatggtactattgtggtgactttgtactgactcatcatcatcaataaaataacttacttcgtgaggaactctgcacatatttcctaacatctagttctgttctaggggttatcttaaacttgggaccaactttctaattttttatctctcagggtgaaatgcatccctttcttctttatcccatgcataggtaaacattacccatagtcatgttctagcttttag

SEQ ID NO: 26563 - DNA, 410 bp, Homo sapiens
cattactggagtgcctaagggaaattaccaaagaggctgaaggatagatagctccaagtcattggtggccttttatgacacattatggaattggaattttatcttacaaataatgggaaaattttaagcaaactagtgaaatttaagattatatattagaatgggttaaatgctgagttcagtgaactcagcgtgggcttcagattccacaaaccctatgaaattttgtttcagagagcacatttgaggctttcattagattctcagaagtctttctctctctccccctcccaccctcacacacacacacacacacacacacacacacacaggtgtgcatgcacatgcatgcccaaaagttaagaataccttcttaaaagtaaaaaattaaaaacaaagataaaaaaaaa

SEQ ID NO: 26564 - DNA, 273 bp, Homo sapiens
  misc_feature (145)..(145): n is a, c, g, or t
tgcgcagaattacatcaaaaatggccgcatgcttggcggttagaatgtatgagttgtaagcatctaagcagaacagtgccaaggattctttttcttttgagacagggtctcgctctgtcaaccagaatggaatgcagtagcgcantccccctcccaccctcacacacacacacacacacacacacacacacacaggtgtgcatgcacatgcatgcccaaaagttaagaataccttcttaaaagtaaaaaattaaaaacaaagataaaaaaaaa

SEQ ID NO: 26565 - DNA, 365 bp, Homo sapiens
gaagacttgtgtggctggagagaggccggctgggagcagtggagtgcaatgatgtggaaggggcccccaggacctgcgttgggttttgctctaagcactgagcccttatctgaatggggtgaaccctcaggctctcaggaacactgtctccacctgcttgtctatttctcctcaaaaattagagggcttatctgacagggccacaaggacagaacaaatttcttgaaaattagtaagaatagctttcattattaaaaataaactctagaactggcatggtggctcatgcctgtaatcctcggcactttgggaggccaaggcaggcagatcatgaggtcaggagttcaagaccagcctggccaata

SEQ ID NO: 26566 - DNA, 567 bp, Homo sapiens
cagcgtacctcagttggaaatgcagaaatcacctgtcttctgcatcaatcactctgggagctgcagactggagctgttactatttggccgtcttgggataaggttatatattgatcagttgatgaaaatgtaaccacctattcctgtatttcccctagaagtaatggttcagtatttgctaatttggtattctcagcaacttaattagaccatgactaccttggacaacatgaatcaattgtacttcctttggaaattagtgttttgtttgaaaattctttggagtctaattttagatcttttgtaaattatctgaactttcactatggctcttttaaagttgttattgtcttcggtagtcagaggcttactgtaatatatctagtgtagatttattttctgcttgggcattttttatgcttcccgaattaaaatattaaagggttactttcatcagttatgcgaagagtctcatgcatcatctccttgaatataacctttacatattttgtattacagtttgtattacaatctgtttgtatgcaatctgtattacagtctgctatt

SEQ ID NO: 26567 - DNA, 843 bp, Homo sapiens
ttcattcaggttaaaaaaaatatacatatgtctacatgaaattctggtattccctgttgaaaaccagtcttaagttagaggcattctgcagttgtacggaaagtaagggaaacaaagttaaaatggaaaaaattgaattaagaggcagaagtaatgaatttgatcatttgttcattgccactcattgtagacacttatttttgatctctgtaaacatcagcttatatctcaaagtatgaggtctgaatacttgcttgtgggtgatcatctttgtgtagaatagaaaagacaaagtaggaccaggtgcagtagctcacacctgtaataccggcacttcgagaggccaaggtggtagaattgcttgagcccaggaattcaagaccagcctggacaacatggtgagaccctgtctctactgaaaaaaaaaaaaaaaaaaaaaagaaaaaagaaaatattagctggacatggtggcatgagcctgtaggcccagcatacttgggacattgaagtgtgaggatcacttgagcctgggaggttgaggctgcaatgagcaatgattgtgccaccgcactccaatctggacaacagagtgagacaagaagagagagagagagagacagatagagcgagtgtcttgttgagttcttcagtgttgggtcaaagaagggaaaaaaattgtgcgtataaatagaaaaaaagaaaactaactttttaaggctttaaaaataactgaaagtgaagaccctgagatatgaaaagtgatttttgttaatcagaaaattggtgatttaggtgataatggggtggaagttggaagataggacgtgaggggacagggtattt

SEQ ID NO: 26568 - DNA, 664 bp, Homo sapiens
tacaggcatgcgccaccacgcctggctaattttgtgtttttagtagagacggggtttctccatgttggtcaggctggtctccaactcccgacctcaggtgatctgcccgccttggcctcccaaagtgcagtagctcacacctgtaataccggcacttcgagaggccaaggtggtagaattgcttgagcccaggaattcaagaccagcctggacaacatggtgagaccctgtctctactgaaaaaaaaaaaaaaaaaaaaaagaaaaaagaaaatattagctggacatggtggcatgagcctgtaggcccagcatacttgggacattgaagtgtgaggatcacttgagcctgggaggttgaggctgcaatgagcaatgattgtgccaccgcactccaatctggacaacagagtgagacaagaagagagagagagagagacagatagagcgagtgtcttgttgagttcttcagtgttgggtcaaagaagggaaaaaaattgtgcgtataaatagaaaaaaagaaaactaactttttaaggctttaaaaataactgaaagtgaagaccctgagatatgaaaagtgatttttgttaatcagaaaattggtgatttaggtgataatggggtggaagttggaagataggacgtgaggggacagggtattt

SEQ ID NO: 26569 - DNA, 279 bp, Homo sapiens
aacccacttcccacctcacccccctttcccaattgaccctcaatagtcaaagtgaatggaggctggcaggcaccttggacacaggttctatcccagtctttactctttccaacactccttcagacacctctttctcacttctcctaaatcatatcctcctcccttctagggggagcctgatggctcaccttagtcacagacaggagctgacacctaaccatcgaagcagctctgtggtggaggtgatgcccacaccatggacggaagcagctccacggg

SEQ ID NO: 26570 - DNA, 158 bp, Homo sapiens
ggctggctgggggcaggactacaatcccagaaggaggcagtcatatggtagggctagccaggggtgtccagtcttttggcttccctgggccacattggaagaagaagcattgtctgggccacacctaaaatacactaacacaatagttgatgaactta

SEQ ID NO: 26571 - DNA, 222 bp, Homo sapiens
ctgcccttttccacctgacaggtgcagagaaagtggtcaaggccagtggctgtgaaatggcaaagggccactggttggccaccgagtacataaggggtgggtcccggccaccaacagccctatgggtgtccaagcagccaccaaggtgattccagcccagctcccaggggcaggagatcccgtttttaaaagctcctcataaatgagttagttccgcaagag

SEQ ID NO: 26572 - DNA, 188 bp, Homo sapiens
cctcacaagcatgtcatgaatggtctggagtaaatcataagcggatttatggaaaaaaaagcttttagataatcaagttgtctataattaaagggaaattatttttaatggtctttctaggaattgggttttggtattttctaaaaaccatttatatactgaagaatcttagcactttgggaggccaa

SEQ ID NO: 26573 - DNA, 525 bp, Homo sapiens
taaacaaccagatctcaggagaactcactctcacgaagacagtaccaagccatgaggggtgtgtccccatgatccagccccacctccagcattgggcattacaatacaacatgagatttgggttgggacaaatatccaaactatcagtcggtctgtttgtctctttttctcctctgagctgttgacagtttgctctctctcctgcatctttctgtttttagaaataaatagccagccgggcgcagtgtggctcacgcctgtaatcccagcactttgggaggctgaggcaggcggatcacaaggtcaggagatcgagaccatcctggctaacatggtgaaaccctgtctctactaaaaattcaaaaacactagccgggcatggtggtgggcacctgtagtcccagttacttgggaggctgaggcaggagaatggcgtgaacccgggaggcggagcttgtagtgagccgagatcccgccattgcactccagcctgggcgacagagcgagactccgtctaaaaaaaaa

SEQ ID NO: 26574 - DNA, 218 bp, Homo sapiens
taacaggtacaaaacctaacctggtaaatatagggtgcagcccagaaagcaggcctgaatatgatctctttctaaaagtgttctgggcacttgagaatgcctatggcattctcccacactcaccaatcaagtaactcagttctttatgggtagctgagggtatgtacagaagggccaggattgtctcttttgagagttattcctcatggaagcatgag

SEQ ID NO: 26575 - DNA, 538 bp, Homo sapiens
gaacagaaagctcatagcagtccttggccatagcaattctgacatgcagccaattaccccactactccagggaaatgggatgtttcttgattaaggcctgattctgctccccaggagtgggttccctagtccattgttctctttagttccagggtcttttaccttccctctaagagggctttcctttttcataagaaatgatctgtatctgcagctgagtggatttctttgcatgtttctgcccatagaaatttggggcccttttcattttgtatttttttcagtctcttttagactaagctgaaggactgtcttaaagactttgtgagtttacttagaatctagctgtcatttactcaagccccagaagttatgcctatatattttattttgagacaggctcctctcttctttgggctgcaagtgaacctgccatcagaaaactcttaaatagtttttaaggcttttttttttttttgtagctgaaagtgtccactaggctctgcctaaaatctttcagagatttttgctaaaaaaa

SEQ ID NO: 26576 - DNA, 419 bp, Homo sapiens
ataagcgtgatactttgaattttcctttgaaatcagctggaatatgttactggaaccctcattaattaatggatcaaatgcagtttttgacgtgttcattttatatctgtatgaaagttgtgatttaaaatttgtttagctgtgcacggtggctcgcgcctgtaatcccagcactttgggaggccaaggcaggcagatcacgaggtcaggagttccagaccatcctggccaacatggtgggaccccgtttctactaaaaatacaaaaattagctgggtgtggtggcatgcacctgcaatcccagctactcgggaggctgaggcaggagaattgcttgaacctgggaggcggaggttgcagtgagccaagatcacgccactgcactccagcctgggtgacagagccagagtccgtctcaa

SEQ ID NO: 26577 - DNA, 401 bp, Homo sapiens
gctcctgaggccacggaagccatccagtggaagctgcatgtgaggcagaatgctcagtcaacagcactggacagaaacaagctgggggctacacagcccatcagtttggagaccttgcgaacgtcccgaagtgggacgctcccttgtccttctctcaggcctcccgcttctccagctgcccgtcccagtaggggcagtcagggcgggtgacccggtggaaaataaacctagcagcatgtccgtgacgcttcaggtttgtgggaatgggtgcagcgttcaagacactctcacgcgtatcccttcgtttgatcctcacagcgcctcagtgagacggcagagcacacattagcccccaaagaaactgctactcacaaaagccaagtgtgaacctcaggtcagac

SEQ ID NO: 26578 - DNA, 303 bp, Homo sapiens
ctccaggatggtccccacgcccaaagggaatgaagccacccacagtgtcccaggcagaggtgtcccacctctcctatctgttaactctgccctggacacggtagggacacagccacgtttgtgtcaacaccagcacagtactgaacacaccatacagaaggaagtcactggaacgtgctggatatatgaacacatgcacagatgaactgaggaatcaataaataagtggatgaattttaaagtttttaccaaatgcctaaattcaacactgggctctctcttcccttgttgctctgtctcaag

SEQ ID NO: 26579 - DNA, 409 bp, Homo sapiens
gtaactaacacctatttacatagcatttatattgtattagatataagtaatctagagattatttaaagtatatggaaggatgtgcataggttatatacaaatattgtgccattttatatcagggacttgagcatccttggattttgttaaccataggaggacctggaaccaaacccccatggatactaagggatgacagtaattatatgaagaatgagttaataaataatgagctctgtgatactgtctcttactgctgcattatttaaagacaaatattgctgagggctttcataaccaaggaaacctctatccaaaaggcacaacttaacccttggcctcagaagatcagttcagtttagatagcgaaaaggaaggttttgaaagagaatttaaagaggcttttttt

SEQ ID NO: 26580 - DNA, 431 bp, Homo sapiens
acaccaaaaacacagtgaactgaactggagtttgaaagtgaactgacttaaaatttgaaaatatttttcacaggatagcagagttggaagaggccattggagtcatccagtgcatacgcacggccaaccatgtggagtttacgctttgccttttctagtgctcactgggcatctattttcaaggtggaacccgtagccaatggtccctaaaattattaatgtgtttataaattattgtgcctgtaaaattatgtccattgccattggtagctgacaggctttataaagtgtgaatgagtgaatgattggctatttcttatcagattgaattccttttaggatagttcatatttggcataacttccaaggaggattttcccattattacatatcacctgatcatagctgttgttttggatcagtgtgtattg

SEQ ID NO: 26581 - DNA, 441 bp, Homo sapiens
tgtgggtgcagcctgaggacaaaggcagtgctgcatcccctgatcccctgccccctacaacctcctgcccagcctcttgggtgctcctcagcttgtcgtcagggaggaagcagccatctcctccgatgactgacttcaagcctcaactctcccacagcttctcaaaagccaaggctgaggccaagtcctagctgctgccttgggacaggtcaagggcctcctgcaatctcatgcacaaactggtacccatgagcatgtggcctaagagatttattgacccctctccaagtccttgccagaggaatcctgcacacctatatccacaatgaagggagccatatccccagctgggtagccatatccctaatgatatcacttatgaaaggtgacaagtcctttctaccactcttatttaagtgaaaatatatttagtcaattatg

SEQ ID NO: 26582 - DNA, 373 bp, Homo sapiens
gaagcccttccatcatgattcacttctttgagtagtgtttgctaaattcatacctttgaattaagcacttccttttagggacctctcttcattaatatccactagaaaggagagactcattatgtgtgagtttcaataagtttatccaatccctttgttttcaactgaaaggagggaaacggacaagtgaagaaggtagggcccaggagtgaaggaacaagggtgggaatagtaataatgttgtactttgaaaatctactgggaaaatgatgaacttagactgctgggagaggctaatagaaaatcgggcagtgagcttgatagtaggcaaaggactatcaggccacggggtcaagttaaagcagcacattca

SEQ ID NO: 26583 - DNA, 308 bp, Homo sapiens
tgcccaggtagtcatgtaggtctgtgggccgtgcttccaggctggaccgagacccggtgcatggggtgcttctggtctgagctgaggcccctggaagccacagccaggaggcagcaagggacggctgtcatgtcccctctcccctgtctcccagggtccctgcgggacagatttccctgcctgagcctcctggttgcccataccctggcctcccaaagcccagcctgaagccttaggcaccctacaacctgcttcctctagcagcctgccctgtctcttctctgccgatgttcctgaaactttcctgc

SEQ ID NO: 26584 - DNA, 347 bp, Homo sapiens
atggcttttgttcacagtaagttatatcaattaagttgcttagaatgaacatatagctgaactaataagcatgaaatattttcactgatttataagaatccagaaattatcaatgagttttctttttctattatttaaaaaagtttttgcttggcaaatcttcccctctaggagattaaagtattttttgctcattaatcaatgtaagaacaccttactttacattcattgaactctgaggttatagaactgtgaacttttcgatttgttcggcttggggaatgtcatagttcattctgtgagtggaagttgcctttaaccacatgagaacaaataagggaatatta

SEQ ID NO: 26585 - DNA, 391 bp, Homo sapiens
tcgaccatagacccagtttagtgaactgctgcattctgattttaaccactcaaaacctctttgtgttagatgttttcattgctccccatttcaaaaagagaaactgagctgggcacgatggctcactcctgtaatcccagcactttgggaggctgaagcgggtggatcacctgaggtcaggagttcaagaccagcctggccaacatggtgaaaccccacctctactaaaaatacaaaaaatagctgggtgtggtggtgtgcacttgtaatcccagctacttgggaggctgaggcaggaaaatctcgtgaacccaggaggggcagcttgcagtgagccacgattgtgccactgcactccagcctgggtgacaagagtgagactccatctcaa

SEQ ID NO: 26586 - DNA, 272 bp, Homo sapiens
gctgtgggagcgcccagagccatggagggagagctcggctgtggcggtgctgcaggtctgtgggggagaggacagtccccgcagattcctggggctctgacacatgaagcagtctgtggggccacccctggcgtatgggggaggggacaggctgtgggggtgtccgatgctgtggaggaggagcctacttctgtgggtgccgcaggtgtgtgttacaggagacaggctgtggaggagacagactctgtgggtatgcccggcccgtggggcac

SEQ ID NO: 26587 - DNA, 720 bp, Homo sapiens
tgccgggattacgggtgtgagccactgtgcccagcacccccaaccttttgacaccagggatcagtttcaaaaaagacaatttttcaacgaatgggggtggggttgggggtaggagttagccagatggtctggggatgaaactgttccatgtcagatcatcaggcattagattctcattaggaacatgcaacctagatcccttacgtgcgcagttcacaatagagttcacgctcccatgagaatctgatgccaccgctgatctgacaagagacggagctccggcggtaatgctccctcacctgccactcacctcctgctgcacaacctgattcctaacaagtcacggaccagctggggaccatggacccctgccttggagattcctccactccactgtgggaaggggcaccttctgaaccaacgttttgcatgtgtcttcatcccctgcttgcactccagatctttccttccttcacttaatcacctgttagcatttaccaagtgcttgctctgtcctggacgttatacaatgaggtggccctggaccctggggtcttgctgtgtgtgggcgggggtgatttcccagggatggctctcaaaacagggacgtgaaaatgcatttggagagatcttcaaattccttgaggatttgaaattttcatttttatttcaacaataacttgttcagccaggcgcggtggcccatgcgtggattgccag

SEQ ID NO: 26588 - DNA, 907 bp, Homo sapiens
tgccgggattacgggtgtgagccactgtgcccagcacccccaaccttttgacaccagggatcagtttcaaaaaagacaatttttcaacgaatgggggtggggttgggggtaggagttagccagatggtctggggatgaaactgttccatgtcagatcatcaggcattagattctcattaggaacatgcaacctagatcccttacgtgcgcagttcacaatagagttcacgctcccatgagaatctgatgccaccgctgatctgacaagagacggagctccggcggtaatgctccctcacctgccactcacctcctgctgcacaacctgattcctaacaagtcacggaccagctggggaccatggacccctgccttggagattcctccactccactgtgggaaggggcaccttctgaaccaacgttttgcatgtgtcttcatcccctgcttgcactccagatctttccttccttcacttaatcacctgttagcatttaccaagtgcttgctctgtcctggacgttatacaatgaggtggccctggaccctggggtcttgctgtgtgtgggcgggggtgatttcccagggatggctctcaaaacagggacgtgaaaatgcatttggagagatcttcaaattccttgaggatttgaaattttcatttttatttcaacaataacttgttcagccaggcacggtgctcaggcccgtaatctgagtactttgggagaccaaggtgggtggatcacgaggtcaagagatcaagaccattctggccaacatggtgaaaccccgtctctactaaaagtacaaaaattagctgagcatggtggcgcatgcctttagtcccagctacttgggaggctgaggcaggagaattgcttgaacctgggaggtggaggttgca

SEQ ID NO: 26589 - DNA, 431 bp, Homo sapiens
ccaaatgattaattcacaccacctgaagaggggaggcccaagtaattgggcagttttaaaaaaaaaatttagcagattatctgctaacttagtcctgaattcatatcccttgactcctaggctccttcttaccagcttctaataatggctgtctataaagcaataacctaaactttgtggattaaatatcccagaggtcattaatggctcccttgcattttataagaaatcagatctctaaaatcattcatgaaatataattcactatagatgaaatttctccactttggtacaaagtgtttttggtcctgacactacattttgaagatattaaaaccaaaactaaaagcatggtctacagcttgtattaattatccttgggtagtttatggaagcatttgagttcttaagaaatagttatctcatatgat

SEQ ID NO: 26590 - DNA, 339 bp, Homo sapiens
atataataataataaaacatttgaaatattgtgagaattaccaaaatgtgatacaaagacacaaagaggacaagtgttcttggaaaaatggtgccaataaacttgtatgcggggttgccacaacccttcgatttataaaaaatgtaatatctgggaagtacaataaagggacgtgccataaaataaggcatgcctgtacatctcatttggaaacaagtacactctaaaatccttttagtttccagactaaaatattcctggaaatcaatgtcaaccatctaattacattccagatagttaattctaagacaaaagttccttgggtacacgcattctatt

SEQ ID NO: 26591 - DNA, 840 bp, Homo sapiens
  misc_feature (78)..(78): n is a, c, g, or t
  misc_feature (646)..(646): n is a, c, g, or t
acatggatggatccagcttatatgcagtttggtacttattttcaatgctgctaaaacctgtccaacaatgccagcatngttctcagatcacaccttcaggcactatgcctacctccgagacagtctttctcatcttgttcctgccttgaggttaccaggtagaaaactggtgtcatcagctgtttctcccagcatcatacctcaagaggatccttcccagcagttcctgcagcagagccttgaaagagtgtatagtcttcagcacttggaccctcagggagcccaggagctgctggaattcaccatcagggatctgcaaagacttggagaacttcaatctgaattggcaggagtagctgatttctctgccacctatcttcgctgtcaactacttctcatcaaggccttgcaggaaaagttgtggaatgtagctgcccctttgtatttgaagcagagtgatttggcctcagcagcagcgaaacagattatggaagagacctacaaaatggaattcatgtacagtggtgtggagaataagcaggtggtgattatacatcacatgaggctgcaggccaaagctttgcaacttatagtaacagcacgaactacacgaggacttgaccccttatttgggatgtgtgacaanattttacaggaagtagacttttttcagaggtatttcatcgctgatttgcccacttgcaggaagctttgtggacaaatcctgacttatgccccgagtcatgaatccaaacctgcagaagtggtccaaattttctgaacatgtgcggagagggggttggaatcccgcgcagagagatcacaaggtcgcccacattg

SEQ ID NO: 26592 - DNA, 1222 bp, Homo sapiens
tatttttagtagagatggggtttcaccgtgttagccaggatgatctcgatctcctgacctcatgatccacccgcctcagcctcccaaagtgttgggattacaggcgtgagtcaccgcgcccagctggtattgcttttctattccctttggacatacatgctacagtcccacaatgtagcatttccttggaaactccctttttttttttttttgagatggagtttcgctcttgttgcccaggctggagtacagtggtatgatcttggctcactgcagcctctgcctcctgggttcaagcgattctcctgcctctgcctcccaagtagctgggattacaggcacccaccaccatgcccagctaattttttgtacttttagtagagacaggatttcactatgttggccaggttggtctcaagctcctgacctcagatgatctaccagcctcggccttctgaagtgctgggattcaggtgtgagccactgtgcccagcagggatgcttcatctttctaagaattatcttggctttggactttattcataaatgttttatttctgttagtatgaacaatagactgccttaacaaagtttttttttaaacaaaatcgttcttgttggattttattcagcagcatctatcatgtagataaattcccaggtgtagcattacagcttctgactaatatagctgccattcagacaattaatgttcaaagagttttctaaagtgataaaaccaaagaaaagcatgtggaaaagcagaagcttagaaagttgtggtcactgaatgcactccctggtttttatttgtcagtgaaatctttatgcattcattgttaatattttaattccatggctttgtaggctgtgctgtgtctgaaggggtaacacctagggaaacatgaggccccttatgggaccccccaaatggaacaacttcactttctcttttatgtattgagccctgtgttaacatttcacttaagaagagcaccagtgctttaaaaaaaaaaaaaaaaaaaaaaaaaaggtaaaatattaccattttgatagactgtaaagagttagattcctgttgaagtgttaaggaaatttaactttgtgaaacttttaaaataaagtttataaatgtagctaatctttgaaaaaccaatgcagtaacactgatttgtaaatgttgtggtcaatccctaggtgcattaaagtttcagtcacctgc

SEQ ID NO: 26593 - DNA, 1342 bp, Homo sapiens
tatttttagtagagatggggtttcaccgtgttagccaggatgatctcgatctcctgacctcatgatccacccgcctcagcctcccaaagtgttgggattacaggcgtgagtcaccgcgcccagctggtattgcttttctattccctttggacatacatgctacagtcccacaatgtagcatttccttggaaactccctttttttttttttttgagatggagtttcgctcttgttgcccaggctggagtacagtggtatgatcttggctcactgcagcctctgcctcctgggttcaagcgattctcctgcctctgcctcccaagtagctgggattacaggcacccaccaccatgcccagctaattttttgtacttttagtagagacaggatttcactatgttggccaggttggtctcaagctcctgacctcagatgatctaccagcctcggccttctgaagtgctgggattcaggtgtgagccactgtgcccagcagggatgcttcatctttctaagaattatcttggctttggactttattcataaatgttttatttctgttagtatgaacaatagactgccttaacaaagtttttttttaaacaaaatcgttcttgttggattttattcagcagcatctatcatgtagataaattcccaggtgtagcattacagcttctgactaatatagctgccattcagacaattaatgttcaaagagttttctaaagtgataaaaccaaagaaaagcatgtggaaaagcagaagcttagaaagttgtggtcactgaatgcactccctggtttttatttgtcagtgaaatctttatgcattcattgttaatattttaattccatggctttgtaggctgtgctgtgtctgaaggggtaacacctagggaaacatgaggccccttatgggaccccccaaatggaacaacttcactttctcttttatgtattgagccctgtgttaacatttcacttaagaagagcaccagtgctttaaaaaaaaaaaaaaaaaaaaaaaaaaggtaaaatattaccattttgatagactgtaaagagttagattcctgttgaagtgttaaggaaatttaactttgtgaaacttttaaaataaagtttataaatgtagctaatctttgaaaaaccaatgcagtaacactgatttgtaaatgttgtggtcaatccctaggtgcattaaagtttcagtcacctgccgtgtgtgtgtgtgcccttttatgtttgccttcctagcattcctgtgttcactgtgcatgttcttgaaaatattttcacttgtcagaaaataaactggaaagtcattgaaaacccgtaaa

SEQ ID NO: 26594 - DNA, 1507 bp, Homo sapiens
tatttttagtagagatggggtttcaccgtgttagccaggatgatctcgatctcctgacctcatgatccacccgcctcagcctcccaaagtgttgggattacaggcgtgagtcaccgcgcccagctggtattgcttttctattccctttggacatacatgctacagtcccacaatgtagcatttccttggaaactccctttttttttttttttgagatggagtttcgctcttgttgcccaggctggagtacagtggtatgatcttggctcactgcagcctctgcctcctgggttcaagcgattctcctgcctctgcctcccaagtagctgggattacaggcacccaccaccatgcccagctaattttttgtacttttagtagagacaggatttcactatgttggccaggttggtctcaagctcctgacctcagatgatctaccagcctcggccttctgaagtgctgggattcaggtgtgagccactgtgcccagcagggatgcttcatctttctaagaattatcttggctttggactttattcataaatgttttatttctgttagtatgaacaatagactgccttaacaaagtttttttttaaacaaaatcgttcttgttggattttattcagcagcatctatcatgtagataaattcccaggtgtagcattacagcttctgactaatatagctgccattcagacaattaatgttcaaagagttttctaaagtgataaaaccaaagaaaagcatgtggaaaagcagaagcttagaaagttgtggtcactgaatgcactccctggtttttatttgtcagtgaaatctttatgcattcattgttaatattttaattccatggctttgtaggctgtgctgtgtctgaaggggtaacacctagggaaacatgaggccccttatgggaccccccaaatggaacaacttcactttctcttttatgtattgagccctgtgttaacatttcacttaagaagagcaccagtgctttaaaaaaaaaaaaaaaaaaaaaaaaaaaaaaaaaaaaggggggggccccgcccaaaaattcccccgggggggcccaagtttggggtccccggttttctgtgtgtcacaagggggccccatgatggggaggcccgatattaatatacgcataggcgacctggcgccgggctgtttaaacaacggtctcggagacgtgggaggaacaccctgtgcttaccctggggagaccttgcgtgggaagggacccttatactccggggggggggagccatatattgtgtgcaccaacactttcccctctaagcagagagatttttaaagagcccctaaaggggcaaaaatcatttacacaattttacagcgctgctaattacgcggggttgtaacacaaacggcggcaaataaatatccgctgcgccctgaaaaaatttggggcacaacaggcaaatcatatgactttgagaaacaatttttctcagggacttattactaaaatatcgaa

SEQ ID NO: 26595 - DNA, 462 bp, Homo sapiens
acattaatttatctctgcaccctcagtagtaggtgtcattcccagcctccagtttggaataatatcacatgtgaactttagcttcaattgaggatacttacagcaatttttattctcttcatgcatgccttattggccatctgttttctgggaaaaaatataggtaataagagtgaaaatgaccccatagaaatatgtattggctgccctttctcatatgagaagtcagcaatagacataagtaaaagatgagataagccaggtagttgattctgttaaacgtatctatctagacttagatcaccaaagagaataagtgttccaaaacagccataaattcaaattcatgtgcttccttagagatctgtttatggttctcatatctcctcttatatgtatttgaatgacagaaccattatttaaggcaaggatcgggtgataacatagaggcttccttggttc

SEQ ID NO: 26596 - DNA, 464 bp, Homo sapiens
cattgatttgcctattctggacattacatgtaaatggaatcatacaatatgtgatcttttgtgactagcttctttcagttagcatgatgtattcaaggttcacccatgctgtaccatgtattaatactttattcctttttattgccaaatgatattccatatctattagttgataggcatttgggttatttccactttttggctattatgaataatgttgctatgaacatttgcttacatatttgtgtgggaacatgtgttttcatttttcttggctatatatctaggagtgaggttgctagctcatatggtaactgaatgtttgaggaactaccaaacttttccacagtggccgcacaactattcacaatagcaaagacatggaatcgacctagatgcccatcagtggtggactggataaagaaaatgtggtgtatatacaccatgaaatactacgcagccgt

SEQ ID NO: 26597 - DNA, 373 bp, Homo sapiens
gaattaaaattaagtggatgttcacagttgcccaatatatatgacctgcaaatgatacgaaaaagtgcagcatttagtggcagttaacaagagtgacaagcctggggcagaggtaccaaacctctcccaccagagagctagaagtattttatacagtaactttgatcttatggaagtgaccttcaatgcttattctgaagtaacctatatggtggatacaggatgaacattcagtgccagggagaatcttctcaggttggttctcgttagagtgataaactggctaggggccatagtattggtcctgttaggtttcggtcatggaaaaaaaaattattttggggtcatcctggctctagatgttatgggcaaa

SEQ ID NO: 26598 - DNA, 328 bp, Homo sapiens
gtagagatggggtttcgctatgatgccctggctggtcttgaactcctggcttcaagagatcttcctgtcttggcctcccacagtgctgggattataggcatgaaacaccatacctggcctcactgcaggttttgattagtccccctggctgcatatttgggctcaaaaaaatgcttttcttcatgttactaagtagactgaaatttatctttgtggttacacattatatatcatttgttatttcttaaagtcatgtaggttagtctttcacagtacataccttcgatgtttaccattttgactgaagatataatgctaaagattttat

SEQ ID NO: 26599 - DNA, 183 bp, Homo sapiens
cgtgaggcaaatgaactcatttctttataaattacccagtctcaggtattctgttatagcaacacaaatggactaaaacacagtccctactacctttgataggtatttaaaatgaaaaaaaaaatcccactatacttgtacctttcagtatatagaaattgttcagactagttcaaacaccac

SEQ ID NO: 26600 - DNA, 432 bp, Homo sapiens
cttgctcttcctccccgggctaggcggtgaaccctctctggagccctgcagagtgggactgaggggctgggctctgtttgcattccccctgctccctccacactctgatgagagcttgttttcctccccagacctttggggggcctgtcttgcttgttctgaacccccaccggtccttgcctcttttttcacctgaggtccaggcaagctaccaccccaggaaggccctcagcaccactccacacatctttgccatcgtggcatcagcctatgacctggctcagaatactgggcaggacccatgcatcctcctgtggtgagtggtggccttcctgggtggctgaacccatgggccacactgagggttgatggggcggggcctgaggtcttcactggaagccactggtatgctccactgctgggctacagttc

SEQ ID NO: 26601 - DNA, 253 bp, Homo sapiens
cgatcgagctcggtacgccctccataatgagtgcccatccttagaaggatgggcttgaaccctcctggcaggaaggggcaggctggtgtgtgacagctctgtgctgctgtgcctcaagaagagatttcacctgggccgtatctatacacatctttgccatcgtggcatcagcctatgacctggctcagaatactgggcaggacccatgcatcctcctgtgctcctcccactcaaatgggcacacattatggag

SEQ ID NO: 26602 - DNA, 609 bp, Homo sapiens
tgggactatctttccacatttatgggggtctctccaggctagctgtcacttctgggtggcacatcccacttcctgggttcactggggtggtcctatgtgcccctccctggagaccctaccaaccaacacatccttagctcctcccactgcagtgggcacagtggctcagggaagacggaagccgccaaaaagatcatgcagttcctaagcagcctggagcaggatcagacggggaaccgggagtgtcagccaggagaggggtggtctccaggcctctggcgtctcctggggtcagctgcaggcactgccctttctgatgggactgacgcctccctggacctgcccctagctgggatgcctgctggtgggggctactgctgcctagggatgcttgaacacccctccctgtacaggtggaggatatgctgcctatactcagcagctttggccatgccaagaccatcctcaatgccaatgccagccgcttcggccaggtcttctgcctctacctacagcaaggggtcatcgtgggagcctctgtgtctcattatctacttgagacctccagggtggtgtttcagctgctggcagggctggactccatagagc

SEQ ID NO: 26603 - DNA, 335 bp, Homo sapiens
tagcgggcgcggtgccaaagctgccatccccggctcacagctcctcatatccaccctgccctcatctttatgaattgcgtgtagacccttattgaatccttagaaggatgggcttgaaccctcctggcaggaaggggcaggtaaggggcaacaggtgctacgtccccaggaccgcctttctaattagtacaaagcttccttctgggtcagagccagccctccttgtagcctgcgcattacttgacagctcagcccccattttatggatcaggctctgggaagttgaatgacttgccagggtccctgcagtgggtggcagaactaacccacaacct

SEQ ID NO: 26604 - DNA, 217 bp, Homo sapiens
tctgtttgcattccccctgctccctccacactctgatgagagcttgttttcctccccagacctttggggggcctgtcttgcttgttctgaacccccaccggtccttgcctcttttttcacctgaggtccaggcaagctaccaccccaggaaggccctcagcaccactccgtatgtgactctgccccactgaccctctgctcacctcccaggcagccc

SEQ ID NO: 26605 - DNA, 609 bp, Homo sapiens
cttgctcttcctccccgggctaggcggtgaaccctctctggagccctgcagagtgggactgaggggctgggctctgtttgcattccccctgctccctccacactctgatgagagcttgttttcctccccagacctttggggggcctgtcttgcttgttctgaacccccaccggtccttgcctcttttttcacctgaggtccaggcaagctaccaccccaggaaggccctcagcaccactccacacatctttgccatcgtggcatcagcctatgacctggctcagaatactgggcaggacccatgcatcctcctgtgtgggcacagtggctcagggaagacggaagccgccaaaaagatcatgcagttcctaagcagcctggagcaggatcagacggggaaccgggagtgtcaggtggaggatatgctgcctatactcagcagctttggccatgccaagaccatcctcaatgccaatgccagccgcttcggccaggtcttctgcctctacctacagcaaggggtcatcgtgggagcctctgtgtctcattatctacttgagacctccagggtggtgtttcagctgctggcagggctggactccatagagc

SEQ ID NO: 26606 - DNA, 431 bp, Homo sapiens
gcccctagctgggatgcctgctggtgggggctactgctgcctagggatgcttgaacacccctccctgtacaggtggaggatatgctgcctatactcagcagctttggccatgccaagaccatcctcaatgccaatgccagccgcttcggccaggtcttctgcctctacctacagcagtgagtggcagggttgcagggggcacctacaatcacttacccttcctgggtccttgggctgcttccctggggtccagaccctggtagggcttcttctgcacggggcccctgggtgttctgcatcctgggcactcacacccatcttctgtgcccacagaggggtcatcgtgggagcctctgtgtctcattatctacttgagacctccagggtggtgtttcaggtaaaggcagcccttctatccacccctgcccagt

SEQ ID NO: 26607 - DNA, 1172 bp, Homo sapiens
atatccaactaacgtcttatgtgtatttggatcatataaaataagagatatttcacttactatttctgttttaagctatgaaatacttttaaagatttgtgtgatgtaaaaagactatctttaaagtaataatactcagccaaatatttctgccaaaatccaaaaatttctgggcctaataagggagtcatattagaggatccctttcctgtaactaaagtgtaggctgcgtattaagtggcatagtctagtcataggacctggcttcaaggtcttggccggctcatgatctggttgtaggatttgagttaggttatttgtacccttcatatctgttccttgggtgtcaaattggcacctccgactagaacccccaacacatacaaagtaccttttagctgtaaacttactgtaatttcattatttaattttcattgtttcttgttaatcatcctatcagatgtcttttaaaagagaaatagagcgaaagtaggtgtagaagaggaagactgatgtttggaatgctggctctctgggctattctagttttcacaatatcttccatagttcttaaattctagtaccctggatatgtgttatagatgctattcagctttattaatgctctcaaaataacaagaaaggcagaatacagtgtttctgattcttcattatataggaaaacaggaggtaaatataaataaaatgaaataggtattataatggaaaacagtttttgaaaggagtcctagagcttatactaaagaatcttttcaggacaaaagttaattattgttttagctcttataactgatctaagcaggaggtttgtaatctgggtgaagtaaaaggagcaagagatgtgagcattgagggtgtactgtttctagctcctggaggcagatagctgaggcagcaggaggaggtcacctcaacttcccttttattaggttacttgccttgcaaaaggggtcatttctgcagcttggtgagctcctgggtcctctgaacaccatggacttaactttttgctgtagaaggtagaagggagcttgctctattactgtacattctcttgactttggctagcagaagcaggaagtagagaaagtgtcagatgcttagggctggccttgagtgttagtatagatatataagtaggtatttggaaa

SEQ ID NO: 26608 - DNA, 350 bp, Homo sapiens
agcccctaattggtacttattaggattcaagctccagggtctactatttaaagctctctacaatctaatttcagcctatttctccaatcacttccctcatgccagctgacaaacatttaatcccagccaaactagtttgctcatgtctcatgaacttgtcttgcatttttccgtgtccacatctctgcaaaggcaatgaagtggggcaggaaacatgcactggctgtggcactagacctctgtttaaatcttagctctaactcctattagctataagacctaaagcaagtcactagccctttataagcctcggttgttttcgctggaaaacaaggaataaaaaaaaaaaa

SEQ ID NO: 26609 - DNA, 462 bp, Homo sapiens
atctatagcactctttaaacatcgctttcccttggccactttcttagcctcctcccccgagaaactttattcaaactcatggctttaatgaccataccaccttacaatgatgataccccagggtgtttctcaaacccagttctctccctctgagttctggagagacagatccaattacccagcagtcatatttgggtatttatgggtccctttatttatttatttttgagtcaggatctcactctgttgcccaggttggagtgcagtggtaagataatggttcacagcagcctcaaattcctgagctcaagccatcctcctgcctcagcctcctaagtagctaggactacaggcatgtgccaccatgcccagctgattttcttatttttgtagagacgggggtctctctatgtggtccaggctagtcttgatctcctgggctcaagcaatcatcctacctca

SEQ ID NO: 26610 - DNA, 441 bp, Homo sapiens
ctgttttttcttaccatttcgcattttctatttctttcttttccttattttttgagtcagagtttcactcttgttgcccaggctggagttcaatggcacagtcttggctcactgcaacctctgcctcccgtattcaagcaattctcctgtctcagccttccaagtagctgggattacaggcatgcgctaacatgcctggctaatttttttttttttgtattgttaatagggacagtgtttctccattttggtcaggctggtcttgaactcccgacctcaggtgatccgcccgcttctgcctcccaaaatgctgggattacaggcatgagcgaccgcgcccagccagcactcagcatttatattttacatttgttgaagttgtagatttatacacacattgattgctgctttgttatacacttgcatatacataagatggga

SEQ ID NO: 26611 - DNA, 541 bp, Homo sapiens
ttttcagggccgtctcagtctcataaaaggggatcaggcaggaggagtttgggagaaacctgagaagggcctgatttgcagcatcatgatgggcctctccttggcctctgctgtgctcctggcctccctcctgagtctccaccttggaactgccacacgtgggagtgacatatccaagacctgctgcttccaatacagccacaagccccttccctggacctgggtgcgaagctatgaattcaccagtaacagctgctcccagcgggctgtgatattcactaccaaaagaggcaagaaagtctgtacccatccaaggaaaaaatgggtgcaaaaatacatttctttactgaaaactccgaaacaattgtgactcagctgaattttcatccgaggacgcttggaccccgctcttggctctgcagccctctggggagcctgcggaatcttttctgaaggctacatggacccgctggggaggagagggtgtttcctcccagagttactttaataaaggttgttcatagagttgacttgttcataa

SEQ ID NO: 26612 - DNA, 315 bp, Homo sapiens
gaggcaaagagtctcaatattgacttatccgtgtctctttttcacagattcactaccaaaagaggcaagaaagtctgtacccatccaaggaaaaaatgggtgcaaaaatacatttctttactgaaaactccgaaacaattgtgactcagctgaattttcatccgaggacgcttggaccccgctcttggctctgcagccctctggggagcctgcggaatcttttctgaaggctacatggacccgctggggaggagagggtgtttcctcccagagttactttaataaaggttgttcatagagttgacttgttcataa

SEQ ID NO: 26613 - DNA, 490 bp, Homo sapiens
ttttcagggccgtctcagtctcataaaaggggatcaggcaggaggagtttgggagaaacctgagaagggcctgatttgcagcatcatgatgggcctctccttggcctctgctgtgctcctggcctccctcctgagtttccaatacagccacaagccccttccctggacctgggtgcgaagctatgaattcaccagtaacagctgctcccagcgggctgtgatattcactaccaaaagaggcaagaaagtctgtacccatccaaggaaaaaatgggtgcaaaaatacatttctttactgaaaactccgaaacaattgtgactcagctgaattttcatccgaggacgcttggaccccgctcttggctctgcagccctctggggagcctgcggaatcttttctgaaggctacatggacccgctggggaggagagggtgtttcctcccagagttactttaataaaggttgttcatagagttgacttgttcataa

SEQ ID NO: 26614 - DNA, 422 bp, Homo sapiens
cagccctaaggctgtgtaagacggggcagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaaactcatttttgggggagaaagcaagtgctgggctcctgggtgcccacgcagttgccatcacggcctatgccctgacactgaccaaggc

SEQ ID NO: 26615 - DNA, 266 bp, Homo sapiens
gtagctaatgcagtttgcaaggcattacaatctgtaacctcacatcctgaacttggttggaagaagaggaaggttgttgtctggtgaatgatctgcttgttatctggtaaatattaaaacagctgtggagcagctgaatccagccttggctgttcacaaattttttcttccttctaagatataacatgtgtaaacatctgacctaaggacaaggttctgatcacagggtgcttgtaaatgttttacaactggctttctgggaagga

SEQ ID NO: 26616 - DNA, 814 bp, Homo sapiens
tgtctttaaaaaaaaaaaaaagaagaaagaaatgtattataacattaggagttgtaggcggcaacattacaaccagtatttttctgattacgattttgtatgttacagatattctatattgagcgcattataccaataatcagaaaacattgctgaatcattttgtctttaaagaatcatctaatagggatgggaaggaatacaaaagttgtattaagtaaatgggatgaagctctcagttcagagatcaagatgattggtaagtggaatactatgcagccataaaaaggaacaaaataatatcctttgcaatgtggctggaggttgttatcctaagcgaattaacatagaaacagaaaaccaaataccacatgttctgacttataagtgggagctaaacattgggtactcatgaacataaagatggcagcaatattggggactattagaggggtaagggaaagggggccaaaggttgaaaagctttattgtactatgctcagtgcctcggtgatgggatcatttatgccccatacctcagcttcatgcaatacactcaggtaacaacctgcacataaatcccctgaaattaaaataaaagttgaaattaaaaaacaacaacaacaacaacaacaaaaggtgattggtaaaaattcactgatgcaatgccatttgcaaccttcagtgcaagtctgattttgacagagttcttaccaattattgcagatgtaaagagattacctttttagcttatgccttgatattatgtgttttgctttagatggtttggtggttggttggtttgtgggatagg

SEQ ID NO: 26617 - DNA, 2934 bp, Homo sapiens
cgaatcttcctccgtaataagaagcgacgtgtcccactgtcctggctccgtgggtccagtgagattgggcctgggcgctggagctgctgtggctcccgccgcggcggctgccatggaggccatgccagagcccagaactcacgccgggggaggccgagacagccggcggtactcatagatgaggcagcggcggcggcggcggcggcggcagcccgggctctccatgagcaggcggcggcggcgacgggtgcggcggcaccggcagttttcggtccccagggaggatgaagacactgtttgaagagatcaaagcatcaattaaaaataactataaccaagatcgatcattttgtaggcctgttcttccttgggggggtgtttttactatcaaagctggccgcaaagcagtatcctgtacaccactctatgttgaaataagactgaaaaatacctgcaccatagatggattcttgatgttattatatgtcattcttaatgaaaatgaaaacttccctagggaactctctcttcattttggtagagagtttgtagactgttttctttacttaatggacacctacagttttacaactgtgaagctactttggatttgggacaagatggaaaaacagcaatacaaatctgaagtccataaagcttcattaataattgatttgtttgggaatgagcatgataattttacaaaaaatcttgaaaatctcatgtctaccattcaagagagttactgttccaactggcgatgcccaactcgagtgcaggaggatcagcagcgcacaattaatataaatcctccccaagaaattccacatggaaacttgataagactggctgtgaatgagttattctgttccaagattgaactgtgtgaagagcatgggtgtggtggcttaagagaattttcccaacgaattttctgccatggggcacccccttttgttgtcttaaatatgcaacattggaaatctgaagatctggcgtatgtaccctattacttggatttgtctgatcacaagtatttgttggaaggtgccacattatttaacaaagaggaacatcattattctgcagctttccagattggtggacattggatgcactatgatgggctcagaaatgtgaatttaattttgttaaataaacccccagagtttctcctcttgtcatcattggtttatattcgagcaacagagaaataaatatagattgatgctaaaagttgttttccctcctgcccatgctctcccagatgaagggcttttattttgtgtatacttggtatccaagaaaatagttcaactatactagtttcagaagtgtattttcagtgtttaaccccaggtaaatgttttatatagaggatctgtgcaaaaatgtttgtaatttttttatatttcctgagttatttttatatgagcatattttatgttggaataaaatatatcttgtggcctttgtattttttatttatatgtacctcaaagatttttacaattctgtctttgaattcaagaaatactttgtcatctgaattctaaatttttctttttggatattcgagtaaaacctaggtaaaagtattttaagtttatataatttaacagttcaaaatatatctgactgtatttctttgccctacctcactataatccaaagtgcactatttgatctagtatggatttgaatgtacaatttatcgatggcttagtttattagttcgatttgcctagtatccctgcagcaattttttaaaatgtctgagaaatttttcagagcttaaactatttctttataatggcaaattacttttaactacttcctaaagtattataaacctgccagtggattttaagtgatagctaagcttccaagcttaattcacgttattacaaataaattatataactatcttaaatgtttatcttataattaaatgtaatttgaaatgctctaatgtattttgcagataaaacaactataaacaatattaggcaactggatgtttactagtgtcggactagcaatagaaatgcactttaaatatatatttaaggggaaatgcgtgcctggaaatacttcttttcctagtgaagttttatattgacacagagaaaagaatacttaaaattttgagtgatgtctactggcttccttgtaagtagtgattgatagcatgcggctttgacttgcaatacaaatcattacgattttatagttatcagaacattacgtttctttataaagaccctaaggtcactcttctttttgcaacttaagggaaaaaatattctcaagggaaaatactttttgaaatttatcaccattttagtgtttacatttcaataaatagttcacttcaggtttgggattgagattagttgcaatatatttagaagctcctacatgacagcacagatcactgccatctgctgaactgctaaagtgcttggtgccatgttgagaaaacttacccaagaatggataaatatgggtgaaacattactgagaatgcctcacgttagcaaatactatgaaaattcttgtttatatatcaaactgatttattttacaaaaaaaaaaaattcaccccaagatttatttagtttcccaagtgtatctgattaggatttaatttagagtaaacttttctggggacacctgattgcatgaactgaagtatacaataacacaaatattacagtaaacataaatggtgtcattaacaaaattattcctaatgcagatttattctttcaggaaatgcactttatttggaatactagtttatcatgaaacaatgacttacctacctcacagggttgttgtgaggattaagatgtttgttaaaatcttgactaccttgaacatgctaataaaaaaacatttttctacctcttttatttgcaggcaaggctc

SEQ ID NO: 26618 - DNA, 561 bp, Homo sapiens
tcgacgacggagtctcactctgtcaccaggctggagtgcagtggcacaatctcggctcactgcaacctctgcctcccatgttccagcaattctcctgccccagcatcccgagtagctgggattacaggcgcctaccactacacctggctaatttttgtatttttagtagaggtggggtttcaccatgttggccaggctggtctcaaactcctgacttcaggtgatccacccgcctcagccttctaaagtgctgggattacaggcgtgaccaccgcacctggccttgttttcttctttagctgacagactactgctatagagaaaagatagtttataaaaatagtttgatgaagacacaaagtagagttggggaattaagaacaaagtacaggcaggcacacctgtggtcccagctactttggaagctgaggcaggatgagcacttgagcccagtagttctgggctacagtgcgctatgctgatgggatgtccacactaagagcagcatcaatatgatgacctctcaggagtagggtaccaccaggttgcctaaggaggggt

SEQ ID NO: 26619 - DNA, 827 bp, Homo sapiens
taatgacacttactccaacttggttgcagattagggttttagcagagggaatagagagcaacttaacaacataaagatttgaccaagaagattaaaaactgaaatgttaataatgcctattgataactaccatgctggctcataatcagaactaaatacttggcagttttgcattatcatatcagttggtgccagttcctgtgttagcctttgactcttagcacatatttataacagttgtttaaaagcccactagtaatccaaaggaaggactggtccattcaaaaccacttctttaaagaattccctaacctgataatagaaggataatcattgaagggaactgttgtgggtattgattcaaagaaagctgtacttacaaaatgtccagtgtaattccatgcttatactaaaaaaaaagaccaaaatgactcaatgaataagtacagaagccagacctaagcattttggtttgggttcctgtttctgtgtgctggaagcttccaatgtgcaataatgggctgttcatttggagaatgcaactcatttttccccttgaaataatgtcaaaatagacataggttccaagcaagacctgaagtctgcattggcctgtatttaagtaagcatattcctaaccaccacagtatttcatgagaaatgtgtctgaaggccaccttagcatgataaggacgcatgtcttcctgcctgaccaactccttcagcaccatgatagagagtgcccttgcttggccctctgggccgctgtctaaaggtttctcaattctaaacctcagttggttttcttgactcctgggataaggggt

SEQ ID NO: 26620 - DNA, 425 bp, Homo sapiens
ctcagtttctctgctcatcacacggccttcggcactgtagctttgggtggtgggctgcagattaattttgtaaccaccttaagaaaaatacggaactctaactccttgccactcaagaaatgtcctccctttcagaatatgccttccgcatgtctcgtctcagtgcccggctatttggtgaagtcaccaggcctactaattccaagtctatgaaagtggtgaaactgtttagtgaactgcccttggccaagaagaaggagacttatgattggtatccaaatcaccacacttacgctgaactcatgcagacgctccgatttcttggactctacagagatgagcatcaggatttttgggtgagcaaaaaggcttaaagaaggttcgtgggaaaggggaaaccaaggaaagggggaaggggaaaagag

SEQ ID NO: 26621 - DNA, 333 bp, Homo sapiens
cctctggctctgacagggtggtcataggtttagcagagctcagcccagaagaaataggcaggagccctagccccacaggaagctgggagtgctggcctctatctgcatcctcaccagccctctttctcctgcagctgctcaaggactcagcccctagaccagtgttcccagatgtgtgcgtggccatgtgcaccgcacctgacagacacatagtaggtgctcaatgaatggcagcttctttttttccccatttggagtctagtcaaaacagcagcttctttgagttaccattggatccaattaaagattaaagattcagtcaagtgaaagcct

SEQ ID NO: 26622 - DNA, 2411 bp, Homo sapiens
tgccttataatggtcaaaggtttccagctagcagcagtccaggtgactcaagaaaacggcacaagataaacttctcaaaacgtggtcctccgaatctggccccacaacacatctactgaatgagaattagcgtcttccaagtcttaaagtagtcgtttacggactacagcttgagaagcgcagaattagaactttaagaagttaacgttcttggatcgcagactaaccgagaagagaggattcaaaaatgaagtgattcatccaatcagattttccagtaattcaccaatcacatcgttggactcttcagccaatggttttgttgcgcgggtcttttcaaaatcaacaaggccaattagaatgtttctgagtatatataagggcagtttccactctgccaagtggctgagtttttctttcaggtagtctgagatggcccgcaccaagcagactgcacgcaagtccaccggtggcaaagcgccgcgcaagcagctggccactaaggcggctcggaaaagcgcgccggccaccggcggcgtgaagaaacctcatcgctaccgtcccggcaccgtggctctgcgcgagattcgccgctatcagaagtcgactgagctgctgatccgcaagttgcctttccaacgcctggtgcgagaaatcgctcaggacttcaagacagatctgcgctttcagagttccgcggtgatggccctgcaggaggcctgcgaggcctacttggtggggctctttgaggataccaacctgtgtgccatccatgctaagcgagtgactatcatgcccaaggacattcagctcgctcgccgcattcgtggggagagagcgtagaggtttccgggcagtaattctatccaacttaaaaaggctcttttaagagccgcctactttcacccgaaaatagctgtgattaactaatcaaatctttgaaactaaacattggttttagtacttaagtcctcatttgattggctaaagttaatggtaagcttgctatatttgttcccgtgctttttcccgaaagtgccagattgtcagcgtccttttctaaactggcttttaggggtttggagcttcgatttggtagtggaaggggccacctgggggcgtttatatacattgtctcaagcgttagtcgcgttgtctacttacacccattatagatgggattttttttcgttgtgtatttctggttaatcccttttaaaactttacaggtatgagcattggcagttgagagtaggtagggatatccttggttgctgctttttcgtgtctgaagcagctatttccacaattccccctttttttaaacagttcttggtttttctgtgaaatgatccattttttaattcaatattagaaattggcggcagaaacgaaagccagattggcctctacattactggcagcatgggcattacgtgggaacttgttagaagctcccagggcattacatgggagcttgtttcaatccccatctagggctggagtcaatctgcatatacctcagatgattctcatgaacactgatttaggaagcctaggttgttggttttggtctcatcagtaaaggcatcctgcctgtgaactcttacaaggagtgagcttttgcaaaatgcatgtttatttatgttacagaatgaaatattctatgaaatgttctctaaagcaagtgcacagaacaatcccctaaaatagtttgatttctttacagatcagttttctcaatgtaacattacagtcacatgggaaggctttagaaaaatctttacctggggttcaatgagactaatagcaatctagagtgggcccagggaatggtaattattaaaattcaggtgcttctaacagctggggctgagactccttgctacataaattttaatactcttattagctctggtttgactctaggcttagcagttttctaattgaatcagtttccttgtagtttgccttcagagagaatatactggtctctaaagactttctggcttgcttgactatctttcaacacctggcttttataagaatttcttagggcaacactaatgtaagttttttcttttttgttttgttttgttttttgtttttttgaaccaccgaggtccttttagtgattggaagtatcaggtttttagggatgttacaaggaggaacacataccatcctgggctgcttggcatacaaccaagatatgttttcatatagaacccttcctttacagattagcacaaggccctgtttgggtattcagcagatccttctttatgatctttattaatttagcaacttgtcattttttttcacatattgcttttattttaaaaacttatttgacattccagaatatatgggaaaggagataatagtttaataaaacctatgttcctctc

SEQ ID NO: 26623 - DNA, 450 bp, Homo sapiens
tagatttacctctgagttaaggagtcaacattgtaacctaagatactctgtttacaatgtcctatataaaggaagtgacaaaaaacaatggcacatgcctaccaagaggaaattccatcaaaggataataagacgaagcagttttgaaaaacagctcagcaaatgtgcattggtcttctcctgtggggcaggaatcaaagaatagatattcttcatggaccattggtggacccagccctcagtgaacttggagtctaatggaagagatttaaaaaaatgtgtataagttaaaatcaatgtaaaagtgctgtaaaccaaaaataaaattctaagtccccctaaccatctgaatggacccctcctctcaggcaagatcattcgaaaattaacctgaaaaactagttcaaggccatgattggaagtgggggtcagatgtgtctcattgtaccc

SEQ ID NO: 26624 - DNA, 328 bp, Homo sapiens
ggaacctagattgtcacttcagccaccataaaatgtatctattaatagatactaaaaagttatggctgtttagggttttatgctgctgtcagcttgacctataggcaatggaccaggaaagagatcaggtcaagtgccatcaactgttgctaaaaatggcaacaaagtagagtggaaatcagaaccagatacttgattttcttatgcctcaaaatgttggagcctcgggtaggagtaccacacagtccattactctatgaactttgtgttgtcttaaaaaggacacaatcccaagagtcctgtaagataacttttaatgataagtaaa

SEQ ID NO: 26625 - DNA, 231 bp, Homo sapiens
ggcagtgagagagagagaggaagggagactgggtacgggcgtgtgtgtgtgtgtgtgtgtgtgtgcatgtgcatgagtgtgctgggtatgggtgtgaggggaggggttaagtaccactcagtacagaaatccagaatttcctggagtgtgaaacaggcaaggtgagggatggagagacagagaagtacagcaggacatatgggtgtgtgacttaggtactagtgaatataa

SEQ ID NO: 26626 - DNA, 952 bp, Homo sapiens
tgaattactgttagcttgcattatcatcagtttgttttgttgtgggttgcttggttaaccctacagagtatacttgaagcttatttgcatcaacagtattctggagctgtaatttttcaataactagactctgagacatgtatacattgtggttcaaataggaatcatccatagtccagtgctagaacaaatgtatacataatccactccccacaaattatcactcatttatttttccactggaaaataagactagatggagtcggtaggtgaaacagttttgccgtgcctaagtggaggctgatcaaaactaatttgagatccgctgcctttaatagagctccacctcaggaatcttacctttataatacatcctagataggcaagagggatatgtcctgaaatcttcactaattccaagattgcgtgtcatttcccccaaaaatttgcttaactctattggaaaatccaagagaattgctgcagctgctgaaaacaagagagctgcattaagctgcaaggccgggtagggtaggtagactgactcaccacctatgggacctgcctccacacatcagcttcccaaatacttgcagatttgggtcttaccaaaagacaagtcagtatgagttactcacaatcctaactacaaaggctacatttacaaataccagagtttcgactgtgtttttactctctgctccctgaaaactgtaaccccaggctagctccaaactctgcttatagcccatgctttactacagtggtggtcgcatatgtgaacgtgtgcatgcgtgttcacgtgttcatgacaacagcaatgcagccatgagggtgctgcccccaaaccaagcctgatgaccttgagaacctcaggcttcccagtaggatcctgcaagaaagcatctcttaaaaataaattctacaggatattagtaaatgttagatgaaa

SEQ ID NO: 26627 - DNA, 1231 bp, Homo sapiens
tcccatctctgacccccttccccgcaaaaaaaaagctaggtgtggtgacatgcacctgtggtcccaggtactcaggaggctgaggtgggaggattgcttgagcccgggaagtcaagactgcagtgagctgcgattgcatgactgcactccagcctgggcaaaagagtgagacattgtctcaatctccccacccctgccaagaaaacccaaaaaatattgaggtataattgttatacaatgaagaacacattttgattagtttatacacacactcctgtgtacacttgtacactcacacatcaggaaaccaagcaacccctaggggttgcttggttaaccctacagagtatacttgaagcttatttgcatcaacagtattctggagctgtaatttttcaataactagactctgagacatgtatacattgtggttcaaataggaatcatccatagtccagtgctagaacaaatgtatacataatccactccccacaaattatcactcatttatttttccactggaaaataagactagatggagtcggtaggtgaaacagttttgccgtgcctaagtggaggctgatcaaaactaatttgagatccgctgcctttaatagagctccacctcaggaatcttacctttataatacatcctagataggcaagagggatatgtcctgaaatcttcactaattccaagattgcgtgtcatttcccccaaaaatttgcttaactctattggaaaatccaagagaattgctgcagctgctgaaaacaagagagctgcattaagctgcaaggccgggtagggtaggtagactgactcaccacctatgggacctgcctccacacatcagcttcccaaatacttgcagatttgggtcttaccaaaagacaagtcagtatgagttactcacaatcctaactacaaaggctacatttacaaataccagagtttcgactgtgtttttactctctgctccctgaaaactgtaaccccaggctagctccaaactctgcttatagcccatgctttactacagtggtggtcgcatatgtgaacgtgtgcatgcgtgttcacgtgttcatgacaacagcaatgcagccatgagggtgctgcccccaaaccaagcctgatgaccttgagaacctcaggcttcccagtaggatcctgcaagaaagcatctcttaaaaataaattctacaggatattagtaaatgttagatgaaa

SEQ ID NO: 26628 - DNA, 589 bp, Homo sapiens
aaaaaatgaattcaccaattggccaatctgctgaaagtcaaaatgaaaggctaatatatgagactgatgacagttcatggttcttggtataacttcaacagcgagtgaacatttttttctttgtctatagctttctttcagccatcgatcctcagttgtgtcttagcctcttatcagtccagctcactttgatactaaatttgattgttgtgtatctcagcaagaagcacgtctcacattctctgtattttatgtggtcatgagtgtgttcctgtcttattcttattttatgtggtgcatttttaaataggactgtacagaatacaagcatctatttgtatatgactctcatcttttatggggagaggtcagagtaggtgagcgtgcactttgattctctgctggaatctctttggattctatgtcccctgtcacatggtttattttcatatgcatatttctcatggttctcctgactcttttagcaatgctcattgcaggatattagaaattgtattacttctaatggcagaatgttagaaattgtgttgactcttaaggcaaaataaaatacccggactcaccttta

SEQ ID NO: 26629 - DNA, 412 bp, Homo sapiens
aagtttcaatttctaggcttttctaatccattcctctacccctttctttggattctgcaatacctattctgtcttatgctcatttgaaattcatcttcatttctgtgacttttttcccctaagtatttcttttctgatctcttctagttcatattctaccttttctttttttctcactattttttccttgagttcttatatttgtgctctgtggtgcatccctccctctcttctgtcttcctccccctctctctctttcaagggcgattgcctcattaagttttaaaaaatgacaaaattttgggtcacaggctttcatctactcactaggcaacattctaggggagtattcggtctattaggtaagttttatggctttctttcactttttttatagaataactttttattg

SEQ ID NO: 26630 - DNA, 423 bp, Homo sapiens
attgcaaccgtgtagctgtttggcgtgcactttcctgagctctgtctcctatcatttgatagttagaagcagttgcattttaggtggggcttggcaagcagaaatataagacgcccagttaaatctgaatttcggatgaataatgaacactggttttagtataaggatgtcctaggcaatattggggacatatttacactaaaaaattcttcgttgtttatctgaaattcagatttagccaggcatctgctatggtttgaatgtttgcgtcccctccaaaattcatgttgaaacttaatccccattgtggcgttatcaagaggaggggccttttgggaagtgattgagacaagagggcacagctcttgtgaatggaattacatgcccttataaagaggctttcgagagctgcctggccctttt

SEQ ID NO: 26631 - DNA, 332 bp, Homo sapiens
gctttgacccgccttctgtcaaaaatcttcctgcccctctaccttccctattctttgggagctgcttgtccctagcttttagttacctgatttataggaaagtccagggctgtctgggacttccagctgtttaatctcagaaggtgatgggttggagtgagagttctgaatggcaggaagggtgatggttatatcatgggaacagggaggcagagagggagcacaaagcactttgcaattttcttctctcctagaaggcaggaaccaaatgcctttttggcatcctgagaattccaaggagctcttggcaatggaactggacactcatatag

SEQ ID NO: 26632 - DNA, 613 bp, Homo sapiens
aatatataactagccacagttagattcaatgtgctgatgattatgatgatgaggataaggatgaggatgacagctagcatttattgagtgcttcctatgaaccaggccctgtgctaatatctttatagacattgtgtcaggtaatcttcccaatatgagacaagccctagtgctatagcctttttataggggtagaaactgaagcttagaggttaaaggtgacatgcttagaaggcaacagatgacccaggtgtgtctaaatctaaagcccttcatgcctttgctccccttacccatttatttctctcctgtttccttcattctttgaacaaacatttattggacacttactatatgccaggcccagagctaggcactgtagctgtggtgatgagcactatttgagtcttgctctcattgaggcaaggtcggggtagagatattaaataacccaaatgataaatacataactgctcatcacgatgatattataaagggaaagatcagcatgttttgtgtgtaatggggaaagattgcatttaaactgggtccagggacagctatttggaggaagagatagttgaattaaagcatgagaagaagttacccagga

SEQ ID NO: 26633 - DNA, 496 bp, Homo sapiens
caaacacatatggggaaaaaaaagacacaaataaaaggcatgattagtagacatttcaaactaaaattttagagattaatctaattatatcaataattaatcacaataaatgtaagatgactaatctcatccaatacaaagcagtgggtattcttatactgatattatcatatcttagtatattatagcaccttttattttaaattctctatttttataaggaaatttccttctacttcattagaacttttcagcaactaagctttctctcaacacagaaacacccaaaatcctatttcaaaaatttttcattgtctccaaaggatatataaaaaaccttttagtttaccatggtacccagtaactctagaaaacagatgatatcatcaaaaattcccagaggcaaaatgtggctttaaaaatccacattgatttggggacttttgattgagctaaaggcattttgtttctgatgagtttttaacctgtatttctt

SEQ ID NO: 26634 - DNA, 462 bp, Homo sapiens
acctgggttcagagtcgacctttaccagttaagcgatgtgtgacctctctgagcctccgtttcctcatctgtaaactggggaataatcatagcatactcctggctctcatcccacagagagcccagcgcaggcagctggagtcctggagctcctgctcccctgagggaaggtctggagggatgggcaggtgtctgggttggtagtcctgattctacttcttggggtctgctccaccccagcccagctttagggctccacttcctaggctgaagccccagcccagagagctaacccttcagccttgtccagattcaaaacacccacctcaggacaccggcaccctccacagccccaggccttacctgtgaacacctgcacccaaatcagccacctgcaatgtgctgggttctgggtaagccattattaaactggccgtgatctcacaagtcaagataccatgt

SEQ ID NO: 26635 - DNA, 419 bp, Homo sapiens
agtgaatattttaattcttaacaataaaatatcttctaatgaatcccaaatgaaaaataaaagaattttgctcactggatatacagaactttatatgaaaacatacttggttttctaactaagaaacaaatatttcctactatataaatcttaatcatatatgtaatctgaatatatatgaaaatatatattcattgtatatataaaaatatacattcattatatatatacagattatacatatattttcagagatcctcataataaacatgtcaatgaagttattattgaagtctactcataactgtgacagccaaggctcagactgccccattaattgcttaaaaatgtcacatagctctttttcagatactaatattataatcttattttactgtcagtgcagcccaccccccacc

SEQ ID NO: 26636 - DNA, 337 bp, Homo sapiens
gagacctgtaggaggaacagtgtgtagagtgtggttcaaagagcactgggctgggtggaagagggtgagtttaagtcaggtggccaaacttctgtagcctgaaagcctctctggtctgcgaacttctccgaacctcgtcttctttcttatttcacattttcaagatgaaaatattagaatacattagatcttgttctggtctgaaaaatgcctctatgggtagccaaataactcagttgtcaagaagaaaaacggatatataaattagtctaataagacatgtatttctccaagaattcaagaaatgcaatttgctgccctgctgggctccgccaga

SEQ ID NO: 26637 - DNA, 534 bp, Homo sapiens
gttacttaatgtagtggtaaaactggtggtcaaaggaggcacagttttcatctaattcaacagtttttcatgaagcatgtctcagccgctgagagccacctgaatgtggacctgcccctctgcttcttcaaaataattagcagaaaaggattaataattcatggaagtggtggttttttgccagcatattcctataaaaagggaaatattttcacatactgtaggggctgccaggcagctgaacatgtggcctggcacggaaattggtgataaaactaaaatatcaggaaattgtaccactcataacttttctgccagaagcttcatttacattatttttaactcttgagagaaaaagattttcatatctaatcaaaggagccaagactttttaccatgcattgaacattgaattttaatgtgaaattctaggagaaaaatagatttttcttctcaattaaccaatagtgacattttactttgccaatattaagatgatcttctgttaaaatttagctgaaatctgtttaaccc

SEQ ID NO: 26638 - DNA, 471 bp, Homo sapiens
aaatggtccttggcttcatggagcttatagtctatttgtggaaacagatactaaacagataatctcataaataacataatttcaattgtgttaagttctacaaagaaaagaacagggtgcaatgagggtatacaacctaatactgtggttttccttgaggaaatgatgtttaagccaacatataaaggaggacttagctaggcagagggcttggggaaaggacatagagcagcacattataggcagaggataggactgaagcaagttgaagccgaggtacgaatctggaccttttttatttttatttttgggacagggtcttgttctgtcatccaagctggagcgcttatcaatatgatggctcattgcaccctcaagtgatcactttagcccaggagatcaaggctgaagtgagccatgatgttgccactgtactccagtctgagtgacaaagcaagactctttctttaa

SEQ ID NO: 26639 - DNA, 345 bp, Homo sapiens
gcgatagaatgaacatattaaggctccaggttactgactggaacaactaagggagatggtagcgccatttaaaagatcggaagcactggccaggcatggtggctcacacctataatcccagcactctggcaagccattaagaggatcccaggagtttgagaccagtctgagcaacatatggagacaaaaatttaaaaattagccagggatgttggtgtgtgtctgtgatcgtatatggaggctgaggttggaggatcactttagcccaggagatcaaggctgaagtgagccatgatgttgccactgtactccagtctgagtgacaaagcaagactctttctttaa

SEQ ID NO: 26640 - DNA, 630 bp, Homo sapiens
atgctgaaaccgaccatctctactaaaaatacaaaaattagctgggtgtggcggcacacgcctgtagtcccagctacttgggaggctgaggcgggagaatcacttgaacctgggaggcggaggttgcagtgagccaagattgcaccgctgcactccagcctggcaacagagcaagactccatctcaaaacaaacatacaaacaaaaaaaggtgcctctggtcctgtgttttctttttccttctgaaagttcatagaaacctggcatatagagcttattttgctgttttaactggttggctccacaaatcctgctacctgacatcagtacagcttgaccgcagtgaagtacttgatggcttgttcatgtttagttcacctctttagaaagaaagctttgtggccaggtgcagtggctcacacctgtaatcccaacactttgggcagctgaggtgagcagatcacctgaggtcaggagttcaagaccagcctggccaacatggcaaaaccctgtctcttctaaaaatacaaaaattagccgggtgtggtggcggaggatgcagtgagccaagatcgtgccactgcactccagcctgggcaacagagtgagactctgtctcaaaaaaaaaaaa

SEQ ID NO: 26641 - DNA, 593 bp, Homo sapiens
atcgtggtcctcaggacgtggggtccctagccagtgtggcttccgttgccctgtcagagtcttctcatgttgttttatatgtaatgtccagggtttttggttttactgggtgaaacagggaaaaatatgtctacctcatcttctcagacaggaaaaatatttttatgaggagaccatcttctcctgtctggatgctttcaataattcacgtaatccccgtttctattccaatttttatctcacatacaggtagttttattaaagtatcaaaatgttcttactgtgtgagaaaatgaccctactaaggttgtatcagcaatgaggatttttttcttatggctgtcttgttttagcaacttctgcctcctaggttcaagcgattctactgcctcagccttccaagtagctgggattacaggcacacgctgcagcacctggctaattttttttggattttagtagagataggagtttcaccgtgttgcctaggctggtctcgaactcctgagctcaggcaattcacctgcttcggcctcctaaaggtgtgagccaccgcacctggcctagctgagatttatatacagataattaag

SEQ ID NO: 26642 - DNA, 482 bp, Homo sapiens
tcctgttgcttgatttatttgaacggcagcaatccggaaaagtcgtcagtgcacaatgactcattccctgagggttctgaataagattctaaaatcaccacccatggttttcctgcactttgaagtgacagaacaaatgacagcagagatgggcactgtctcctgagtccagaatggatgacacacacgcgtctcacaacaataacatcctcatctaaaaacagcctgaaaggaggttatttctgggctttgcttgttagtaagcatttgtgcacctgtgggcagagacctaagaccaagatggtttgggttttttttctgtatagtcaatcaacaaacttattgatgccttttccatgccagggcctgttctaaggacatgagattaattcaaccctcagaggaaaaccctcacagagcaaaaattgggataacaaatgagaaaagccataaatgagagacagatgaggaggctaagggag

SEQ ID NO: 26643 - DNA, 263 bp, Homo sapiens
tgtagaaatgggatctcactatgtcactatgttgtctctgctggcctcaaactcctggcctcaagcaatcccccaacctcagcctgttgagtagctaagtctatgggcacacaccaccgcacccagcaaaaaattgaattttagattttgtctataactactttcattgcagtcaacattgtattacgtagttaagaattttttttgaggcagtgatcatttaaaataaaaatgcctaaattccttaaccttgaattcttaat

SEQ ID NO: 26644 - DNA, 685 bp, Homo sapiens
ggtgggatcacctgaggtcagcatggtgaaaccctatctctactaaaaataaaatattagccgggcgtggtggcgcatgcctgtagtcccagctacccgggagactgaggcaggagaatcgcttgaacctgggaggcagaggttgcagtgagcaagctgcactccagcctgtgtgacagagcaagactccgtctcaaaaaaaaaaaaaaaaaaaagaaagaaagaaagaaacaaacaaaaatagttatgtgggttttcgttgacatatttttgggaaaccttgatgtatgtattcagaggacttctaagccataagagacccaagtgccttgaggagccacatacttttccctgcgctgcttatttctgaggtggttaataatatcgactctgggaagattgatttttcaagactccttcccatttcttaatttatttctgcttacttagtttggttttttatttttagcagacattttagcaaagcagaaatatatttttcctgtggattttagacttgcattcttatatttacgaacttacaaaaacttatcccagaattaattttttttttcaaatgcttaggcaaattaagtatgatcaagtcttctttattgtgtgctgtaaaaatggagtggcggcaagaatgtaatacagggcatctgactgctgaggaaaaaaaaaa

SEQ ID NO: 26645 - DNA, 491 bp, Homo sapiens
tctccccacttctagaaagtaagttcatgtggaatttcaacaggaagaaaagactttcaaaaatgtaataccagcattgatttaaaaattcaatggtgggctgggcacgctggctcatgcctgtaatcccagcactttgggaggcctaggcaagtggatcacctgaggtcaggagtttgagaccagcctggccaacatggtgaaaccctgtctctactaaaaatacaaaaaattagccaggcttggtggcgggtgcctgtaatcccagctactcaggaggctgaggcgggagaatcgcttgaacccgggaggcagaggttgcagcgagccaagattgcaccattgctctccagcctgggcaacaagagtgaaactgcgtctcaaaaataataataatattaataataataatgtgtattagcaattgaataaaaatgggttcctctgtgaaaagagttcctgagacttgggagaagagtccaaaagaagaa

SEQ ID NO: 26646 - DNA, 409 bp, Homo sapiens
tgtggagctaaccaaccatggttctgatctcctggatcacaaaatgagtgaccaggccacagtgtctagagcctaggcacaaatctggtatagttgggtttgtgtgtattactccagtcctttagttggtcagctaaaggaggtggctgtgtaatatactgcaaagattgtgggctttagagtcaggaagccctgtgttcaaatcctgactatgccacttactatctttgtgactgtagtgaagttatcaacttctcccccactcaattttctttatctgcgagataggggtaaaaatgcctctcttgcagggaagctggggtaatacctgtaaaacattttgcatagtgaccaaaatttaatactcaaaatatgtcatcctcttcccccccttttttttttaaaccag

SEQ ID NO: 26647 - DNA, 951 bp, Homo sapiens
atggagaatgtcactacaatgaatgagtttcttctacttggcctgactggtgttcaggagctgcagcctttcttctttgggattttcttaatcatttacctgataaacttgattggaaatggatctatattggtgatggttgttttggaaccacaactccactcccctatgtatttttttctgggaaacctttcttgtctggatatttcttattcttcagtgacactgcccaagctgctcgtaaacctcgtgtgcagtcgcagggctatatcttttctaggctgtatcacccagctacacttcttccactttttgggaagcacagaggccattttactggctatcatggcctttgaccgttttgttgccatctgcaatcctcttcgctacactgtcatcatgaacccccaggtgtgtattctgttggcagctgcggcctggctcatcagcttcttttacgctctgatgcattctgtcatgactgcacacctgagtttttgtggctctcagaaactcaatcacttcttctacgatgtcaagccgctcttagaattggcctgtagtgacacattactcaatcaatggcttctttccattgtcacaggcagcatatccatgggagctttctttctgactcttctctcctgcttctatgtaattggcttccttctgtttaagaacaggtcctgcagaatactccacaaggctctgtccacttgtgcctcccattttatggtggtatgtcttttctatggacctgtgggcttcacatatattcgtcctgcttcagccacctccatgattcaggaccggataatggccatcatgtatagcgccgtcacccctgtactgaatccactaatctacacccttaggaacaaagaagtgatgatggctctgaagaaaatctttggtaggaagttgtttaaagactggcagcaacaccactag

SEQ ID NO: 26648 - DNA, 801 bp, Homo sapiens
gcccgtctgtgtctaggtaccaccgtgggtacattgttgggcaggagtgtgtgcaaacacaggtctgtgtgtgcaatctcacatatctgcctgtgagactggattgagacccattcgtttctatgaatgtccgtgtacgtcagcgtgtgtgtccaccttcctgagtgatgtgttcgcttgtagggtgctggctgaatagactctgtccagccctgttctgtagtctcaagctgcctgcgatggcctgaaattccacctttcatcccctatggatgacagagagcttacagatgaccctactgaatgcaagcacctttggtgaggagcatcacagggctccttctggagcatttggtggggacagctgcagagaagaggcctggaactcgggcagcactgcagtgccaggaggcaggcggggaaccgaggcaaaggctgcccatctccccctgccaggcctgtgtgatcattatcaccaacagctggtgggtggccgggccaggatgcagcggggccttctgatgcccaatcagcacggctgccttcctgacccagtcaaggcctctgtctgaaatgagtcgctccaggttctcagcatacacttccatcgcgtctgtcgggtattgttccttaactgtcccatctgtgcagagtccattgccccaactagactgtgagctcctcctctgagccttccaagtcccccctccgccttcgccacctcccgctcgtgcccagcacaagtgagcctggtgtggaaaccactccattgcccggtggaatggattctgtaatcagtgg

SEQ ID NO: 26649 - DNA, 766 bp, Homo sapiens
ccacaaggcagagggagtgaatataagttagtagccaggagccagatctaatatttaaaaggctgctttggagatttcatttccattggcgtgtacaagttcatgattgtttcgaaataaaacttgttaggattttaaacttgactttcattatctctggtatattcttctttaaaacatatttgctcttcccaaatagaaagagtaattcatgactttcctatctacttattttgtctcagatttgattttgatttttctctgtcttcacgaaaccaacgaaataatagggagaataattgaagctttctaatcattagactctaataaagaaactcgatacactgtaaacccaccactacattctaccgtgacgagcagaacaacctgagaagaatacagttttttactctaagcagccttggttttccttgtcacaccactagtaaacaactctgttttaaaaatctgtaattttctttttttttctgtttctttttcttgaacttttattttaagttccggggtacccgtgcaggatgtgtaggtttgttttataggcaaacatgtgccatggtgatttgctgcacatatcaacccttcagctagttattcagcccagcagccattagctattcttcctgatgctctcccttctcctacactgcccccgacagcccccagtgtgcgttgtcacgcccccatgtgtccatgcattctcattgttcagctctcacttgtaagtgagaatatgtgataaaaaaaa

SEQ ID NO: 26650 - DNA, 1919 bp, Homo sapiens
cctgtccttacccacttttccaaacggggaagactcaggtatcaggaattacccattgcacattttgcgggggggggggctaatgtagacatgacaccaagtgcttttcattttaattctctaagcagtagatgagatctttcccttgggagaaatcacagagatggagttttccatttctgcttatacgaaatatgactgaaaatgaacaaagccacctttttaaccaaatacactagaacatatgcactcaagagttagcataattggagttattttcttgatgttgcatgtgccaagaacacttagggttcccctttgggattacctttgaagccatgcaaggcaagaggcctcacaactttatagtcagaccttgtgttttatccaacccctcctcctgcccaccaagatcatcctgagctgcttcacccattttatttagcagacttattttctaatgctctttagctgttaaaaaaaaaaaatcattcctcaaaaaatagatctacccttaaaggacaaagatttaccaacactgaagacccttacaagttgacagtttctaaagagggttctaggaatgttctgtgtaaggtcagcttcactggaataaacatacatcttcccaaggtgactacttcaaaggcaacactacccattcgggtgcagaaattaccgtacttactctgccataaatgtaaaatgtgtataaagttaagctattgcattttttcataacacatttaaatagaaattggcttttaaagtattgtagttaaaaccagatctcaccaagtaatagttgtgcaattgacaaatgtttggtgccatgtaatggagatgtcacactacacagttgtagtttaaatgcagtccaacataaggtgcatgccactgaactgtaaccctagtaatgtgtcttgtacagttgaaaaataatacttcacctttatataggttaagatatgtaccttatctttaccactcagggtggctttaaaagacggacagctttaggtttgttctcactggaactggttacactttctgtgcaaacttaaccaagtgatgatcgtctggaagctgcattccctcatttccactgtttggtgtgaatctagtctccccactttatctaaaaggaggctagcagggccccagcctgagcagagcagctagagagtgcttccagattcctttgccaaaggaggcccattttccagctgtgagtgacatctgtagtcattggcttcattgcctggcactagccctgtctagaagtggagaaagctggatcacagctggaccacaaccagccccaatccaggatttcccataccatgctggctgtgggctctgtgagcctcagccaggtggccaggctatacttgtcacagctggccacaggcctgctgaaggaacatggggtgtagagccagagcctggttctggttctccgcttgaacagctgacctcgtgcaatcacaggaactctgcgtctccatgtttcactcagatagagaaaatgcctcctttgtttacctctttgaagctgaagtaagtgagactggtgcatgtaaattaatggtagtagagcacctcccacatctgattttataacagtttcccatcactccttaaagaaaaaggccaggccgggcgtggtggttcacgcctgtaatctcagcacttcgggaggccgaggcgggtggatcatgaggtcaggagattgagaccattctggctaacacagtgaacaaaaaattagtcgggcatggtggcgggcgcctgtagtcccagctacttgggaggctgaggcaggagaattgcttgaaccttggaggtggaggctgcagtgagccaagattatgccactgcactccagcctgggtgacagagcgagactccgtctcaaa

SEQ ID NO: 26651 - DNA, 1865 bp, Homo sapiens
cctgtccttacccacttttccaaacggggaagactcaggtatcaggaattacccattgcacattttgcgggggggggggctaatgtagacatgacaccaagtgcttttcattttaattctctaagcagtagatgagatctttcccttgggagaaatcacagagatggagttttccatttctgcttatacgaaatatgactgaaaatgaacaaagccacctttttaaccaaatacactagaacatatgcactcaagagttagcataattggagttattttcttgatgttgcatgtgccaagaacacttagggttcccctttgggattacctttgaagccatgcaaggcaagaggcctcacaactttatagtcagaccttgtgttttatccaacccctcctcctgcccaccaagatcatcctgagctgcttcacccattttatttagcagacttattttctaatgctctttagctgttaaaaaaaaaaaatcattcctcaaaaaatagatctacccttaaaggacaaagatttaccaacactgaagacccttacaagttgacagtttctaaagagggttctaggaatgttctgtgtaaggtcagcttcactggaataaacatacatcttcccaaggtgactacttcaaaggcaacactacccattcgggtgcagaaattaccgtacttactctgccataaatgtaaaatgtgtataaagttaagctattgcattttttcataacacatttaaatagaaattggcttttaaagtattgtagttaaaaccagatctcaccaagtaatagttgtgcaattgacaaatgtttggtgccatgtaatggagatgtcacactacacagttgtagtttaaatgcagtccaacataaggtgcatgccactgaactgtaaccctagtaatgtgtcttgtacagttgaaaaataatacttcacctttatataggttaagatatgtaccttatctttaccactcagggtggctttaaaagacggacagctttaggtttgttctcactggaactggttacactttctgtgcaaacttaaccaagtgatgatcgtctggaagctgcattccctcatttccactgtttggtgtgaatctagtctccccactttatctaattcctttgccaaaggaggcccattttccagctgtgagtgacatctgtagtcattggcttcattgcctggcactagccctgtctagaagtggagaaagctggatcacagctggaccacaaccagccccaatccaggatttcccataccatgctggctgtgggctctgtgagcctcagccaggtggccaggctatacttgtcacagctggccacaggcctgctgaaggaacatggggtgtagagccagagcctggttctggttctccgcttgaacagctgacctcgtgcaatcacaggaactctgcgtctccatgtttcactcagatagagaaaatgcctcctttgtttacctctttgaagctgaagtaagtgagactggtgcatgtaaattaatggtagtagagcacctcccacatctgattttataacagtttcccatcactccttaaagaaaaaggccaggccgggcgtggtggttcacgcctgtaatctcagcacttcgggaggccgaggcgggtggatcatgaggtcaggagattgagaccattctggctaacacagtgaacaaaaaattagtcgggcatggtggcgggcgcctgtagtcccagctacttgggaggctgaggcaggagaattgcttgaaccttggaggtggaggctgcagtgagccaagattatgccactgcactccagcctgggtgacagagcgagactccgtctcaaa

SEQ ID NO: 26652 - DNA, 724 bp, Homo sapiens
ggaggtctgccccaccaagggctggttccctgaattctttggaacagctgtagcaaaactggaatgtgctacagctctttggaggctgcagacccactgaaaacgtcactgaagatattgccggggccactgatgactttataacttcaccaaaggaattaacctctagttattagtaaggaggttttgtataccagtgaaactactgacatcacctggtctgaaggaccccatgaagagatgactcaccaaagaatgcagtttccacatcctgatgatttcatccccattacctgacaaaacaatgaccccaatttcccagcccctcaccctccatgaccccctgaaaaacgtcagctagaaacttctcggagagatggatttaagggtctcctcccatccccttgcttggtgccctgtgatcattacactctttctctgctgcaaaccctgctatctctgtacctgtctgtcactgcacagcaggcatatgaatctgttggtcctataacatcgcaacgtaacattcccatgtggagggggattacactccatgttcttatcacagcaaaacatatgtcacacgtagcaatctatgtaagtgtttggaatcatttcagagctacataacaggcaccattgtgaaatgcaggaaactctgaatttccagttttgaaaaaattgtattggagctctgtctctgctacccactaactgtgatttt

SEQ ID NO: 26653 - DNA, 446 bp, Homo sapiens
cttgctcaactctacctaatgacttttgaactgaaacattcgagtttttaaaaattacattgatcatatatttatttcaaaaatttctttctcttttaacaaaaacacattttaatttaattttctgttcttgacacagtttctactcttttcccatttctttaatcaatttaaactcttatatttgcaagtatttttttagaccgctctaccatcttcagttcttggggttcaaaagatcccattagttgcatccactcactgtgcttcaacgtggctcacttctatgtagggcttataatttttttactgtggggtaatttttcaagagggattgtttaccagagaaatcccagtgtcttgggttgtagactggtccctgtggagtcactcctatagaataattttgtatttgcctcagccaagtatttgtgagttttactgat

SEQ ID NO: 26654 - DNA, 508 bp, Homo sapiens
ttaaaactggacacaagaacacaaaacgcttgggctgctgagagattagaccaacaaccctccacggctacaaaccttttccacgttatatggcacgttataagtgggtgttcctagtgatggttctgattttttttttaaaaagtctaaatatgtttaatgttgtctcagaagacaaaatatattttagacagatattcctcagtgatgagtaagcctcagctatctggaaaattcatgcaggcgccagagatcattactgagtaattcaagctaataactgcgtcatgctggttgtaccctgcatgccaatatctgctaaaagcagcaccacgaaagggaaatacgaatctcactaagcactcacccattcttgttaacgacactggaactgatcatccttaataatacacagataaatctatcaggagcatttccttgcttcctgtgaaaggaagtactcattccatgtgtcctgtgaaattcagccagcttcgggaagctggag

SEQ ID NO: 26655 - DNA, 360 bp, Homo sapiens
atgggagggtcacttgagcccaggagttcgagaccagcctgggcaacagagtaagaccctgtctttggaaaaaaaattaatatttggcaggcgtgttgatgcatgcctgtagacccaactactagggtggctgaggtgggattacttcaagcccaggaggttgaggctgcagtaaggaatgatcacaccactgcactctagcctgggtaatagagcaagactctgtctcaaaaaaaaaaaaaaaaaaaactccagtactcctactgtggtcactttctagctgccaacattaacaccagagaggtgcacagctgactctcatgagctgacatgagccggccctggggaggttttggagtc

SEQ ID NO: 26656 - DNA, 473 bp, Homo sapiens
agccatctcactactttgaaaacaacagtaactctcacaacactacctttttccagcaaattttcccatcgagcacccccagatcatgtcagaaagaaatcttaaagctgctaacccacgatcaaggtcatggggtcagatagttattcagtgtggcagagactctttccttgcccatcagaatggagggaaaagaatattacacagaaatcaaagaagagcttggaaggacacgtatttcacaaatgcattgatgagtaagagagaaaacttatccaaggcagtgacaagagactcctgagacaactggcacatcagtgtacagtgagaccatacctttatagtgacagctttgttttggtatttaactggttatcacacgtgatttttaaattaagcctaataaggtaatgctacataatatgcatttgaagtatttatatgtatacgaagctggctaactaatcattgct

SEQ ID NO: 26657 - DNA, 301 bp, Homo sapiens
aatcagtgctctgtaaaactcaccaatcagcgctctgtaaaatgcaccaatcagcgccctctaaaatgcactaaccagcgccctctaaaatgcaccaatcagcaggagtctaaaagtagccaatcgcggggaggattgtaaaaagggcactctgataggacagaaacggaacatgggaggggacaaataagcaaagaaaagctggccaccccagccagcagtggcaacccgcgctacttgctgtggaagctttgttctttcactcttcacaataaatctggatgctgctcactctttcggt

SEQ ID NO: 26658 - DNA, 386 bp, Homo sapiens
gctgtaccctaaagatcttttagatgttaggtttccctggcccctgtgcctgcctgagctcctttgtgacgtgtgtggtattcccttggtgtccaggccatcacacagtgctttttcttgactgtgtttgtattgctctccattgaaaagcttcttggccgggcgcagtgtctcatacctgtaatcccagcactctcagaggttgaggcgggcagatctcttgaggtcaggaattcgagaccagcctggccaacatggtgaaatgccttctctactaaaaatacaaaaattagctggtgtggtggcacgctcttgtaatcctagttactcaggaggctgaggcaggagaatcgcttgaacctgggaggtggaggctgcagtgagcc

SEQ ID NO: 26659 - DNA, 1203 bp, Homo sapiens
gactattagaagtcagattctaatttaagaggatatagggtttattcataaaaagagatataaaagatggagatcagagtgcttgagtagattagggccacctagactagcaagagaaagaaaaaatgataaggtataaagaagaaggcccaggcatgatggcttgcctgtaatcccagcactttcggagactgaggtgggagaattgcttacggctaggagttcaagagcagcctgaataacagcgagacctagtctcacacacacacacacacacacacacacacacacacacacacacacacagatgttaggttgtgaagggaagacaagggttaaagaaagacatacacacagagggcagttcaacaggaaatgcaggctttatgtccagcataacacctacagaggtggggaaccagcctaatgccagtgcccaccaccgcttacaggctggggtacttataggcctaggtgggaggggtctgggcagtatggcttgctgctatgtactgctatgtgttggtaaggtgttcccatgatgaggcagtttggctcttgttcccacagaatgtgatgttccttgcactttttcccagcagaatatgataaaaggcaggctgtttctcacagcccgaacccccgtggaatgattcactttgatcaaggtctgagaaatggtgggagacttacaaaatgatgcagttggaactaacaagagagaaagaactagaagaagaataaggtagttggcagaactcatgaggaggagaccagatcaggagggaccacaaggacaggagaattagcaacgagagactggctggcaccagtcttgggaaaacttcagagtgagctccattcatggtctattaaaaggcctttgttgtcattcagtgatatgtgcctggcccctgagactttaattcaacactagccaaactatctcatttggataacccccttttcaaagttcaaaagactgattagcccccacagaactgaaggtgaggaaatggggttctagaatctggcagggcagtgtgatgtggaagggcacatttacccttccacaggaatgtcacgggttgatatgggcagaacaactgtaaatttcgcaacggggtgtggctattgttattgctgtcaaagtgggaattcatattgtcagctattcactagttgattagactggcggttcat

SEQ ID NO: 26660 - DNA, 611 bp, Homo sapiens
ttatgagcaaagccgtaagtgtggcttccttattttaaagatgcgtaaacagatccagagaagtgatgtgacttacaaagatttctatcaagttggattcttgcctgagaaaatcagtcttcacaaattctggccccctaagggttctaaacagttttatagctctctgaattattagctttaaaatcaattgaaaatgtagtatattattagtggggaaacatttagatgctgtgggcaatgcttgcactacgttttattctttcagaataagagcagcagcactgggcctaacttcaatttattactggtaaatgagttaatgactaagagcagttgttgaggcctttcttcatgcctgggtccacacatcccagcagtgagcacccaccggtcagctccaagctgggaatgcctgcaggttttctgggctttcagcttagggtggccagatttagcaactaaaaatacaagatgcctcattaaatttgaatttcaagtaaataacaaataatgttttgtataaatatgtctggtgcaatatttgcaaccctattttagctttggttttatatgatcagagtttatatttttattttcataatttgatg

SEQ ID NO: 26661 - DNA, 470 bp, Homo sapiens
tacaaaagtgattgcttctgatttatattcaggatgtaaggcacagaagaaaggcaacatactaataagttacacacagaagttattttatacattttattcatagtatttagtaaaatttatacaattcttcaaatttaaaataattaatttctctttgtattacatgtgtgcccaccaactacagtaaactttattatttgaaacaaatacatgggtttattcctgatcttcttcgttaaaatgcaactccgtatgccagtgctgtggcaagactattatacaattccaaatgtcactgagctcttttcaagttaataagccttaaatcaagggaatttggtgcaaataaactattttcagttctcagaaagtttgtgggtaaagtggtaattttttgaacacggaacagttttcaagggtctcactggaaaatatgcttgggttgttaacagaaggacagtaattgc

SEQ ID NO: 26662 - DNA, 355 bp, Homo sapiens
cgttgcactccagcctgggtgacagagtgagatcccgtctcaaaacaaacaaccctcaaaactctccaataggccaggcacgatggctcacgcctgtaatcccagcactttggtaagtcgaggtgggggcggggggatcacctgaggttgggagttcgagaccagcctggctaacattgtgaaacccagtttctactaaaaattaaaaaattagcctggcatggtggcacgcgcctgtaatcccagctactgggaagctgaggcgagagaatcgcttgaacctgggagacggaggttgcagtgagccaagatcgtgccattgcactccagcttgggcaacaagagagaaagtcaa

SEQ ID NO: 26663 - DNA, 163 bp, Homo sapiens
acctctccagtgtgataatcaaaaatgtctcaagacgttgccaaatgtcttctgaggggcaaaatcagccccaattgagaaccactgccatagagtcagaggaagcagatggattggagaaaatgttaaagctaagggactggagtctcgatgaaaaaagaaa

SEQ ID NO: 26664 - DNA, 93 bp, Homo sapiens
atgaacccctctgagaagacttgttctctaagtgttgaaatcctttttcatctccaaagcgttagtgcccacagagaacctttacaagtaaac

SEQ ID NO: 26665 - DNA, 87 bp, Homo sapiens
acttggacctcacttttccagttaagtggcctctgcacgcgaggagagtgagctccaggactctgcctgtctcagtgctgtgaatga

SEQ ID NO: 26666 - DNA, 394 bp, Homo sapiens
tcagtacaaaatgaacacagccggcgctttggggaacgttcatttgcagctttgttatccttagacaggaagccttctcctccacactttgatcgacatttttcagaaggcaatggcatcaacctttaaaaatggatactttcaagggtttaaaggttgagatttttaagacaaacccagaataggcaaaagttacatattggccaaaaatgtgactccagaaaccatgtgttgtagctaactggggccactagcaaatctttcttttgagacttctgtcctgttagcagaatgcactgatcgaactaaaccttgagcatgacacaggatagaactagttattgttaagaaaataatgttcaagggcattggtccattgtacccaggaatagtt

SEQ ID NO: 26667 - DNA, 234 bp, Homo sapiens
ttccttaattctgaattaattggccctaaaagtattttggaagcaatggttaaaactgttcagcatattagctctatattgtgtttatcaaaatcttttatttataattcactgcaaagcaaatcaaaattagttaagtaaaacaagaaatgtggcttctctgtctatgaagttgccatcctattgtttctttgcttctctactaaacttgctttcactttgcaaaaaaaacca

SEQ ID NO: 26668 - DNA, 1838 bp, Homo sapiens
gttcaagtcattctcctgcctcagcctcccaagtagctgggattacaggtgcctgccaccacgcccggctaattttttttttatttttagtagagatgggttttcaccatcttggccaggctggtctcgaactcctgacttcgtgatccacccacttcagccttccaaagtgctgggattacaggtgtgagccaccacgcccggccttcagtaatcttaaaatacagaaaaagcccttttatctggcatgatggggactgcaagtttgccagttaattgagcgattggttaaagaggcaaattataaaaataaaatgttttatggtaagtttcaaacacataaatttatttgccagcctttgagtggggccctgctgattggagagctgagtcacctgttttattttttattttatttgagacagagtctcactctgtcacccaggctggagttgcagtgagctgagatcgtgctgctggattccagcctgggcaacagggtgagattctgtctcaaaaacagaattggtggctgagtgcggtggctcacgcctgtaatccccacactttgggaggctgaggcggtcggatcatctgaggtcaggagttcaagaccagcctggccaatatgatgaaaccctgtctctactaaaaatacaaaaaaattagtcaggcatggtggcacacacctgtaatcccagctactcgcgaggctgaggcaggagaatcacttgaacccaggaagcggaggttgcggtgagcagagattacgccactgctctccagcctgggcaacaagagtgaaactccatctcaaaaaaagcaaaacaaacaaaaaaagaattggccagcctgggaagtccattcctttggagtctgtgttaccattctcaataaacctaatgagggctggcagaggggaactggccagtctctccttgggctttcaccgtacctcatgccatgtcacctgtaacagtgttgtagttacctgcttatgtctttgtccttgagggcaaggcccatatttatttttatttccagtgcttggcatatattaataaagaggtgcttaagatgtttgtacaaatgagttaaggtggagggaggagagttgaggcacaggtcagctggctttggcttctgtcttcttagtaaggtgaacagtgagtcatccacacagattataatggtagcagagctggagtctacagctccttgagtatgaaagtccccttgagtgtgaaagacaaaatgctggtcgggggaagagaaggggaattaaaaggtaagtggaagatggcctaattgccaagtgtacagcttcagctcagcatataattgttatggaccccagttatccactcacctaaccgtcagtgccctgtggctcagagcagcagtgaagctaagtaggaggtgaggtttggaaggtgagtgctgtgcagcagtcttggagatcatagttgacagtgccggctctggggtgggcaggaagaccattgttgggtaagtgaggggaggtgggggtcacagcaaatatgagaaacacagccaggcactgtggttcacacctgtaaccccagcatttaggaaggctgaggtgggaggatcacttgaggccaggaattcaagaccagcctgggcaacatggtgaaaccctgtctctactaaaaatacagaaattagctgggtgtggtggctcacacctgtactcccagctactcggaaggctgaagtgggaggatggcttgagctcaggaggcagaggttgcagtgagctgagagggcgccattgcgctccaggctgggtgacagcgagattgtgccttaaaaaa

SEQ ID NO: 26669 - DNA, 1037 bp, Homo sapiens
cggccgctccaacatcagaatggtaacacagactccaaaggaatggacttcccaggctgtccattcctttggagtctgtgttaccattctcaataaacctaatgagggctggcagaggggaactggccagtctctccttgggctttcaccgtacctcatgccatgtcacctgtaacagtgttgtagttacctgcttatgtctttgtccttgagggcaaggcccatatttatttttatttccagtgcttggcatatattaataaagaggtgcttaagatgtttgtacaaatgagttaaggtggagggaggagagttgaggcacaggtcagctggctttggcttctgtcttcttagtaaggtgaacagtgagtcatccacacagattataatggtagcagagctggagtctacagctccttgagtatgaaagtccccttgagtgtgaaagacaaaatgctggtcgggggaagagaaggggaattaaaaggtaagtggaagatggcctaattgccaagtgtacagcttcagctcagcatataattgttatggaccccagttatccactcacctaaccgtcagtgccctgtggctcagagcagcagtgaagctaagtaggaggtgaggtttggaaggtgagtgctgtgcagcagtcttggagatcatagttgacagtgccggctctggggtgggcaggaagaccattgttgggtaagtgaggggaggtgggggtcacagcaaatatgagaaacacagccaggcactgtggttcacacctgtaaccccagcatttaggaaggctgaggtgggaggatcacttgaggccaggaattcaagaccagcctgggcaacatggtgaaaccctgtctctactaaaaatacagaaattagctgggtgtggtggctcacacctgtactcccagctactcggaaggctgaagtgggaggatggcttgagctcaggaggcagaggttgcagtgagctgagagggcgccattgcgctccaggctgggtgacagcgagattgtgccttaaaaaa

SEQ ID NO: 26670 - DNA, 270 bp, Homo sapiens
gtagaattgaattccaggcagctcccttaaattgggttcaggctccatgaggactgtaggattttctcatagcaaagactgcagtggtggtaatgggagttgctgcaggcttcctgcttaccttttcccggcagagaagtccctcctggtttccagctgatcccatatgggcagatgaggtggcagaggcagggtgttttgttcccttttctatgcagtcagcctgagtttctgtgttttataaagtttctaccacttccttgatgtact

SEQ ID NO: 26671 - DNA, 500 bp, Homo sapiens
aggcctcgccaaggcacccctccttctttctgctatggtagcatcagaggaggccaaggaaggagctgggattatccctgggtggtaatgagccccccttctgcccacggggttagtggagaacatacaagaagcctggacccctaactgtcaatagggaggctcccctccccttcctgctggatggtgtcagaagaggcctactggagagtcaggactttcagcactgcccagtgataacaaggtgatgttcaccacagtgtcaggagagaccacttgggagcccaaactcccacccctgcctagcagtaatgagaagtcctttccttgagtgtcactggaagcagagcagggagcctggacacctgtcagtgatacagtggcacacctcctttaccctgccagaggggtgtcctagaataccagctaaagcagaaggtttacataagatccagtcttataacatattacaaaaatattcaggtttcagttaaaaaaaa

SEQ ID NO: 26672 - DNA, 349 bp, Homo sapiens
taagtcagggaggtctgccaggccttggattattctatttgctcacggggttttagccaaaggtacaagccaaaataagtagaagctaaacatattgaaaaagaagaaacaaatatttttgcagatattgacagcctaggaaatccacacaaatgtactgcaatactattagattgaaaacagggttcagcgagatagatggacataagataaatataaaagactagatgaatttccttttcaccagtagtaacaataattaaactagataattggaaaagggctccattctgaaacagcagcaattattataatatatagaggcctatactgaatagtacatgcacat

SEQ ID NO: 26673 - DNA, 585 bp, Homo sapiens
ggaagccatctcggtctctttctggtcttcagtgcacagtggccaggacagcctcccccacttcaccgaatcacatttcttcagcagtttccaacagtgaaatcatttctaggacaatggctgctaacacgtgtcagctgaagcactgcagatcgagtcatccaactcaagcttcttcctcttattggaagggataaaccaggtggaagggctcaaatgcgctgcttctggaagcatcctgggtccccctctgctctgctacctttggcttgcacctgagcccagggcagggacaggagcagatcaggagaccccgagagagtgtgagccaggagccaagaccctgcggcacttacctggagccaggaggaaagcccagggacccaaacttctgcaggcggcacttacctggagccaggaggaaagcccagggacccaaacttctgcagactgcgcaggacgccactgacctcgggagcccaggaggacgcgcttcccagaagccacagctgctgagatcgacactggcccagagggttaagagcttggaccttggcttcaggggcacctttgcccagagaaagc

SEQ ID NO: 26674 - DNA, 1813 bp, Homo sapiens
agcagaaacgggttttcaccgtgttggccagggtggtctcgatctcctgactcgtgatccgcccgcctcggcctcccaaagtgctgggattacaggtgagagccaccgcacccggcctgttttgacattcttaatgatcttaataatttggcatctgaaagtctgaaacagtgtcagtattgttagtcaaaaagaacaagttcttcaaccacttgcgtagtaccccaaattatattcaagtccctgtgactccaatgcttggagaagtcattgatatgatttgattaatgttataactttgaatttcctaactttctcagcggcatagattctaagccacttccatgtgctttcagatggcatcttaatagattggtgttgaggttattttaatgtccataaacaagaaaggtctgggaacaatctgtatgatttttctttcacattttcttatctttgccactggaggttaactgtcgtccagatatgcatatgaattgtgaaatgcaaagaagcaaacatttgggggtaggggagtaagtgctgtagttcttttgttcacttattttaatactatagaagtgtatttcattttataaaaagcaagaatcataaaaaccctctgtattttgatttatgaagaatatagcttctctctgaagtatctcaagatatatcttggggaccacaatgggatcacagtgtaattgtttgctgttggtgtcatgtttggattttagcatggtttgttatgcatgtcagtggcctctgatttcagaaagagcttggcgagggcagaacacataagggaaggaaacctctgctcaagagagtggcctgggatcacagtgtcgtcattcccaatttccttgaattccttcttggcagaccttactgtaatattacacaaaactgtaatgagtggccctcctttggaggtaacagatgcctttcctaagaactcaaagttctcttttcagcgtgctgtgacttgaatatggaaatcattttaatttcttcttttctcttatggggaaatttccatgcttggtttgtcaagacaagagaattcattccttattattgaaacattaatgaactgaaacacgttgaagcaagtaaaaaatcaaaattaggttggtttatcttaaatagttaaaagccttccttagtacaaaataaattaagcattgtaaaacgaagttaattcaggtaattactcagtacagaaatctaaccgtatatatcattggtattgcaatttaagggtataattaaattctcagaaatctgcaggactcactctaatttgctttctatatttatttacaagacagggaacaaatatgtgtcaatgtgcagcttaacagaggggacttgaatggataaaattatctttaattatctagagctacccagtactgggcttgaatttaatcatagtcaaatgtttcctctggcagcataatattaccatacaccatattaccttataattgccattacagttccttatcaaaaatgttaattctttgcttgagcaaaaatcaataaaaccttatgtttgaccctaaagtatttgatcagggaacagaaggtgtgaattggacagatcccccgaataactttcttcaatcaagttgaaaaaccaaacagctatgtaagtccccaggagagctctttttcccttatcttctcatttgttttgttataaactgtttaaatagttcaaatggttgtgcatgcctaggggatgaaacctatgtaatagaaatgtactgttttatgaataaggagtaaaattgttttaaaa

SEQ ID NO: 26675 - DNA, 851 bp, Homo sapiens
agtcacaagacaggattgaactgttcaatttttcaaaccaagtagtttgtaaatactcagcccaaattccatcaatatattgcttatagcaggtcaggtggaaagggagcaggtggatttttttgccttatctaggggattatttaccctccttgataccctcaaagcaactttaatctgagggtatagtgactgctgcagtctgatccttttatacaaatggaagaaagctcttttgttagattaattcagcgattttgaggatacattttctttttgttaattatcaaactttttaaagctgttctttcccaaaggggaagcatgaaagcttccactaaaaatttaagatgttaattactataatttatgaatatttattataattaatgtaatattagtaattcccaggatatgtgcttattctagaaaacatttacaagggattttgatgaaaaaaaaggaaacaagctgcacacttagaaaaggatctacggtacagtaaaccaaacctgtactgattatgatgttttcaaattaacctcctttttctttttggcctaatcataatagttgtcatttggactgagctattagaatttggaaggctgtgaaggaatggaataatctgaacacagaaccaggattctttctgcccttttaggtttgctccagaattctagggtggtgttttcctgtgtcatggatgtggtgacctaatcatcgcgcatctgaaagtagttttctctttatgtcattctggggcagcagtaacagtcagcagactgagaagtcctcagtcaaaagctggcagaatggaaagggcttggaaatggtggagaacaatgtaa

SEQ ID NO: 26676 - DNA, 382 bp, Homo sapiens
cagccaacattatttgtaggccaggtgtagtggcttatacctttaatcccagcacttcgggaggccaacatgggaggatggcttgaggccaggagttcaagaccagtttgagcaacatagcaagactaaatagccatacttttgtatactattcagcacaaaaatgttaataataagaattaaataatactcattttagcttttgtgttcatttacaatgagcaatatattctttttaaaatttttgatgtgtaataattatacatatttagggatacagactgacattttggctcatgtatacaatgtaatgatcaaatcagggtaattagcatatctcttgcctcaaacacttatttattaattttgggaatattcaaaa

SEQ ID NO: 26677 - DNA, 594 bp, Homo sapiens
tcagtgataagatgagaaaattgaggcttagggaggtataatgtactttttctaaggtcacatggctagtacatggtagaagccaagtatgaattcaggacttttctggcttcaaagatctaggctcttacctgtactggatgtggcttccttgacttctttacaggttggagaattagggctaattggatgttctcactagaaagtgtgtgtgttggggggtgtgtggaggatgttctcactggaaagtgtatgtgtgtgggtgattttccttggagctattaatatttttgctactagttggtaagtttttttgttgttgttaaagctaataatgaagcttataatgtaataatataaatgtttagtaatagctaaactttttgcttgtgtgggtcagttttatataatcttaagttcttataattttttatctggaaaatttcttaagctttgatatttttaagtgcattgtaagaattaaaagtcagaaaaatatttcctggtaggggcctttgctttagaattttagaagccattaaaagagagggaaaagaaagtgatgaaagatagtttaatagctttactagaaat

SEQ ID NO: 26678 - DNA, 285 bp, Homo sapiens
ctggaacattcaggagctgatatgtgtttcaaaggcttgaagttctttctattttatatgtcagaggggaaatctagatttatatcagtgagctagaaaaatttatctacagagaaatgtaaaatgttaaagagatgtaaggaagcgaatcttttgaaaggaagacaaatatttatgtatatatcaggccatttgatttgtgctatttctccctaaagtaggactctgatacaaacaatgtagaaacaaggaggaagggacaaaataaaaaaataatttatttta

SEQ ID NO: 26679 - DNA, 341 bp, Homo sapiens
gagacagtgtctcactgtgtcacccaggctggagtgcaatggcaggatcttggctcactgcgacctgtgtctcccgggctcaggcaattctcctgcctcagacacctgaatagctgggaatacaggcacatgtcaccacacctggctattttttgtatttttagtagagacggtgtttcaccctgttggacaggctggcctcaaactcctggcctcaagtgatctgcccaccttggcctcccaaagtgctgggattacaggtgtgagccacctgaaaaatcattgtaaaaatcaactgtcctacattcttatttggaagtgactcctctaaccaaagacag

SEQ ID NO: 26680 - DNA, 870 bp, Homo sapiens
gccagtgggttaggtaagggcaggttatggcgggttttgatgtgcaatttgacttttatccttaaagcaatggggagttattgagtcttgagcagaggcatgaaatgagcagatttgcattttagaaaaattgtttttttctaaacagaaaaacagataggatgtaggtagctcaaggcaaggacattagatagaaggttgttaaagtagtcaggtgggaagtgacgtatagactaaggaggtaacagtattgacaatagaagatggattaaagaactcttaagttagaacctcaaaagtcagaagaatgtaggattatcagatttctggtatgagggactagagtttggtaactggagttttccactgatgttggtaatactagagtaaatcaagtttgtgaagagagatgaaattttcagtttaatctatgtagagtttaacatacctgtggtacagacaagcaaagatacaattgtgatttaggtcggaattcagcagagaggtctggactaaagaaacagattcaaatgtcataagtgtgtgagcggtgttgaaaccatgggttgggtgaaattaccattgagtacagatggccaggaatatccctaagggacataaacatttaaagaaccaccaaaaatgactgagaagtgctaagagaaaatgcaggagagaatactaacatagaagccaatagaagagagaatttcaagaaaaaagtaagagtttcgagaagcaaaagcaaagactttaaatatacagacaagagagtatccatcgaatttggcagcctccaaaagctgggcagcctccaaagtgtggtggctgaagccagactgaagaaagtcaagaaataaaagtgatgta

SEQ ID NO: 26681 - DNA, 828 bp, Homo sapiens
gagaattagacatttaataaaaatgccaggtgttccttgtcctcattcttccatatttgtcttatatatgtttagcaaaataattgagttaaatatgagcttttatgcttaagcgatggctgtgttttcgctcttaataaaattgcaccataaaatttgatttttagtgccaaaattataaaaaggggttgggcttgtttcctcaacctgaacaacttcttaccttcaagatggatgattcaaagaggaataatagggaatttcttagtatgaagttacttggttgttttcttaggaaaacaaaaggtagaatttaacagcatggggcctgatttaaatagaaaataaatgtacagatataatcaactctgctgtcatggggatttcaagttataaatgcaataagtaacatcccctgacttattctatgtacttttgccctaatctactacctattagtctgaaacttgagtttttaaatttaatctctatgtaaaagaggaataaattgaatgcataattaaaatatatgttgtcaattatcacacctttttgcctagactataagcttcatttttcctgttatatccactaaattaatttatgcttgtttttccattaaaacaagttactttggctgggtgcagtgactcccgcctgtaatcctagcactttgggaggctgaggtgggcagatcatgaggtcaggagttcgagaccagcctgtccaacatggtgaaaacctgtctctactaaaaatacaaaaattagccgggcatgggtggccggcacctgtagtcccagttgcttgggaggctgaggcaggaga

SEQ ID NO: 26682 - DNA, 1636 bp, Homo sapiens
tggcggggcggcaggtcccagagcagcgctcgccacctccccccggcctgggcagcgctcgcccggggagtccagcggtgtcctgtggagctgccgccatggccccgcggcgggcgcgcggctgccggaccctcggtctcccggcgctgctactgctgctgctgctccggccgccggcgacgcggggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatgaaactcggggaaaccagcccagctaagtccggagtgaaggagcctctctgctttagctaaagacgactgagaagaggtgcaaggaagcgggctccaggagcaagctcaccaggcctctcagaagtcccagcaggatctcacggactgccgggtcggcgcctcctgcgcgagggagcaggttctccgcattcccatgggcaccacctgcctgcctgtcgtgccttggacccagggcccagcttcccaggagagaccaaaggcttctgagcaggatttttatttcattacagtgtgagctgcctggaatacatgtggtaatgaaataaaaaccctgccccgaatcttccgtccctcatcctaactttcagttcacagagaaaagtgacatacccaaagctctctgtcaattacaaggcttctcctggcgtgggagacgtctacagggaagacaccagcgtttgggcttctaaccaccctgtctccagctgctctgcacacatggacagggacctgggaaaggtgggagagatgctgagcccagcgaatcctctccattgaaggattcaggaagaagaaaactcaactcagtgccattttacgaatatatgcgtttatatttatacttccttgtctattatatctatacattatatattatttgtattttgacattgtaccttgtataaacaaaataaaacatctattttcaatatttttaaaatgcattaagagaat

SEQ ID NO: 26683 - DNA, 202 bp, Homo sapiens
agggaaaggaaaaaaaaatccttcgcccaaaaaatttccctttcccaaaaaggtcgcacattttacgaatatatgcgtttatatttatacttccttgtctattatatctatacattatatattatttgtattttgacattgtaccttgtataaacaaaataaaacatctattttcaatatttttaaaatgcattaagagaat

SEQ ID NO: 26684 - DNA, 2026 bp, Homo sapiens
aagctgcagcaggaattcggcgaagtggcggagctggggccccagcgggcgccgggggccgcgggagccagcaggtggcgggggctgcgctccgcccgggccagagcgcaccaggcaggtgcccgcgcctccgcaccgcggcgacacctccgcgggcactcacccaggccggccgctcacaaccgagcgcagggccgcggagggagaccaggaaagccgaaggcggagcagctggaggcgaccagcgccgggcgaggtcaagtggatccgagccgcagagagggctggagagagtctgctctccgatgactttgcccactctcttcgcagtggggacaccggaccgagtgcacactggaggtcccagagcacgacgagcgcggaggaccgggaggctcccgggcttgcgtggatgcaagagacaggctggctgtcctggcgggaaggagcagaatatctgaaagcttcaaccatgaggtccagacacacgaggcctgcgtgagactcaggacaatggaaaactgcccccagtgccaccaccatcggacaagcaggcagcaagcaggcaggtagagaaggacagaagatcagtgtggagcagaacatggagaaaaagcctctgacactccagcaccagatagcaccagaggcctcaaagccagtggggctctgcaggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattaagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatgaaactcggggaaaccagcccagctaagtccggagtgaaggagcctctctgctttagctaaagacgactgagaagaggtgcaaggaagcgggctccaggagcaagctcaccaggcctctcagaagtcccagcaggatctcacggactgccgggtcggcgcctcctgcgcgagggagcaggttctccgcattcccatgggcaccacctgcctgcctgtcgtgccttggacccagggcccagcttcccaggagagaccaaaggcttctgagcaggatttttatttcattacagtgtgagctgcctggaatacatgtggtaatgaaataaaaaccctgccccgaatcttccgtccctcatcctaactttcagttcacagagaaaagtgacatacccaaagctctctgtcaattacaaggcttctcctggcgtgggagacgtctacagggaagacaccagcgtttgggcttctaaccaccctgtctccagctgctctgcacacatggacagggacctgggaaaggtgggagagatgctgagcccagcgaatcctctccattgaaggattcaggaagaagaaaactcaactcagtgccattttacgaatatatgcgtttatatttatacttccttgtctattatatctatacattatatattatttgtattttgacattgtaccttgtataaacaaaataaaacatctattttcaatatttttaaaatgcattaagagaat

SEQ ID NO: 26685 - DNA, 1982 bp, Homo sapiens
aagctgcagcaggaattcggcgaagtggcggagctggggccccagcgggcgccgggggccgcgggagccagcaggtggcgggggctgcgctccgcccgggccagagcgcaccaggcaggtgcccgcgcctccgcaccgcggcgacacctccgcgggcactcacccaggccggccgctcacaaccgagcgcagggccgcggagggagaccaggaaagccgaaggcggagcagctggaggcgaccagcgccgggcgaggtcaagtggatccgagccgcagagagggctggagagagtctgctctccgatgactttgcccactctcttcgcagtggggacaccggaccgagtgcacactggaggtcccagagcacgacgagcgcggaggaccgggaggctcccgggcttgcgtgggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaagggcctctgtctgctcctgccatccccgcagtgctggacatacatgctcagtgggaagcgtctgttgatttgagggcaaccccctcctcttttcaaaacctatgaaccacctgctttgcaggcaaactcccccgctggccagcgttgaaatggaagccatggaggctctgccggtgacttgggggaccagcagcagagatgaagacttggaaaactgctctcaccacctatgaaactcggggaaaccagcccagctaagtccggagtgaaggagcctctctgctttagctaaagacgactgagaagaggtgcaaggaagcgggctccaggagcaagctcaccaggcctctcagaagtcccagcaggatctcacggactgccgggtcggcgcctcctgcgcgagggagcaggttctccgcattcccatgggcaccacctgcctgcctgtcgtgccttggacccagggcccagcttcccaggagagaccaaaggcttctgagcaggatttttatttcattacagtgtgagctgcctggaatacatgtggtaatgaaataaaaaccctgccccgaatcttccgtccctcatcctaactttcagttcacagagaaaagtgacatacccaaagctctctgtcaattacaaggcttctcctggcgtgggagacgtctacagggaagacaccagcgtttgggcttctaaccaccctgtctccagctgctctgcacacatggacagggacctgggaaaggtgggagagatgctgagcccagcgaatcctctccattgaaggattcaggaagaagaaaactcaactcagtgccattttacgaatatatgcgtttatatttatacttccttgtctattatatctatacattatatattatttgtattttgacattgtaccttgtataaacaaaataaaacatctattttcaatatttttaaaatgcattaagagaat

SEQ ID NO: 26686 - DNA, 1829 bp, Homo sapiens
aagctgcagcaggaattcggcgaagtggcggagctggggccccagcgggcgccgggggccgcgggagccagcaggtggcgggggctgcgctccgcccgggccagagcgcaccaggcaggtgcccgcgcctccgcaccgcggcgacacctccgcgggcactcacccaggccggccgctcacaaccgagcgcagggccgcggagggagaccaggaaagccgaaggcggagcagctggaggcgaccagcgccgggcgaggtcaagtggatccgagccgcagagagggctggagagagtctgctctccgatgactttgcccactctcttcgcagtggggacaccggaccgagtgcacactggaggtcccagagcacgacgagcgcggaggaccgggaggctcccgggcttgcgtgggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccagtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatgaaactcggggaaaccagcccagctaagtccggagtgaaggagcctctctgctttagctaaagacgactgagaagaggtgcaaggaagcgggctccaggagcaagctcaccaggcctctcagaagtcccagcaggatctcacggactgccgggtcggcgcctcctgcgcgagggagcaggttctccgcattcccatgggcaccacctgcctgcctgtcgtgccttggacccagggcccagcttcccaggagagaccaaaggcttctgagcaggatttttatttcattacagtgtgagctgcctggaatacatgtggtaatgaaataaaaaccctgccccgaatcttccgtccctcatcctaactttcagttcacagagaaaagtgacatacccaaagctctctgtcaattacaaggcttctcctggcgtgggagacgtctacagggaagacaccagcgtttgggcttctaaccaccctgtctccagctgctctgcacacatggacagggacctgggaaaggtgggagagatgctgagcccagcgaatcctctccattgaaggattcaggaagaagaaaactcaactcagtgccattttacgaatatatgcgtttatatttatacttccttgtctattatatctatacattatatattatttgtattttgacattgtaccttgtataaacaaaataaaacatctattttcaatatttttaaaatgcattaagagaat

SEQ ID NO: 26687 - DNA, 1862 bp, Homo sapiens
aagctgcagcaggaattcggcgaagtggcggagctggggccccagcgggcgccgggggccgcgggagccagcaggtggcgggggctgcgctccgcccgggccagagcgcaccaggcaggtgcccgcgcctccgcaccgcggcgacacctccgcgggcactcacccaggccggccgctcacaaccgagcgcagggccgcggagggagaccaggaaagccgaaggcggagcagctggaggcgaccagcgccgggcgaggtcaagtggatccgagccgcagagagggctggagagagtctgctctccgatgactttgcccactctcttcgcagtggggacaccggaccgagtgcacactggaggtcccagagcacgacgagcgcggaggaccgggaggctcccgggcttgcgtgggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatgaaactcggggaaaccagcccagctaagtccggagtgaaggagcctctctgctttagctaaagacgactgagaagaggtgcaaggaagcgggctccaggagcaagctcaccaggcctctcagaagtcccagcaggatctcacggactgccgggtcggcgcctcctgcgcgagggagcaggttctccgcattcccatgggcaccacctgcctgcctgtcgtgccttggacccagggcccagcttcccaggagagaccaaaggcttctgagcaggatttttatttcattacagtgtgagctgcctggaatacatgtggtaatgaaataaaaaccctgccccgaatcttccgtccctcatcctaactttcagttcacagagaaaagtgacatacccaaagctctctgtcaattacaaggcttctcctggcgtgggagacgtctacagggaagacaccagcgtttgggcttctaaccaccctgtctccagctgctctgcacacatggacagggacctgggaaaggtgggagagatgctgagcccagcgaatcctctccattgaaggattcaggaagaagaaaactcaactcagtgccattttacgaatatatgcgtttatatttatacttccttgtctattatatctatacattatatattatttgtattttgacattgtaccttgtataaacaaaataaaacatctattttcaatatttttaaaatgcattaagagaat

SEQ ID NO: 26688 - DNA, 1252 bp, Homo sapiens
cgggagcgggctatgtagcaggcgtcgccagtgtcttctcggaagtcggagtcagtaatctcacgaggccagagatgacctctccccttcgggaaaagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatgaaactcggggaaaccagcccagctaagtccggagtgaaggagcctctctgctttagctaaagacgactgagaagaggtgcaaggaagcgggctccaggagcaagctcaccaggcctctcagaagtcccagcaggatctcacggactgccgggtcggcgcctcctgcgcgagggagcaggttctccgcattcccatgggcaccacctgcctgcctgtcgtgccttggacccagggcccagcttcccaggagagaccaaaggcttctgagcaggatttttatttcattacagtgtgagctgcctggaatacatgtggtaatgaaataaaaaccctgccccgaatcttccgtccctcatcctaactttcagttcacagagaaaagtgacatacccaaagctctctgtcaattacaaggcttctcctggcgtgggagacgtctacagggaagacaccagcgtttgggcttctaaccaccctgtctccagctgctctgcacacatggacagggacctgggaaaggtgggagagatgctgagcccagcgaatcctctccattgaaggattcaggaagaagaaaactcaactcagtgccattttacgaatatatgcgtttatatttatacttccttgtctattatatctatacattatatattatttgtattttgacattgtaccttgtataaacaaaataaaacatctattttcaatatttttaaaatgcattaagagaat

SEQ ID NO: 26689 - DNA, 1664 bp, Homo sapiens
aagctgcagcaggaattcggcgaagtggcggagctggggccccagcgggcgccgggggccgcgggagccagcaggtggcgggggctgcgctccgcccgggccagagcgcaccaggcaggtgcccgcgcctccgcaccgcggcgacacctccgcgggcactcacccaggccggccgctcacaaccgagcgcagggccgcggagggagaccaggaaagccgaaggcggagcagctggaggcgaccagcgccgggcgaggtcaagtggatccgagccgcagagagggctggagagagtctgctctccgatgactttgcccactctcttcgcagtggggacaccggaccgagtgcacactggaggtcccagagcacgacgagcgcggaggaccgggaggctcccgggcttgcgtgggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatgaaactcggggaaaccagcccagctaagtccggagtgaaggagcctctctgctttagctaaagacgactgagaagaggtgcaaggaagcgggctccaggagcaagctcaccaggcctctcagaagtcccagcaggatctcacggactgccgggtcggcgcctcctgcgcgagggagcaggttctccgcattcccatgggcaccacctgcctgcctgtcgtgccttggacccagggcccagcttcccaggagagaccaaaggcttctgagcaggatttttatttcattacagtgtgagctgcctggaatacatgtggtaatgaaataaaaaccctgccccgaatcttccgtccctcatcctaactttcagttcacagagaaaagtgacatacccaaagctctctgtcaattacaaggcttctcctggcgtgggagacgtctacagggaagacaccagcgtttgggcttctaaccaccctgtctccagctgctctgcacacatggacagggacctgggaaaggtgggagagatgctgagcccagcgaatcctctccattgaaggattcaggaagaagaaaactcaactcagtgccattttacgaatatatgcgtttatatttatacttccttgtctattatatctatacattatatattatttgtattttgacattgtaccttgtataaacaaaataaaacatctattttcaatatttttaaaatgcattaagagaat

SEQ ID NO: 26690 - DNA, 714 bp, Homo sapiens
cttagtagagacgggctttcgccatgttgaccaggctagtctcgaactcctgacctcagacgatccacctgcctcggtttcccaaagtgctgggattacatgtgtgagccactgcgcctggccaattaatttccttttaaatagcaacttgtggctagtggctgccaaatcagacagtgcaaatatacagtaaaggtggagtagtatcaaaatcagaatcaatgagtttgaccagataaattttcatgttcctgaaatgttgatctatctccagatagatgtttaggccatataatgagtttgtttatatttttttgtttgttttgtaactgattcctttaattattctagtaaaaagtctagaaaagtacagcttcaaagctgcaatagcacttaaggagcatcagtcaagtcctctcacctcagttcatcttctgatctctcaggcttttaaaactcagatgtttgttttcaccttgtcatgtttcattgcatctttgatcacttctgcagcagttctccagagaaaagattataggtagtaactcataatatccctttagtatcaagaactggtatttactatatactcattggctaacatgtttcattatctggagctttgggactcattgcctccagggtaactacctcagaggcgacatgctaatccttatgtgagtttcccttccttctctccagggtgacaccata

SEQ ID NO: 26691 - DNA, 381 bp, Homo sapiens
aattctagttggggatcccccagggtgtcccctaccaaaaagttggggtttttatgtttttttttttgtttttaaactcctgaccttcaaataataaaaatcaattcctttgataatttattttgggtgcagttgggtgttatactttcctgttgtacatccccagaagtgtgtaagctctgaaacagtggaaggcctgataaattctatttcatttctgatgaccaccatatgtacaagttaaaagattgaagtttcttttccaggattaataccagggagcaatttagccactaaagcaaatagaactaaaagggaagctttcttaggcccctattttgttaatttcctcaagatacttggaaaataatatttaaaaaa

SEQ ID NO: 26692 - DNA, 380 bp, Homo sapiens
tgaactaccaaaagttttgctgtagatcaggggttggtaaactacagcccacctgcttttgtagtctgtgaggagggaatggtgttcccatttttaaatggttgggttttttttttctttaaggtagaatatgtcagccgggcgcggtggctcacgcctgtaatcccagcactttgggaggccaaggcgggcagatcacgaggtcaggagatcgagaccatcctggctaccacggtgaaaccccgtctctactaaaaatacaaaaaattagccgggcgtggtggcgggcgcctgtagtcccagctactcgggaagctgaggcaggagaatggcgtgaacccgggagacagagcttgcagcgagctgagatcatgccactg

SEQ ID NO: 26693 - DNA, 454 bp, Homo sapiens
ccactacaccaagttgcctaccctgtttcatctgaaaagtatgtgatttaagagataaacaatttcacagcattgtgcagagagggtcagaaattctctcaagtgcccctggggtatcttctagagagagggggatttttagaatgctattaaaacgtccaaagggcaaatgcagaaatccctttgtagtcttcagacaccaacaaagctggtccctataccctctgtcctcttgtccttccttctgtggcagacaccaacaggtgaagggagctggcctggctgagctgcatcaagacctttccccactagtgcgttcaaggccagcacaagagagcacttcacctgtgcttcactaggcagtgtggttgcacagctcctcctctcaacacagggtgctccctcaagggccctccacattagaagggtgtcaggttcagacacctcctcagca

SEQ ID NO: 26694 - DNA, 688 bp, Homo sapiens
ggggaaggagagagtggaaactagaaaggcatatataagaataggaatcttgtggaatgagggagttgaaaggacaggaattattaatagaggaaagttttggaggagcagtgaagaaaaagggatctagtgcacatggttgcttcttttcttgagcccaaagaggtaaggataatttttacctgggaaaggaagtatgggaaatttatgtcctatacatttgctgtggagaaataaacagtcatttgccaagaatgatagatacaggatagtagccttaagagaatcatcatgaggaacttggggagtaaagctgataaggaatactttgaaaaaaaaaaaaaaaaaaaggctcctgagctactttgaggaagatcttgaattcatagtggtactggtccacaattttgatttttctctatcaaaacttagaagctgtggttcaggaatgttgaagatgagtgcttaggatcattcaggattgggtatgattaacaggatgaatatgatcaaaaaataatggggatggggtaaaggaattcttcaagacacaagctcaggcttcgtcttttccttgaaatggcccccattggtcttttctcttttaattttgtacttttctctgctattgctgccttatgtttagtccattagaatttacgcacacacacatacacacacaccctta

SEQ ID NO: 26695 - DNA, 507 bp, Homo sapiens
ttccaatctatgctttattgttaaaaaaaaattccaacacttaggaacaacgcaaacacccacctagatacagtgtctaagggaaacttggtaacgtcgtttaaaatagaatagtctgaaccagtagttcttaaattatgcttatggagcacactatgtttttttatgccagatttaggtattctgttattaaaatcaaataatagtagtgggtttttttttagcattttaaaacaaaaaaagtcagttaattaagatttcttaatcttaactctgttgcaataatttttttaaattttgctttaacactcttattgaaataaataagtagcaaatacagtggaagactggaagatatcctattacccttaatttagcatactgtgtttacccgttttggggaaaagagttagagattatgctatgtgtttgaagcatataatattgtcatttgctggaaaaaaattttagattgaacaatcgaattaaatatatcatgtcatggta

SEQ ID NO: 26696 - DNA, 351 bp, Homo sapiens
gtgcagacaaagccctgacgaatagaggcctgcgcagagtgcccggggtgcagggcagcagggcagccagtgaaccactgagctcgcactgtagccagtcctgtgtgcccctgctggattctgcttctatgagggaggcagcaaggagttgggacttcacaggtgaaaggacttgccagaggcagagtctcgttctatcacccaggctggagtgcagcggggcgatctctgttcattacaacctccgcctcccgggttcaagcgattctcctgtctcagcctcctgagtagctgggattatagagggtcttactttgtcgcccaggctggagtacagtggcatgatcgtag

SEQ ID NO: 26697 - DNA, 541 bp, Homo sapiens
ttcttttttgccttctctgcctctctcactcttaccctctttaacaactcctgagatgcactcaaagaaatagggagtttaatccattttgactcaggtgcttgaactcacttagaaggccttagagatgagacatctcaggaagtaattaaggttaattggagttacaggggtgggccctgatctgatagaattattgttgtcatgagaagaaagctggctcttaaccaccctccctccccctcccaccaaaatgtaccaaaaaagaggttgtgtaaggacacagtgagatggtggccacctacaagccacgaaaagagacctcagaatggcctgtgttgctggcaccttaatcttggatttcccaaaacaaagttggctgggtatggtgacacacccctgtagtcccagctactcgggagactgaagcaggaggatcactggagcatcgctggagcccaggaatttgaggctgcagtgagctatgactgtaccactgcaactccagcccgggtgacagggcaagactctgtctccggaa

SEQ ID NO: 26698 - DNA, 374 bp, Homo sapiens
ggtgttgttttaaagttgaagtgttgtatgttttagcagttttcccatgtactacctttaagaatttatgtaaacaaatacattcccattactgtctaatatatgctatgttacttttttcacagtatgtttttgaggaatatgattcgtaatacataaggaatttgtgctgtaacatagatcgtgatgttggtgttatgttgaatttatttttcatgctcttgatagacttttaaaaatcagtggtgccggctgggcatggtggctcacgcctgtaatcacagcactttgggaggccgaggtaggaggatcacctgaggtcaagggagtttgagaccagcctggccagcgtagtaaaaccctgtctcttctaa

SEQ ID NO: 26699 - DNA, 383 bp, Homo sapiens
ccaagccccaggtctgccaatcaatttattgtacctctaacatcatctaacctccacctctgtgactggttcacaggtgggcatatcaatcacagtggtccaatgagccttgagccagaacttctgctgggattactggaaaaaaagctcatttattgccagagttcctgcaagcttggagctgctagaggccatctttgcaacctcgtggggagatctttcgggaaaatgaaaccatcacaaaggcaagcagagtctagagactgaaacagatttctgtcaacatcctatgggcccttgctcccagccatgcctgaagttggctgtacctccgggacctagacattttagttactcaaaataataaattctcttgtgtccga

SEQ ID NO: 26700 - DNA, 464 bp, Homo sapiens
gaaattaaatagatcaaagaatgagccaggccggatactcattatatctatgggtaacaagaagtattagcaattgcacagatttctccctattcatttagtcggtagcaattctatcatatagcattccaggaatgggttaaattaaaacagacagtactaactctataaaagagatcactagtacaatttgaacaaacagttgcattagggatattagggatgttgctgaagttacccactaggtggactaaaggatctcaggttttttaaagattcagatttgacataacagattcaacatgctgtcagattactcacaaaaactaaggattgtgaaactttaaccatagccttattctgccaagcgaaagaagtaggcataagcaaggaaaaattaagaggggtaagaatatcataagaagtcttcgtctgatggccttgggaaaagctgtccacggcat

SEQ ID NO: 26701 - DNA, 369 bp, Homo sapiens
ctcgccattttacagatggggaagccgaggcacagacaggttaggggacgttctccggctcacacagctcctggcttgtcagacccaacatcagatgactcgggcgggcccagaaccctcacttggaaaccccacttccaggtcctgtccccacctcacagcggacatcacagcggtgacagcaccgtcattacagggcacgctggaaaatcagattcctgactcggagagcaggacggacattaaagctctgaggaagacaccagcagatgaggaaaggcggtaaagctgaatccacagaaggattttacttcgtccaaagaaatctactggtggggatgctggcaggcctcggatttctccatcaaa

SEQ ID NO: 26702 - DNA, 655 bp, Homo sapiens
tattcaccgtctatgcggtcccaagttttcccaaagcgaggcagtgccccaaaggtctgtgctgaggagaatgctgctctgccttagcggtgtcccccgggtctgtgctgagcagaacgcagctccgcccttgcggtgcccccggcccgcctgggtctgtgctgaggagaacactgctccgccttcgctgtatctctgaagtctgtgcagaggagaactcagctccgccctggcgatgctctccttgtctgtgctgggaagaacacagctccgccctcgcaaaggcgcacagcgccggcgcaggagcagagaggcccacagcgctggcgaaaggcgcagagaggcccacagcgccggcgcaggcgcagagaggcccacagcgctggcgcaggcgcagagaggcagaaggcccatgaggggaaggtgagacacctggggcaaagaagaaaaaaaaatgcgccgcgaagcggtgtctgggtcatccagggacgaaagttttttcccatcagcccttgcgctgggccccagggacccgggcatccctggttcacgcccagggtgtgcctcaggcgactaggggtaccccaacttggacagaaggcccgtgagtggaagttgaagtttgtgggaggagagatgaggcaccaggggcaga

SEQ ID NO: 26703 - DNA, 291 bp, Homo sapiens
ccagctgacagccaccacctgccagacataaaagatggaaattcatttctgctaaagagaaagaaaaaattggaagacagggtgaaggtgaacaggcccattataagaaagaaacaaaaatctatattctgtctacaaggaaacgagagagagaaagagagagaagaaagaagttccaggattctaatgtaccaaagggatctcctttttcttgttttgttctgaaaatttcaccaaaagagcacaggagaacatcttggctaattcattggcgatgatgtaagaaaactg

SEQ ID NO: 26704 - DNA, 496 bp, Homo sapiens
caacagagcgagactccatctcacaaaaaaaaaaaaagaaagaaagaaaatggtgcagtttggactaacagatacagcgacatcaaaatgtttcctgggtctgttaagtcctgggtttgtttagtgaacgttattaatctgttcctgtaaccctaaacatcttgtgactactaagaatgcagccaacaggtctctgcctgattttacctactgcctcttcaagatggaattgctctggttccaatgcctctgacaaactggctgcttgatctctaggttgtgaccatgtcagggatagaggcagcttaggtagaggtagactttcttgtactcaacattgaattgtggcttagttaaaatcagaactttcattcttggaataatacagtattgtaagggtaagccaaatgattaacacatttacttaattacacattgtagcattgaaataactgatgcctttctaatgcaaataaaaaagatttatgtatatgat

SEQ ID NO: 26705 - DNA, 360 bp, Homo sapiens
tgagacagagcatcttgctctgtcgcccaggctgaagtgcagtggtccaaccttggctcactgcagcctctgcctcccgggttctagtgattcccctgcctcagcctcctgagtagctgggattacaagcacacgccaccacgcctggctaatttttgtatttttagtagagacaaggtttcaccatgttggtcaggctggtctcaaactcatgacctcaggtgatccaccacctcagcctcccaaagtgctgggattgcaggcgtgggccaccgcgcccagccttgtcataatttttaatgactgaatgatatttgatcatgtggatgtactatttttaacaatcttttatggctagat

SEQ ID NO: 26706 - DNA, 699 bp, Homo sapiens
ataatgcctgttctccaggcatccaaagagtcaaagagccaagagacagtaagtttaatacttgtatttgctccagctactagagcacacagagagtagctcttcagttaggagagagaagtcagggaaggcctccacagagggttattttagctgagctttatagaaaaacatggggaaaggacttgaaaaagtatgtaggtgacttttagtatcagctccaacatgtaaagagcttggaagtcatcacatccctcctcacagcaaaaacaaacaaaaaactgtacagattggaatatcaatggcttttcttagatccatggaagaattaaagtcataggacaaaccaccactcaaaaccctggagagacaggcaaatacagagaatcacaattgggatcagcttactgggagaagaggctgctggtcagtgactgctaggaacactaaaatgaactccaggtttgccagccttcggactccggaacttacaccagtggccccctggatcctgaggcttttggcctcagatggatagttgcaccatcagctttcctggttctgaggcctttggagttggactgaaccatgctaccggtatcccaaggtctccagctttcggatggcctcaccgtgggtcttttcagccaccataattgcatgagccaagttccctaataaatttcctctcatatccta

SEQ ID NO: 26707 - DNA, 546 bp, Homo sapiens
ataatgcctgttctccaggcatccaaagagtcaaagagccaagagacagtaagtttaatacttgtatttgctccagctactagagcacacagagagtagctcttcagttaggagagagaagtcagggaaggcctccacagagggttattttagctgagctttatagaaaaacatggggaaaggacttgaaaaagtatgtaggtgacttttagtatcagctccaacatgtaaagagcttggaagtcatcacatccctcctcacagcaaaaacaaacaaaaaactgtacagattggaatatcaatggcttttcttagatccatggaagaattaaagtcataggacaaaccaccactcaaaaccctggagagacaggcaaatacagagaatcacaattgggatcagcttactgggagaagaggctgctggtcagtgactgctaggaacactaaaatggtaattatttagatattttcttaaatggtaaaaataaatatatataaaaaagtaaaatggtaacgttaccattcggatgttgggagcggccg

SEQ ID NO: 26708 - DNA, 1225 bp, Homo sapiens
aatcaaacttgggtttgtctaactccagagtccttcctagtaattaacctccggtgctctgaactgccatgcaaaagaatgtgaacttcattctgaagggaatgggaaggtcgtggaaaatttttaagcatgaaagtgacaggctcaaaacagcaacaccaaccaaccaaccaaccaacaaaaaaccctcagtttttaaaagatagctcttggccgggcgcggtggctcacgcctgtaatcccaacgctttgggaggccgaggcgggcggattcacaaaatacaaaaaatacaaaactacaaaaaattaggccggacgtggttggtggggcgcctatagtcccagctattccggaggctgaggcaggagaatcgcatggacccggtaggccaaggttgcagtgagccgagctcgtgccactgcactccagcctgggcgacagagcgagactccgtctcataaaaaaaaaaaaaaaaaaaaagatagctgtcatacggagtggaagctcaatggcagggcagaaagaccagcctgactatgtaatctactagaccagagctggcgaggacttcagttaaggcatggtcatgggtggacggagaaaaggtgatacaattgaaagtcagaagacagatttagtaatatttggaactcatgagatttggacagaggacaagaggaagggacacccaaccagaacagatggggctaatgaaggtgtcttccaggaagatggggaatgtggaaagaaacaaatgggcttggaaagcaagatgaggcatgtggttttggaaataagctgggtttgaagtgcctagtatccatccagaaggacctgtctaccaggcagttagaaacattggtgtagccaggcacagtggctcacgtctataatcccagcactttgggaggccaaggtgggaggagggcttgagcccaggacttcaagaccagcctgggcgatgaagtgagaccctgactctacaaaaaataaaaaaaattagctgggcctggtggtgtgtgcccgtagtcccagctactcagatggctgaggtgggaggacccctgaacccaggagtccaaggttgcagtgagctttgattgtgctactgcactccagcctggacgagtgagaccctgtttctctttctctctctatctccctctctctctctctctctctctcacacacacacacacacacacacacacacacacacaaaat

SEQ ID NO: 26709 - DNA, 403 bp, Homo sapiens
tatttgactttaacacccctggtgaaaggtttcatcttctacttctacttaagacttttcattttctctttgttctggcacctagaaacttccctaatgtgttttgcactggactatgtattaaaacagttttctttttaaattttgattttttagttgtacttcagagcacattttaatgttttgaccagagaagtatattgtttctagtaatgaaacactgcaagtaattaaaatgtttaacaatagttaactgctgaaataaattataacgtagttgtagggtgaaataatatgtaattattataaaaatgtagttgaaatataataaagtagatagtatatgcttgtgacatattaggttagaaagcatgatacaaaattatagaatgttaattatgta

SEQ ID NO: 26710 - DNA, 490 bp, Homo sapiens
ccacagtttcctgcggctgtctgcacacccagaccagagcagttcctgcctttgcgctttgcaccattttccttggtgaacttctattcatccttcaaagcccagcagtaatcatcctttagaaagtcttctttcagagggaaccaaaaaggtaatcgctggagacagacagatgctgcctgaatgcctgttgtgttgtgtggttgtgggaatgttacttcacctctccgtgcctcagtttcctcagctgtaatggggatggtaacagtgtctaggggtactgcttggaatgcacatagggagatgagtgaaggcccagcactagaagagtgcaggcactagcagagtgcaggcgcaattgctgctgggaccagcaggtaactcgcatccaagttacagtgcccagccccagcagcagcctcagcaccaggcagagtgtgctcagcactgtggggggccaagaggacttgagggccgctggtctgtgatt

SEQ ID NO: 26711 - DNA, 437 bp, Homo sapiens
ccacagtttcctgcggctgtctgcacacccagaccagagcagttcctgcctttgcgctttgcaccattttccttggtgaacttctattcatccttcaaagcccagcagtaatcatcctttagaaagtcttctttcagagggaaccaaaaagaatggggagaattgtgcctgcccagcctcctccttggggactccaggggcccaaagaaccaagagctgcaaatgtcctggtggccttggaagtttatggatggtacagatctggggtggagggcatggccaggacagggagggctgtcagagagagggtctgtgggtttgtggagtgtggggatcagtcgctgactcattagatgaaccaggagcctgcatgctacagcccacctgccaaatcttgcccccacctgctttttaaaataaagttttattggaacatg

SEQ ID NO: 26712 - DNA, 500 bp, Homo sapiens
cgagacaccgtatctgagggcttgggtggaactgaggagagggcggctgggaaggccatccgggaggaaagggcagacggctacggcagcgtcaggtggtacagtttgccccggaagtgaggtaaagaagagagcgggaggagagagggccacatgcctctcagccatggccctgaatgctggcttggctgagcctcatctttgctgtttgcagaatggggagaattgtgcctgcccagcctcctccttggggactccaggggcccaaagaaccaagagctgcaaatgtcctggtggccttggaagtttatggatggtacagatctggggtggagggcatggccaggacagggagggctgtcagagagagggtctgtgggtttgtggagtgtggggatcagtcgctgactcattagatgaaccaggagcctgcatgctacagcccacctgccaaatcttgcccccacctgctttttaaaataaagttttattggaacatg

SEQ ID NO: 26713 - DNA, 399 bp, Homo sapiens
caggcactgaagtcagaactgcatgagtttaaaacagccagctctattgttttccagccatatgaccttggccatgtcccttaatctctgtgggcctcagttgctacacctgtgaagtagaagcaatgatcatgccatcttagtggattcctatgaaaattaaatgagatactccatataacgcatttagaatagtgtcatgatatggtatatgaaggctctcaacaaatgttagttaccatttttcaaagtagagatacaatgttaaattaaacaacatggggccaggtgcaatggttcacacttgtaatcccagcactttgggaggcccaggtgggaggatcacttgagcaacggagttcgagaccagcctgggaaacacagcaattccctgtctcc

SEQ ID NO: 26714 - DNA, 3067 bp, Homo sapiens
agagaaaagaggagaggagaggaggaacagaaaagaaaagaaaagaaaaagtgggaaacaaataatctaagaatgaggagaaagcaagaagagtgacccccttgtgggcactccattggttttatggcgcctctactttctggagtttgtgtaaaacaaaaatattatggtctttgtgcacatttacatcaagctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaaccctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgacccttagacggaaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgattttttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacac

SEQ ID NO: 26715 - DNA, 2886 bp, Homo sapiens
agagaaaagaggagaggagaggaggaacagaaaagaaaagaaaagaaaaagtgggaaacaaataatctaagaatgaggagaaagcaagaagagtgacccccttgtgggcactccattggttttatggcgcctctactttctggagtttgtgtaaaacaaaaatattatggtctttgtgcacatttacatcaagctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaaccctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgagtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgacccttagacggaaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctccagcctggcgacagagggagactccatctcaaatta

SEQ ID NO: 26716 - DNA, 2111 bp, Homo sapiens
agagaaaagaggagaggagaggaggaacagaaaagaaaagaaaagaaaaagtgggaaacaaataatctaagaatgaggagaaagcaagaagagtgacccccttgtgggcactccattggttttatggcgcctctactttctggagtttgtgtaaaacaaaaatattatggtctttgtgcacatttacatcaagctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaaccctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctccagcctggcgacagagggagactccatctcaaatta

SEQ ID NO: 26717 - DNA, 1880 bp, Homo sapiens
agagaaaagaggagaggagaggaggaacagaaaagaaaagaaaagaaaaagtgggaaacaaataatctaagaatgaggagaaagcaagaagagtgacccccttgtgggcactccattggttttatggcgcctctactttctggagtttgtgtaaaacaaaaatattatggtctttgtgcacatttacatcaagctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaaccctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtgagtgacgggctctgagtgggaggtgggcagggtccaggggaggcaggggtgggttctgtcctaggttcagtctcctctggaggtggtgatatagacaggctcctcccctgcttgggcctcagtttctccaaatgtaaaggtgagaggcctgcgggtggg

SEQ ID NO: 26718 - DNA, 257 bp, Homo sapiens
aaagggatgtaatcggatcacccggggaacagtgaggaaaattgactccagggggtcaggaggattcaaggacaccccccaccactgtctctctccagcagagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgag

SEQ ID NO: 26719 - DNA, 2962 bp, Homo sapiens
agagaaaagaggagaggagaggaggaacagaaaagaaaagaaaagaaaaagtgggaaacaaataatctaagaatgaggagaaagcaagaagagtgacccccttgtgggcactccattggttttatggcgcctctactttctggagtttgtgtaaaacaaaaatattatggtctttgtgcacatttacatcaagctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaaccctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgacccttagacggaaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctccagcctggcgacagagggagactccatctcaaatta

SEQ ID NO: 26720 - DNA, 2911 bp, Homo sapiens
agagaaaagaggagaggagaggaggaacagaaaagaaaagaaaagaaaaagtgggaaacaaataatctaagaatgaggagaaagcaagaagagtgacccccttgtgggcactccattggttttatggcgcctctactttctggagtttgtgtaaaacaaaaatattatggtctttgtgcacatttacatcaagctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaaccctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgacccttagacggaaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctccagcctggcgacagagggagactccatctcaaatta

SEQ ID NO: 26721 - DNA, 411 bp, Homo sapiens
ggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggtgagctgacactcaggggtcccagccccagactctgccctcaggaagggggacggctctcaggggcttctccctctcacagcccagccctggggatgacgcgggtggtctgagccacatttaacacggtgcctccttctctcctaggagcctacatcaaacccaccctctcagcccagcccagccccgtggtgaactcaggagggaatgt

SEQ ID NO: 26722 - DNA, 435 bp, Homo sapiens
ctaaagtttatgtgtctagtccttctaaaattctgtttcctgtggatctacgatagggacagctgttctctgcctgggactgtcttttccccataaccctctacttctactcagttttgaagacctagccccaagaaacctcccctggagacctctcctggttctccccagcagagccagcccctctctccccgcccctgtgctcccagagaccccacctagggcatttagcttgttctagaattattcatttgcatgcctttctctagactggactggacatcttgctcatcttcgtgcctctggtccagcccagagcttgacctgtagtgtgtagtgggcccgtgttgattaaatggactaagacaccgaccccctaaaaaggctggggtgctaaggagctgggcatggagcaggaaatgagctgtccctgaa

SEQ ID NO: 26723 - DNA, 382 bp, Homo sapiens
tgtcatgtgtttagggagcagccaaggtgaagttttcaaccaggccgaccaacttcagagtccactggcttcaaaacagtgctttacatcctccttccaacattattcacaagccgatcaagactgagagagtcacaagtgtgtgaaacctgtattctttctgacttcattttccctggtaagatggttacttgcccaccaatctggcttatgctacagtgaaacacaacttctttatggttaacgtttttgtctgtgctcattctttagctgtaatcaagagggtggcacatcttccaataggatatttatcctgtgtattttccaaaaactggccatgcagtcactaaacatggatcagagagaggttcatggaaattat

SEQ ID NO: 26724 - DNA, 620 bp, Homo sapiens
cttagtgcaagtaagagacgacctcaaaaaaaaaaaaagttggacaaatgaagagtgtattttctcatcactggtatttttctagaagaaattacagcagagattagaaatctaatacaaaatgtcgtaatcatcttatgttctcttctttgaggtagactaaaagagcatcattatatttgaagaaaccaagattgaatgttcattggcttggcagtttttaacacagtgcagtttggaacatgtcccagttcttgtggatcacatttatggaaactcttaaaggactttaatgcccctccctaatcctttttctactgtaaaacctcattaatatatcctcaatgtataatttattagtaataaggatttgggtcattcgagatttaaaactttgagataagttggatattcggaataatgtaatgatttgtaatataggtcttaaacatttaaatagcttaactcattgtttaagactagtcatcagctatatttgagtacatattccccacagtaaaactattttcaataatattactatgcatctttgtaagtgccttataatttgggcttttaaaaattgcctgcgctttcttcccttaatttagcccatttac

SEQ ID NO: 26725 - DNA, 475 bp, Homo sapiens
aaaatgtgttttaggattattgaaacaactttaaatacctggccatttttttttttataatttctcagccactattacttattttccaatgccctattattgttctactctttattgatataaataaaaacagattatctgttaaagttgtcatttaaaatataagtagctttaaaaatgttttaattcctgttaacatcttttcttgcaacaaatgtttactaagtaatgactatatgccaattattgttctaagtactggggatatagtggtgaacaacacaggcaaaactccctgcccttctagagctttaattctttttttttttttttaagaatgaatcatccattttattttattttgtcatgtgctcaacagcatctctctctctctcccctctccctggcaggtcacagagataaattaaaaataaaatctacaaggaaaataatttatgaaagcactcccaggttc

SEQ ID NO: 26726 - DNA, 519 bp, Homo sapiens
taaagatgacaaaattttggttaggaaacgctgaacaaggatttgagttttaataatcctatgccaatgcaaattccattacactacagtgtcaatgattaaggctcaccttacatcttacatccacacagaagccatttccaactaccatgaactgcagagatgacttactttcccaagcatcctttcgcttttgactaaattactttcttaagacatcttccttactagactgagagccccttggatgtagcgggtataacttcttatccatgtttatgtattcccaatgcctagcattgtgaccacacattgtatgtgctcaaaaactgcttgctgaattgaaatgaactgagcctttagttatggagccatgaaataatttcctaacctcttaggtggtagaagcatttcttccatagaatctctgacacagttatccagattcaactagcatatttctaaaataggacacttactacttcacaaaacagcctattctacttatttaacagttat

SEQ ID NO: 26727 - DNA, 326 bp, Homo sapiens
acctcaacctttgtgatgatatgcaatattgcaacactggcgtaccttccttaccttttaggttaacacaaatccagttctagccagacttctgaacagtaacaactctggaaaaggtgcatttagagtttagagctgggaaagattgctggcaacagttccaattccctgccaagttctgtgcttgaggctgaaaagcaaggtgctattttatttattagacttcacagaaagacactggagatctcaagagaccaacagtccagtctgtaaagttgttatatccacaatcagatcagctaggtccataacggggacacatatgg

SEQ ID NO: 26728 - DNA, 754 bp, Homo sapiens
cttgtcatttctttgtggtgacaacattcaaaatcatctcttccagctattttgaatttgtgcattattttgataaatttgatagaatagaaattaatttaaaagggtacaattttaaaactgcaatgtgatgggatcaaatttaataatttggaaaattcgcttatgtagaagagtcatgcctctctaagaatgctcaatgaactggcataggtgggcacaagcaccatcagcatggaagggttcctcctgatgtcactggccactaaggcagttggtggggtgagggtggggatgagagccaggcatggcagcccttaggtggtcaccatttccctctcctggcagcctgtatttgcttgggagacctatctcttgggtatagatcctattgggctgctaaagaagagaggtgctaatccttttaggatgacttctgggaattcaccaggatgccctgcctctcctactctggacatggaaaaaaatgctgggtttaccaaaggtggatgagtcaggcccaggactagagccacggggcctctccctggacgtgccatagtcaggctgtctcggcagctaaaagaggctacacacatttattgtcatcagaagctgggacagatgagccttgggttacaagatctcctacctggagctctcccgggaggtgccaatcataggggatgggaggacaaacacatgcttggtggggctccagcgttaccgccgaggtgcatctccttggccacta

SEQ ID NO: 26729 - DNA, 549 bp, Homo sapiens
gtcattttattttttcattttatttttagcaagcacagaacaggtgggaaacacagcttagttggaatggaacaaaggcagatttgatacttttttaggagcttttacaatataatctattctttaatggatagcgttatgagagaaaataagattataatggaataaaaagtggtctaatgttcattattcaatttagtggatatgttacaagattatttctaaaatcttttgtagattaaactagatgcctttcttgattctgtgactggtattactctatcatgatttctgagacctttactaagaatgtttttctgaacatactaaagcatattatgtaaaagatagtgagctgtggtgcaagatcctatgcagcatggcccctggtattatgactacctctccaccgatttatacatagaatttacgtggtatacacaggttggcaaatactgtaattattataaaatgatttttcaaaatctgtatttgtatctaacaaaatactaaaaaagaactgtgtcaaaataaaatgttagaatttca

SEQ ID NO: 26730 - DNA, 343 bp, Homo sapiens
aaacctcaacaagcatagcatgatgtatcactggatttcttaaaccatttttgattgtcgtttgacataatactatttattaatctttagaaagtgttcaatgtggtttgaagtaatgtcttggcaacaagtggagagagattatcccagagagaagcattgtggagaaggtaaatacccaggtcctgagaatcaggctgctctccaccgtttccctattgatcatcacctgttctctttggcagtttgcctttggatcattttacagctcttttactttttttctccctgttcagattccttgttagctagcaacactaggctgagttttgaaatgagataa

SEQ ID NO: 26731 - DNA, 193 bp, Homo sapiens
ttttttgtagagttggcatctctttatgttgcccaggctggtctagaactcctggcctcaagtgatccttccacctcagcctcccaaagcactaggattaccagcatgagccactgtgcccagcttattcacaagtactgacgaagcacctgctgttccccagggctctccaaagcctggaggacacagcatg

SEQ ID NO: 26732 - DNA, 2728 bp, Homo sapiens
ggggacactggatcacctagtgtttcacaagcaggtaccttctgctgtaggagagagagaactaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcgttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaaggagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaagtgcctcctttggtgaaggtgacacatcatgtgacctcttcagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctgggagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacgcagcctgcagactcactgtgggaaggagacaaaactagagactcaaagagggagtgcatttatgagctcttcatgtttcaggagagagttgaacctaaacatagaaattgcctgacgaactccttgattttagccttctctgttcatttcctcaaaaagatttccccatttaggtttctgagttcctgcatgccggtgatccctagctgtgacctctcccctggaactgtctctcatgaacctcaagctgcatctagaggcttccttcatttcctccgtcacctcagagacatacacctatgtcatttcatttcctatttttggaagaggactccttaaatttgggggacttacatgattcattttaacatctgagaaaagctttgaaccctgggacgtggctagtcataaccttaccagatttttacacatgtatctatgcattttctggacccgttcaacttttcctttgaatcctctctctgtgttacccagtaactcatctgtcaccaagccttggggattcttccatctgattgtgatgtgagttgcacagctatgaaggctgtacactgcacgaatggaagaggcacctgtcccagaaaaagcatcatggctatctgtgggtagtatgatgggtgtttttagcaggtaggaggcaaatatcttgaaaggggttgtgaagaggtgttttttctaattggcatgaaggtgtcatacagatttgcaaagtttaatggtgccttcatttgggatgctactctagtattccagacctgaagaatcacaataattttctacctggtctctccttgttctgataatgaaaattatgataaggatgataaaagcacttacttcgtgtccgactcttctgagcacctacttacatgcattactgcatgcacttcttacaataattctatgagataggtactattatccccatttcttttttaaatgaagaaagtgaagtaggccgggcacggtggctcacgcctgtaatcccagcgtgctgagattgcaggtgtgagccaccctgcccagccgtcaaaagagtcttaatatatatatccagatggcatgtgtttactttatgttactacatgcacttggctgcataaatgtggtacaagcattctgtcttgaagggcaggtgcttcaggataccatatacagctcagaagtttcttctttaggcattaaattttagcaaagatatctcatctcttcttttaaaccattttctttttttgtggttagaaaagttatgtagaaaaaagtaaatgtgatttacgctcattgtagaaaagctataaaatgaatacaattaaagctgttatttaattagccagtgaaaaactattaacaacttgtctattacctgttagtattattgttgcattaaaaatgcatatactttaataaatgtacattgtattgtaaaaaaaaaaat

SEQ ID NO: 26733 - DNA, 859 bp, Homo sapiens
ggggacactggatcacctagtgtttcacaagcaggtaccttctgctgtaggagagagagaactaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcgttcacactctctgcactacctcttcatgggtgcctcagagcaggaccttggtctttccttgtttgaagctttgggctacgtggatgaccagctctcgtgatccgcctgcctcggcctctgctgagattgcaggtgtgagccaccctgcccagccgtcaaaagagtcttaatatatatatccagatggcatgtgtttactttatgttactacatgcacttggctgcataaatgtggtacaagcattctgtcttgaagggcaggtgcttcaggataccatatacagctcagaagtttcttctttaggcattaaattttagcaaagatatctcatctcttcttttaaaccattttctttttttgtggttagaaaagttatgtagaaaaaagtaaatgtgatttacgctcattgtagaaaagctataaaatgaatacaattaaagctgttatttaattagccagtgaaaaactattaacaacttgtctattacctgttagtattattgttgcattaaaaatgcatatactttaataaatgtacattgtattgtaaaaaaaaaaat

SEQ ID NO: 26734 - DNA, 909 bp, Homo sapiens
ggggacactggatcacctagtgtttcacaagcaggtaccttctgctgtaggagagagagaactaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcgttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtcctgcccagccgtcaaaagagtcttaatatatatatccagatggcatgtgtttactttatgttactacatgcacttggctgcataaatgtggtacaagcattctgtcttgaagggcaggtgcttcaggataccatatacagctcagaagtttcttctttaggcattaaattttagcaaagatatctcatctcttcttttaaaccattttctttttttgtggttagaaaagttatgtagaaaaaagtaaatgtgatttacgctcattgtagaaaagctataaaatgaatacaattaaagctgttatttaattagccagtgaaaaactattaacaacttgtctattacctgttagtattattgttgcattaaaaatgcatatactttaataaatgtacattgtattgtaaaaaaaaaaat

SEQ ID NO: 26735 - DNA, 3035 bp, Homo sapiens
ggggacactggatcacctagtgtttcacaagcaggtaccttctgctgtaggagagagagaactaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcgttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaaggtgcctcctttggtgaaggtgacacatcatgtgacctcttcagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctgggagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacgcagcctgcagactcactgtgggaaggagacaaaactagagactcaaagagggagtgcatttatgagctcttcatgtttcaggagagagttgaacctaaacatagaaattgcctgacgaactccttgattttagccttctctgttcatttcctcaaaaagatttccccatttaggtttctgagttcctgcatgccggtgatccctagctgtgacctctcccctggaactgtctctcatgaacctcaagctgcatctagaggcttccttcatttcctccgtcacctcagagacatacacctatgtcatttcatttcctatttttggaagaggactccttaaatttgggggacttacatgattcattttaacatctgagaaaagctttgaaccctgggacgtggctagtcataaccttaccagatttttacacatgtatctatgcattttctggacccgttcaacttttcctttgaatcctctctctgtgttacccagtaactcatctgtcaccaagccttggggattcttccatctgattgtgatgtgagttgcacagctatgaaggctgtacactgcacgaatggaagaggcacctgtcccagaaaaagcatcatggctatctgtgggtagtatgatgggtgtttttagcaggtaggaggcaaatatcttgaaaggggttgtgaagaggtgttttttctaattggcatgaaggtgtcatacagatttgcaaagtttaatggtgccttcatttgggatgctactctagtattccagacctgaagaatcacaataattttctacctggtctctccttgttctgataatgaaaattatgataaggatgataaaagcacttacttcgtgtccgactcttctgagcacctacttacatgcattactgcatgcacttcttacaataattctatgagataggtactattatccccatttcttttttaaatgaagaaagtgaagtaggccgggcacggtggctcacgcctgtaatcccagcgctttgggaggccaaagcgggtggatcacgaggtcaggagatcgagaccatcctggctaacatggtgaaaccccatctctaataaaaatacaaaaaattagctgggcgtggtggcagacgcctgtagtcccagctactcggaaggctgaggcaggagaatggcatgaacccaggaggcagagcttgcagtgagccgagtttgcgccactgcactccagcctaggtgacagagtgagactccatctcaaaaaaataaaaataaaaataaaaaaatgaaaaaaaaaagaaagtgaagtatagagtatctcatagtttgtcagtgatagaaacaggtttcaaactcagtcaatctgaccgtttgatacatctcagacaccactacattcagtagtttagatgcctagaataaatagagaaggaaggagatggctcttctcttgtctcattgtgtttcttctgagtgagcttgaatcacatgaaggggaacagcagaaaacaaccaactgatcctcagctgtcatgtttcctttaaaagtccctgaaggaaggtcctggaatgtgactcccttgctcctctgttgctctctttggcattcatttctttggaccctacgcaaggactgtaattggtggggacagctagtggccctgctgggcttcacacacggtgtcctccctaggccagtgcctctggagtcagaactctggtggtatttccctcaatgaagtggagtaagctctctcattttgagatggtataatggaagccaccaagtggcttagaggatgcccaggtccttccatggagccactggggttccggtgcacattaaaaaaaaaatctaaccaggacattcaggaattgctagattctgggaaatcagttcaccatgttcaaaagagtctttttttttttttttgagactctattgcccaggcagagcttgcagtgagccgagtttgcgccactgcactccagcctaggtgacggagtgagactccatctcaaaaaaatttattaaaaata

SEQ ID NO: 26736 - DNA, 3047 bp, Homo sapiens
ggggacactggatcacctagtgtttcacaagcaggtaccttctgctgtaggagagagagaactaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaagtgcctcctttggtgaaggtgacacatcatgtgacctcttcagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctgggagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacgcagcctgcagactcactgtgggaaggagacaaaactagagactcaaagagggagtgcatttatgagctcttcatgtttcaggagagagttgaacctaaacatagaaattgcctgacgaactccttgattttagccttctctgttcatttcctcaaaaagatttccccatttaggtttctgagttcctgcatgccggtgatccctagctgtgacctctcccctggaactgtctctcatgaacctcaagctgcatctagaggcttccttcatttcctccgtcacctcagagacatacacctatgtcatttcatttcctatttttggaagaggactccttaaatttgggggacttacatgattcattttaacatctgagaaaagctttgaaccctgggacgtggctagtcataaccttaccagatttttacacatgtatctatgcattttctggacccgttcaacttttcctttgaatcctctctctgtgttacccagtaactcatctgtcaccaagccttggggattcttccatctgattgtgatgtgagttgcacagctatgaaggctgtacactgcacgaatggaagaggcacctgtcccagaaaaagcatcatggctatctgtgggtagtatgatgggtgtttttagcaggtaggaggcaaatatcttgaaaggggttgtgaagaggtgttttttctaattggcatgaaggtgtcatacagatttgcaaagtttaatggtgccttcatttgggatgctactctagtattccagacctgaagaatcacaataattttctacctggtctctccttgttctgataatgaaaattatgataaggatgataaaagcacttacttcgtgtccgactcttctgagcacctacttacatgcattactgcatgcacttcttacaataattctatgagataggtactattatccccatttcttttttaaatgaagaaagtgaagtaggccgggcacggtggctcacgcctgtaatcccagcgctttgggaggccaaagcgggtggatcacgaggtcaggagatcgagaccatcctggctaacatggtgaaaccccatctctaataaaaatacaaaaaattagctgggcgtggtggcagacgcctgtagtcccagctactcggaaggctgaggcaggagaatggcatgaacccaggaggcagagcttgcagtgagccgagtttgcgccactgcactccagcctaggtgacagagtgagactccatctcaaaaaaataaaaataaaaataaaaaaatgaaaaaaaaaagaaagtgaagtatagagtatctcatagtttgtcagtgatagaaacaggtttcaaactcagtcaatctgaccgtttgatacatctcagacaccactacattcagtagtttagatgcctagaataaatagagaaggaaggagatggctcttctcttgtctcattgtgtttcttctgagtgagcttgaatcacatgaaggggaacagcagaaaacaaccaactgatcctcagctgtcatgtttcctttaaaagtccctgaaggaaggtcctggaatgtgactcccttgctcctctgttgctctctttggcattcatttctttggaccctacgcaaggactgtaattggtggggacagctagtggccctgctgggcttcacacacggtgtcctccctaggccagtgcctctggagtcagaactctggtggtatttccctcaatgaagtggagtaagctctctcattttgagatggtataatggaagccaccaagtggcttagaggatgcccaggtccttccatggagccactggggttccggtgcacattaaaaaaaaaatctaaccaggacattcaggaattgctagattctgggaaatcagttcaccatgttcaaaagagtctttttttttttttttgagactctattgcccaggcagagcttgcagtgagccgagtttgcgccactgcactccagcctaggtgacggagtgagactccatctcaaaaaaatttattaaaaata

SEQ ID NO: 26737 - DNA, 3242 bp, Homo sapiens
ggggacactggatcacctagtgtttcacaagcaggtaccttctgctgtaggagagagagaactaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaaggagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaagtgcctcctttggtgaaggtgacacatcatgtgacctcttcagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctgggagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacgcagcctgcagactcactgtgggaaggagacaaaactagagactcaaagagggagtgcatttatgagctcttcatgtttcaggagagagttgaacctaaacatagaaattgcctgacgaactccttgattttagccttctctgttcatttcctcaaaaagatttccccatttaggtttctgagttcctgcatgccggtgatccctagctgtgacctctcccctggaactgtctctcatgaacctcaagctgcatctagaggcttccttcatttcctccgtcacctcagagacatacacctatgtcatttcatttcctatttttggaagaggactccttaaatttgggggacttacatgattcattttaacatctgagaaaagctttgaaccctgggacgtggctagtcataaccttaccagatttttacacatgtatctatgcattttctggacccgttcaacttttcctttgaatcctctctctgtgttacccagtaactcatctgtcaccaagccttggggattcttccatctgattgtgatgtgagttgcacagctatgaaggctgtacactgcacgaatggaagaggcacctgtcccagaaaaagcatcatggctatctgtgggtagtatgatgggtgtttttagcaggtaggaggcaaatatcttgaaaggggttgtgaagaggtgttttttctaattggcatgaaggtgtcatacagatttgcaaagtttaatggtgccttcatttgggatgctactctagtattccagacctgaagaatcacaataattttctacctggtctctccttgttctgataatgaaaattatgataaggatgataaaagcacttacttcgtgtccgactcttctgagcacctacttacatgcattactgcatgcacttcttacaataattctatgagataggtactattatccccatttcttttttaaatgaagaaagtgaagtaggccgggcacggtggctcacgcctgtaatcccagcgctttgggaggccaaagcgggtggatcacgaggtcaggagatcgagaccatcctggctaacatggtgaaaccccatctctaataaaaatacaaaaaattagctgggcgtggtggcagacgcctgtagtcccagctactcggaaggctgaggcaggagaatggcatgaacccaggaggcagagcttgcagtgagccgagtttgcgccactgcactccagcctaggtgacagagtgagactccatctcaaaaaaataaaaataaaaataaaaaaatgaaaaaaaaaagaaagtgaagtatagagtatctcatagtttgtcagtgatagaaacaggtttcaaactcagtcaatctgaccgtttgatacatctcagacaccactacattcagtagtttagatgcctagaataaatagagaaggaaggagatggctcttctcttgtctcattgtgtttcttctgagtgagcttgaatcacatgaaggggaacagcagaaaacaaccaactgatcctcagctgtcatgtttcctttaaaagtccctgaaggaaggtcctggaatgtgactcccttgctcctctgttgctctctttggcattcatttctttggaccctacgcaaggactgtaattggtggggacagctagtggccctgctgggcttcacacacggtgtcctccctaggccagtgcctctggagtcagaactctggtggtatttccctcaatgaagtggagtaagctctctcattttgagatggtataatggaagccaccaagtggcttagaggatgcccaggtccttccatggagccactggggttccggtgcacattaaaaaaaaaatctaaccaggacattcaggaattgctagattctgggaaatcagttcaccatgttcaaaagagtctttttttttttttttgagactctattgcccaggcagagcttgcagtgagccgagtttgcgccactgcactccagcctaggtgacggagtgagactccatctcaaaaaaatttattaaaaata

SEQ ID NO: 26738 - DNA, 3177 bp, Homo sapiens
ggggacactggatcacctagtgtttcacaagcaggtaccttctgctgtaggagagagagaactaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcgttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaaggaaggaagtgaaagttccagtcttcctggcaagggtaaacagatcccctctcctcatccttcctctttcctgtcaagtgcctcctttggtgaaggtgacacatcatgtgacctcttcagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctggggtatgtgactgatgagagccaggagctgagaaaatctattgggggttgagaggagtgcctgaggagagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacgcagcctgcagactcactgtgggaaggagacaaaactagagactcaaagagggagtgcatttatgagctcttcatgtttcaggagagagttgaacctaaacatagaaattgcctgacgaactccttgattttagccttctctgttcatttcctcaaaaagatttccccatttaggtttctgagttcctgcatgccggtgatccctagctgtgacctctcccctggaactgtctctcatgaacctcaagctgcatctagaggcttccttcatttcctccgtcacctcagagacatacacctatgtcatttcatttcctatttttggaagaggactccttaaatttgggggacttacatgattcattttaacatctgagaaaagctttgaaccctgggacgtggctagtcataaccttaccagatttttacacatgtatctatgcattttctggacccgttcaacttttcctttgaatcctctctctgtgttacccagtaactcatctgtcaccaagccttggggattcttccatctgattgtgatgtgagttgcacagctatgaaggctgtacactgcacgaatggaagaggcacctgtcccagaaaaagcatcatggctatctgtgggtagtatgatgggtgtttttagcaggtaggaggcaaatatcttgaaaggggttgtgaagaggtgttttttctaattggcatgaaggtgtcatacagatttgcaaagtttaatggtgccttcatttgggatgctactctagtattccagacctgaagaatcacaataattttctacctggtctctccttgttctgataatgaaaattatgataaggatgataaaagcacttacttcgtgtccgactcttctgagcacctacttacatgcattactgcatgcacttcttacaataattctatgagataggtactattatccccatttcttttttaaatgaagaaagtgaagtaggccgggcacggtggctcacgcctgtaatcccagcgctttgggaggccaaagcgggtggatcacgaggtcaggagatcgagaccatcctggctaacatggtgaaaccccatctctaataaaaatacaaaaaattagctgggcgtggtggcagacgcctgtagtcccagctactcggaaggctgaggcaggagaatggcatgaacccaggaggcagagcttgcagtgagccgagtttgcgccactgcactccagcctaggtgacagagtgagactccatctcaaaaaaataaaaataaaaataaaaaaatgaaaaaaaaaagaaagtgaagtatagagtatctcatagtttgtcagtgatagaaacaggtttcaaactcagtcaatctgaccgtttgatacatctcagacaccactacattcagtagtttagatgcctagaataaatagagaaggaaggagatggctcttctcttgtctcattgtgtttcttctgagtgagcttgaatcacatgaaggggaacagcagaaaacaaccaactgatcctcagctgtcatgtttcctttaaaagtccctgaaggaaggtcctggaatgtgactcccttgctcctctgttgctctctttggcattcatttctttggaccctacgcaaggactgtaattggtggggacagctagtggccctgctgggcttcacacacggtgtcctccctaggccagtgcctctggagtcagaactctggtggtatttccctcaatgaagtggagtaagctctctcattttgagatggtataatggaagccaccaagtggcttagaggatgcccaggtccttccatggagccactggggttccggtgcacattaaaaaaaaaatctaaccaggacattcaggaattgctagattctgggaaatcagttcaccatgttcaaaagagtctttttttttttttttgagactctattgcccaggcagagcttgcagtgagccgagtttgcgccactgcactccagcctaggtgacggagtgagactccatctcaaaaaaatttattaaaaata

SEQ ID NO: 26739 - DNA, 3005 bp, Homo sapiens
ggggacactggatcacctagtgtttcacaagcaggtaccttctgctgtaggagagagagaactaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctgggagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacgcagcctgcagactcactgtgggaaggagacaaaactagagactcaaagagggagtgcatttatgagctcttcatgtttcaggagagagttgaacctaaacatagaaattgcctgacgaactccttgattttagccttctctgttcatttcctcaaaaagatttccccatttaggtttctgagttcctgcatgccggtgatccctagctgtgacctctcccctggaactgtctctcatgaacctcaagctgcatctagaggcttccttcatttcctccgtcacctcagagacatacacctatgtcatttcatttcctatttttggaagaggactccttaaatttgggggacttacatgattcattttaacatctgagaaaagctttgaaccctgggacgtggctagtcataaccttaccagatttttacacatgtatctatgcattttctggacccgttcaacttttcctttgaatcctctctctgtgttacccagtaactcatctgtcaccaagccttggggattcttccatctgattgtgatgtgagttgcacagctatgaaggctgtacactgcacgaatggaagaggcacctgtcccagaaaaagcatcatggctatctgtgggtagtatgatgggtgtttttagcaggtaggaggcaaatatcttgaaaggggttgtgaagaggtgttttttctaattggcatgaaggtgtcatacagatttgcaaagtttaatggtgccttcatttgggatgctactctagtattccagacctgaagaatcacaataattttctacctggtctctccttgttctgataatgaaaattatgataaggatgataaaagcacttacttcgtgtccgactcttctgagcacctacttacatgcattactgcatgcacttcttacaataattctatgagataggtactattatccccatttcttttttaaatgaagaaagtgaagtaggccgggcacggtggctcacgcctgtaatcccagcgctttgggaggccaaagcgggtggatcacgaggtcaggagatcgagaccatcctggctaacatggtgaaaccccatctctaataaaaatacaaaaaattagctgggcgtggtggcagacgcctgtagtcccagctactcggaaggctgaggcaggagaatggcatgaacccaggaggcagagcttgcagtgagccgagtttgcgccactgcactccagcctaggtgacagagtgagactccatctcaaaaaaataaaaataaaaataaaaaaatgaaaaaaaaaagaaagtgaagtatagagtatctcatagtttgtcagtgatagaaacaggtttcaaactcagtcaatctgaccgtttgatacatctcagacaccactacattcagtagtttagatgcctagaataaatagagaaggaaggagatggctcttctcttgtctcattgtgtttcttctgagtgagcttgaatcacatgaaggggaacagcagaaaacaaccaactgatcctcagctgtcatgtttcctttaaaagtccctgaaggaaggtcctggaatgtgactcccttgctcctctgttgctctctttggcattcatttctttggaccctacgcaaggactgtaattggtggggacagctagtggccctgctgggcttcacacacggtgtcctccctaggccagtgcctctggagtcagaactctggtggtatttccctcaatgaagtggagtaagctctctcattttgagatggtataatggaagccaccaagtggcttagaggatgcccaggtccttccatggagccactggggttccggtgcacattaaaaaaaaaatctaaccaggacattcaggaattgctagattctgggaaatcagttcaccatgttcaaaagagtctttttttttttttttgagactctattgcccaggcagagcttgcagtgagccgagtttgcgccactgcactccagcctaggtgacggagtgagactccatctcaaaaaaatttattaaaaata

SEQ ID NO: 26740 - DNA, 3205 bp, Homo sapiens
ggggacactggatcacctagtgtttcacaagcaggtaccttctgctgtaggagagagagaactaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaagtgcctcctttggtgaaggtgacacatcatgtgacctcttcagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctggggtatgtgactgatgagagccaggagctgagaaaatctattgggggttgagaggagtgcctgaggaggtaattatggcagtgagatgaggatctgctctttgttagggggtgggctgagggtggcaatcaaaggctttaacttgctttttctgttttagagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacgcagcctgcagactcactgtgggaaggagacaaaactagagactcaaagagggagtgcatttatgagctcttcatgtttcaggagagagttgaacctaaacatagaaattgcctgacgaactccttgattttagccttctctgttcatttcctcaaaaagatttccccatttaggtttctgagttcctgcatgccggtgatccctagctgtgacctctcccctggaactgtctctcatgaacctcaagctgcatctagaggcttccttcatttcctccgtcacctcagagacatacacctatgtcatttcatttcctatttttggaagaggactccttaaatttgggggacttacatgattcattttaacatctgagaaaagctttgaaccctgggacgtggctagtcataaccttaccagatttttacacatgtatctatgcattttctggacccgttcaacttttcctttgaatcctctctctgtgttacccagtaactcatctgtcaccaagccttggggattcttccatctgattgtgatgtgagttgcacagctatgaaggctgtacactgcacgaatggaagaggcacctgtcccagaaaaagcatcatggctatctgtgggtagtatgatgggtgtttttagcaggtaggaggcaaatatcttgaaaggggttgtgaagaggtgttttttctaattggcatgaaggtgtcatacagatttgcaaagtttaatggtgccttcatttgggatgctactctagtattccagacctgaagaatcacaataattttctacctggtctctccttgttctgataatgaaaattatgataaggatgataaaagcacttacttcgtgtccgactcttctgagcacctacttacatgcattactgcatgcacttcttacaataattctatgagataggtactattatccccatttcttttttaaatgaagaaagtgaagtaggccgggcacggtggctcacgcctgtaatcccagcgctttgggaggccaaagcgggtggatcacgaggtcaggagatcgagaccatcctggctaacatggtgaaaccccatctctaataaaaatacaaaaaattagctgggcgtggtggcagacgcctgtagtcccagctactcggaaggctgaggcaggagaatggcatgaacccaggaggcagagcttgcagtgagccgagtttgcgccactgcactccagcctaggtgacagagtgagactccatctcaaaaaaataaaaataaaaataaaaaaatgaaaaaaaaaagaaagtgaagtatagagtatctcatagtttgtcagtgatagaaacaggtttcaaactcagtcaatctgaccgtttgatacatctcagacaccactacattcagtagtttagatgcctagaataaatagagaaggaaggagatggctcttctcttgtctcattgtgtttcttctgagtgagcttgaatcacatgaaggggaacagcagaaaacaaccaactgatcctcagctgtcatgtttcctttaaaagtccctgaaggaaggtcctggaatgtgactcccttgctcctctgttgctctctttggcattcatttctttggaccctacgcaaggactgtaattggtggggacagctagtggccctgctgggcttcacacacggtgtcctccctaggccagtgcctctggagtcagaactctggtggtatttccctcaatgaagtggagtaagctctctcattttgagatggtataatggaagccaccaagtggcttagaggatgcccaggtccttccatggagccactggggttccggtgcacattaaaaaaaaaatctaaccaggacattcaggaattgctagattctgggaaatcagttcaccatgttcaaaagagtctttttttttttttttgagactctattgcccaggcagagcttgcagtgagccgagtttgcgccactgcactccagcctaggtgacggagtgagactccatctcaaaaaaatttattaaaaata

SEQ ID NO: 26741 - DNA, 1280 bp, Homo sapiens
ggggacactggatcacctagtgtttcacaagcaggtaccttctgctgtaggagagagagaactaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcgttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaaggagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaagtgctgagattgcaggtgtgagccaccctgcccagccgtcaaaagagtcttaatatatatatccagatggcatgtgtttactttatgttactacatgcacttggctgcataaatgtggtacaagcattctgtcttgaagggcaggtgcttcaggataccatatacagctcagaagtttcttctttaggcattaaattttagcaaagatatctcatctcttcttttaaaccattttctttttttgtggttagaaaagttatgtagaaaaaagtaaatgtgatttacgctcattgtagaaaagctataaaatgaatacaattaaagctgttatttaattagccagtgaaaaactattaacaacttgtctattacctgttagtattattgttgcattaaaaatgcatatactttaataaatgtacattgtattgtaaaaaaaaaaat

SEQ ID NO: 26742 - DNA, 427 bp, Homo sapiens
gcggagatttaacggggacgtgcggccagagctggggaaatgggcccgcgagccaggccggcgcttctcctcctgatgcttttgcagaccgcggtcctgcaggggcgcttgctgcgtgagtccgagggctgcgggcgaactaggggcgcggcgggggtggaaaaatcgaaactagctttttctttgcgcttgggagtttgctaactttggaggacctgctcaaccctatccgcaagcccctctccctactttctgcgtccagaccccgtgagggagtgcctaccactgaactgcagataggggtccctcgccccaggacctgccccctcccccggctgtcccggctctgcggagtgacttttggaaccgcccactcccttcccccaactagaatgcttttaaataaatctcgtagttcctcacttga

SEQ ID NO: 26743 - DNA, 951 bp, Homo sapiens
ggggacactggatcacctagtgtttcacaagcaggtaccttctgctgtaggagagagagaactaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcgttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaaggagtcccacaccctgcaggtcatcctgggctgtgaaatgcaagaagacaacagtaccgagggctactggaagtacgggtatgatggggcaggtgcttcaggataccatatacagctcagaagtttcttctttaggcattaaattttagcaaagatatctcatctcttcttttaaaccattttctttttttgtggttagaaaagttatgtagaaaaaagtaaatgtgatttacgctcattgtagaaaagctataaaatgaatacaattaaagctgttatttaattagccagtgaaaaactattaacaacttgtctattacctgttagtattattgttgcattaaaaatgcatatactttaataaatgtacattgtattgtaaaaaaaaaaat

SEQ ID NO: 26744 - DNA, 2969 bp, Homo sapiens
ggggacactggatcacctagtgtttcacaagcaggtaccttctgctgtaggagagagagaactaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcgttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaaggtgcctcctttggtgaaggtgacacatcatgtgacctcttcagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctgggagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacgcagcctgcagactcactgtgggaaggagacaaaactagagactcaaagagggagtgcatttatgagctcttcatgtttcaggagagagttgaacctaaacatagaaattgcctgacgaactccttgattttagccttctctgttcatttcctcaaaaagatttccccatttaggtttctgagttcctgcatgccggtgatccctagctgtgacctctcccctggaactgtctctcatgaacctcaagctgcatctagaggcttccttcatttcctccgtcacctcagagacatacacctatgtcatttcatttcctatttttggaagaggactccttaaatttgggggacttacatgattcattttaacatctgagaaaagctttgaaccctgggacgtggctagtcataaccttaccagatttttacacatgtatctatgcattttctggacccgttcaacttttcctttgaatcctctctctgtgttacccagtaactcatctgtcaccaagccttggggattcttccatctgattgtgatgtgagttgcacagctatgaaggctgtacactgcacgaatggaagaggcacctgtcccagaaaaagcatcatggctatctgtgggtagtatgatgggtgtttttagcaggtaggaggcaaatatcttgaaaggggttgtgaagaggtgttttttctaattggcatgaaggtgtcatacagatttgcaaagtttaatggtgccttcatttgggatgctactctagtattccagacctgaagaatcacaataattttctacctggtctctccttgttctgataatgaaaattatgataaggatgataaaagcacttacttcgtgtccgactcttctgagcacctacttacatgcattactgcatgcacttcttacaataattctatgagataggtactattatccccatttcttttttaaatgaagaaagtgaagtaggccgggcacggtggctcacgcctgtaatcccagcgctttgggaggccaaagcgggtggatcacgaggtcaggagatcgagaccatcctggctaacatggtgaaaccccatctctaataaaaatacaaaaaattagctgggcgtggtggcagacgcctgtagtcccagctactcggaaggctgaggcaggagaatggcatgaacccaggaggcagagcttgcagtgagccgagtttgcgccactgcactccagcctaggtgacagagtgagactccatctcaaaaaaataaaaataaaaataaaaaaatgaaaaaaaaaagaaagtgaagtatagagtatctcatagtttgtcagtgatagaaacaggtttcaaactcagtcaatctgaccgtttgatacatctcagacaccactacattcagtagtttagatgcctagaataaatagagaaggaaggagatggctcttctcttgtctcattgtgtttcttctgagtgagcttgaatcacatgaaggggaacagcagaaaacaaccaactgatcctcagctgtcatgtttcctttaaaagtccctgaaggaaggtcctggaatgtgactcccttgctcctctgttgctctctttggcattcatttctttggaccctacgcaaggactgtaattggtggggacagctagtggccctgctgggcttcacacacggtgtcctccctaggccagtgcctctggagtcagaactctggtggtatttccctcaatgaagtggagtaagctctctcattttgagatggtataatggaagccaccaagtggcttagaggatgcccaggtccttccatggagccactggggttccggtgcacattaaaaaaaaaatctaaccaggacattcaggaattgctagattctgggaaatcagttcaccatgttcaaaagagtctttttttttttttttgagactctattgcccaggcagcagagtgagactccatcttc

SEQ ID NO: 26745 - DNA, 3084 bp, Homo sapiens
ggggacactggatcacctagtgtttcacaagcaggtaccttctgctgtaggagagagagaactaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcgttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaaggagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctgggagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtttctgagttcctgcatgccggtgatccctagctgtgacctctcccctggaactgtctctcatgaacctcaagctgcatctagaggcttccttcatttcctccgtcacctcagagacatacacctatgtcatttcatttcctatttttggaagaggactccttaaatttgggggacttacatgattcattttaacatctgagaaaagctttgaaccctgggacgtggctagtcataaccttaccagatttttacacatgtatctatgcattttctggacccgttcaacttttcctttgaatcctctctctgtgttacccagtaactcatctgtcaccaagccttggggattcttccatctgattgtgatgtgagttgcacagctatgaaggctgtacactgcacgaatggaagaggcacctgtcccagaaaaagcatcatggctatctgtgggtagtatgatgggtgtttttagcaggtaggaggcaaatatcttgaaaggggttgtgaagaggtgttttttctaattggcatgaaggtgtcatacagatttgcaaagtttaatggtgccttcatttgggatgctactctagtattccagacctgaagaatcacaataattttctacctggtctctccttgttctgataatgaaaattatgataaggatgataaaagcacttacttcgtgtccgactcttctgagcacctacttacatgcattactgcatgcacttcttacaataattctatgagataggtactattatccccatttcttttttaaatgaagaaagtgaagtaggccgggcacggtggctcacgcctgtaatcccagcgctttgggaggccaaagcgggtggatcacgaggtcaggagatcgagaccatcctggctaacatggtgaaaccccatctctaataaaaatacaaaaaattagctgggcgtggtggcagacgcctgtagtcccagctactcggaaggctgaggcaggagaatggcatgaacccaggaggcagagcttgcagtgagccgagtttgcgccactgcactccagcctaggtgacagagtgagactccatctcaaaaaaataaaaataaaaataaaaaaatgaaaaaaaaaagaaagtgaagtatagagtatctcatagtttgtcagtgatagaaacaggtttcaaactcagtcaatctgaccgtttgatacatctcagacaccactacattcagtagtttagatgcctagaataaatagagaaggaaggagatggctcttctcttgtctcattgtgtttcttctgagtgagcttgaatcacatgaaggggaacagcagaaaacaaccaactgatcctcagctgtcatgtttcctttaaaagtccctgaaggaaggtcctggaatgtgactcccttgctcctctgttgctctctttggcattcatttctttggaccctacgcaaggactgtaattggtggggacagctagtggccctgctgggcttcacacacggtgtcctccctaggccagtgcctctggagtcagaactctggtggtatttccctcaatgaagtggagtaagctctctcattttgagatggtataatggaagccaccaagtggcttagaggatgcccaggtccttccatggagccactggggttccggtgcacattaaaaaaaaaatctaaccaggacattcaggaattgctagattctgggaaatcagttcaccatgttcaaaagagtctttttttttttttttgagactctattgcccaggcagagcttgcagtgagccgagtttgcgccactgcactccagcctaggtgacggagtgagactccatctcaaaaaaatttattaaaaata

SEQ ID NO: 26746 - DNA, 2993 bp, Homo sapiens
ggggacactggatcacctagtgtttcacaagcaggtaccttctgctgtaggagagagagaactaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcgttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaaggtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctgggagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacgcagcctgcagactcactgtgggaaggagacaaaactagagactcaaagagggagtgcatttatgagctcttcatgtttcaggagagagttgaacctaaacatagaaattgcctgacgaactccttgattttagccttctctgttcatttcctcaaaaagatttccccatttaggtttctgagttcctgcatgccggtgatccctagctgtgacctctcccctggaactgtctctcatgaacctcaagctgcatctagaggcttccttcatttcctccgtcacctcagagacatacacctatgtcatttcatttcctatttttggaagaggactccttaaatttgggggacttacatgattcattttaacatctgagaaaagctttgaaccctgggacgtggctagtcataaccttaccagatttttacacatgtatctatgcattttctggacccgttcaacttttcctttgaatcctctctctgtgttacccagtaactcatctgtcaccaagccttggggattcttccatctgattgtgatgtgagttgcacagctatgaaggctgtacactgcacgaatggaagaggcacctgtcccagaaaaagcatcatggctatctgtgggtagtatgatgggtgtttttagcaggtaggaggcaaatatcttgaaaggggttgtgaagaggtgttttttctaattggcatgaaggtgtcatacagatttgcaaagtttaatggtgccttcatttgggatgctactctagtattccagacctgaagaatcacaataattttctacctggtctctccttgttctgataatgaaaattatgataaggatgataaaagcacttacttcgtgtccgactcttctgagcacctacttacatgcattactgcatgcacttcttacaataattctatgagataggtactattatccccatttcttttttaaatgaagaaagtgaagtaggccgggcacggtggctcacgcctgtaatcccagcgctttgggaggccaaagcgggtggatcacgaggtcaggagatcgagaccatcctggctaacatggtgaaaccccatctctaataaaaatacaaaaaattagctgggcgtggtggcagacgcctgtagtcccagctactcggaaggctgaggcaggagaatggcatgaacccaggaggcagagcttgcagtgagccgagtttgcgccactgcactccagcctaggtgacagagtgagactccatctcaaaaaaataaaaataaaaataaaaaaatgaaaaaaaaaagaaagtgaagtatagagtatctcatagtttgtcagtgatagaaacaggtttcaaactcagtcaatctgaccgtttgatacatctcagacaccactacattcagtagtttagatgcctagaataaatagagaaggaaggagatggctcttctcttgtctcattgtgtttcttctgagtgagcttgaatcacatgaaggggaacagcagaaaacaaccaactgatcctcagctgtcatgtttcctttaaaagtccctgaaggaaggtcctggaatgtgactcccttgctcctctgttgctctctttggcattcatttctttggaccctacgcaaggactgtaattggtggggacagctagtggccctgctgggcttcacacacggtgtcctccctaggccagtgcctctggagtcagaactctggtggtatttccctcaatgaagtggagtaagctctctcattttgagatggtataatggaagccaccaagtggcttagaggatgcccaggtccttccatggagccactggggttccggtgcacattaaaaaaaaaatctaaccaggacattcaggaattgctagattctgggaaatcagttcaccatgttcaaaagagtctttttttttttttttgagactctattgcccaggcagagcttgcagtgagccgagtttgcgccactgcactccagcctaggtgacggagtgagactccatctcaaaaaaatttattaaaaata

SEQ ID NO: 26747 - DNA, 2401 bp, Homo sapiens
ggggacactggatcacctagtgtttcacaagcaggtaccttctgctgtaggagagagagaactaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcgttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaaggagtcccacaccctgcaggtcatcctgggctgtgaaatgcaagaagacaacagtaccgaaggcttccttcatttcctccgtcacctcagagacatacacctatgtcatttcatttcctatttttggaagaggactccttaaatttgggggacttacatgattcattttaacatctgagaaaagctttgaaccctgggacgtggctagtcataaccttaccagatttttacacatgtatctatgcattttctggacccgttcaacttttcctttgaatcctctctctgtgttacccagtaactcatctgtcaccaagccttggggattcttccatctgattgtgatgtgagttgcacagctatgaaggctgtacactgcacgaatggaagaggcacctgtcccagaaaaagcatcatggctatctgtgggtagtatgatgggtgtttttagcaggtaggaggcaaatatcttgaaaggggttgtgaagaggtgttttttctaattggcatgaaggtgtcatacagatttgcaaagtttaatggtgccttcatttgggatgctactctagtattccagacctgaagaatcacaataattttctacctggtctctccttgttctgataatgaaaattatgataaggatgataaaagcacttacttcgtgtccgactcttctgagcacctacttacatgcattactgcatgcacttcttacaataattctatgagataggtactattatccccatttcttttttaaatgaagaaagtgaagtaggccgggcacggtggctcacgcctgtaatcccagcgctttgggaggccaaagcgggtggatcacgaggtcaggagatcgagaccatcctggctaacatggtgaaaccccatctctaataaaaatacaaaaaattagctgggcgtggtggcagacgcctgtagtcccagctactcggaaggctgaggcaggagaatggcatgaacccaggaggcagagcttgcagtgagccgagtttgcgccactgcactccagcctaggtgacagagtgagactccatctcaaaaaaataaaaataaaaataaaaaaatgaaaaaaaaaagaaagtgaagtatagagtatctcatagtttgtcagtgatagaaacaggtttcaaactcagtcaatctgaccgtttgatacatctcagacaccactacattcagtagtttagatgcctagaataaatagagaaggaaggagatggctcttctcttgtctcattgtgtttcttctgagtgagcttgaatcacatgaaggggaacagcagaaaacaaccaactgatcctcagctgtcatgtttcctttaaaagtccctgaaggaaggtcctggaatgtgactcccttgctcctctgttgctctctttggcattcatttctttggaccctacgcaaggactgtaattggtggggacagctagtggccctgctgggcttcacacacggtgtcctccctaggccagtgcctctggagtcagaactctggtggtatttccctcaatgaagtggagtaagctctctcattttgagatggtataatggaagccaccaagtggcttagaggatgcccaggtccttccatggagccactggggttccggtgcacattaaaaaaaaaatctaaccaggacattcaggaattgctagattctgggaaatcagttcaccatgttcaaaagagtctttttttttttttttgagactctattgcccaggcagagcttgcagtgagccgagtttgcgccactgcactccagcctaggtgacggagtgagactccatctcaaaaaaatttattaaaaata

SEQ ID NO: 26748 - DNA, 1484 bp, Homo sapiens
ggggacactggatcacctagtgtttcacaagcaggtaccttctgctgtaggagagagagaactaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcgttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaaggagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaagtgcctcctttggtgaaggtgacacatcatgtgacctcttcagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtacccctgctgagattgcaggtgtgagccaccctgcccagccgtcaaaagagtcttaatatatatatccagatggcatgtgtttactttatgttactacatgcacttggctgcataaatgtggtacaagcattctgtcttgaagggcaggtgcttcaggataccatatacagctcagaagtttcttctttaggcattaaattttagcaaagatatctcatctcttcttttaaaccattttctttttttgtggttagaaaagttatgtagaaaaaagtaaatgtgatttacgctcattgtagaaaagctataaaatgaatacaattaaagctgttatttaattagccagtgaaaaactattaacaacttgtctattacctgttagtattattgttgcattaaaaatgcatatactttaataaatgtacattgtattgtaaaaaaaaaaat

SEQ ID NO: 26749 - DNA, 2495 bp, Homo sapiens
ggggacactggatcacctagtgtttcacaagcaggtaccttctgctgtaggagagagagaactaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacgcagcctgcagactcactgtgggaaggagacaaaactagagactcaaagagggagtgcatttatgagctcttcatgtttcaggagagagttgaacctaaacatagaaattgcctgacgaactccttgattttagccttctctgttcatttcctcaaaaagatttccccatttaggtttctgagttcctgcatgccggtgatccctagctgtgacctctcccctggaactgtctctcatgaacctcaagctgcatctagaggcttccttcatttcctccgtcacctcagagacatacacctatgtcatttcatttcctatttttggaagaggactccttaaatttgggggacttacatgattcattttaacatctgagaaaagctttgaaccctgggacgtggctagtcataaccttaccagatttttacacatgtatctatgcattttctggacccgttcaacttttcctttgaatcctctctctgtgttacccagtaactcatctgtcaccaagccttggggattcttccatctgattgtgatgtgagttgcacagctatgaaggctgtacactgcacgaatggaagaggcacctgtcccagaaaaagcatcatggctatctgtgggtagtatgatgggtgtttttagcaggtaggaggcaaatatcttgaaaggggttgtgaagaggtgttttttctaattggcatgaaggtgtcatacagatttgcaaagtttaatggtgccttcatttgggatgctactctagtattccagacctgaagaatcacaataattttctacctggtctctccttgttctgataatgaaaattatgataaggatgataaaagcacttacttcgtgtccgactcttctgagcacctacttacatgcattactgcatgcacttcttacaataattctatgagataggtactattatccccatttcttttttaaatgaagaaagtgaagtaggccgggcacggtggctcacgcctgtaatcccagcgctttgggaggccaaagcgggtggatcacgaggtcaggagatcgagaccatcctggctaacatggtgaaaccccatctctaataaaaatacaaaaaattagctgggcgtggtggcagacgcctgtagtcccagctactcggaaggctgaggcaggagaatggcatgaacccaggaggcagagcttgcagtgagccgagtttgcgccactgcactccagcctaggtgacagagtgagactccatctcaaaaaaataaaaataaaaataaaaaaatgaaaaaaaaaagaaagtgaagtatagagtatctcatagtttgtcagtgatagaaacaggtttcaaactcagtcaatctgaccgtttgatacatctcagacaccactacattcagtagtttagatgcctagaataaatagagaaggaaggagatggctcttctcttgtctcattgtgtttcttctgagtgagcttgaatcacatgaaggggaacagcagaaaacaaccaactgatcctcagctgtcatgtttcctttaaaagtccctgaaggaaggtcctggaatgtgactcccttgctcctctgttgctctctttggcattcatttctttggaccctacgcaaggactgtaattggtggggacagctagtggccctgctgggcttcacacacggtgtcctccctaggccagtgcctctggagtcagaactctggtggtatttccctcaatgaagtggagtaagctctctcattttgagatggtataatggaagccaccaagtggcttagaggatgcccaggtccttccatggagccactggggttccggtgcacattaaaaaaaaaatctaaccaggacattcaggaattgctagattctgggaaatcagttcaccatgttcaaaagagtctttttttttttttttgagactctattgcccaggcagagcttgcagtgagccgagtttgcgccactgcactccagcctaggtgacggagtgagactccatctcaaaaaaatttattaaaaata

SEQ ID NO: 26750 - DNA, 860 bp, Homo sapiens
tggaatcaactttagtgttcatcaatgggtgaatgtataaagaaaatgtgatgcacacacacacacacacacacatatacacacaatggaatactatgtacccataaaaaagaaatcatctcatttgcagcaacatgtatggaactgggggttattatcttaactgaaataatccaggcacagaaaaagacaaatgttattttttctcatttatatgtgggagctaaaatatttgattacatgtagatagagagtagaatgatagataacagagactgggaagagtgagtgggaggaaagtgtgaatgaaaagaagtggcttaaagggtacaaacatacagtaagatagaataaataaattcaatgatttatagaagagcagagtgactatacttaacaaaaatgtattgtactcaggagacggacaccctaaataacctgacttgatcactatgcattatgtatatgtaacaaaacttctcatgtgggtcattaatgtggtttgaatatttgtcacctccaaatcttatgttgaaatgtgattttcaatgttggagatggagcctagcggaaggtgtttgggttatgggggcagatccttcacgaatggcttgctgctctccccacagtaatgagtgagttcttgctctgtgaggtcatgtgagatcttgtttgaaaaggagcctgacacatctctctctctcttattgtctcaccatgtgatacgcctgctcctccttcaccttctgttatgattgtaagcttctgaggcctcaccagaagatgaacaaatgttggtgccatgattgtacagcctgaagaaccatgagccaaaataaacgtcttttctttataaataa

SEQ ID NO: 26751 - DNA, 480 bp, Homo sapiens
caagcatgcttttgctgatggtgcttgggatctttcatttctctgtgctctttgcaagtttcctgcccccaatcctcaagccccctctggcagacccctacaggtacctgggaattcctggagattaataccctgtctccctagttcccatggaaaatggagttccaaaaattcccacgaaacttttttccattgtctttttgcttttgtttgatatcgagaggaaaggaaaaagttctgtttgtccattttgttacagataaggaaagtggtttcacaaaggttaagcaacttgatcagtgttacccagcaaagagcagaatgattttcaacattcagtttaaaagtcggcggggggcagtggctcacacctgtaatatcagcaacttgggaggccaaggtggtacggtcgcttgaagccaaggagttcaagaccagcctggtcaacatagcaaaaccttgtctttacaaaaagtaaaa

SEQ ID NO: 26752 - DNA, 412 bp, Homo sapiens
cagcctgggtgacaaagaacctatccccccaaaaaagaaaatatgatcgtttgaccaaaggccttttcgaagtgcctgtaaagtgaaaattagtcacagcactaagattacttggcttttttcaccattctcaagtaggcagtggagtttccaagtaacaagactggtataaaaagtgcacaagcacataagaagctagatatctttgaagagatctatgttggttttgatttctaatgtaaatatttgtaattcacccaacaaaactcacctagactagtatattaatgtatttatgaactaaaataaagatgacagtttttaaaaaaaaatttggaggagtgggagagcaggtgtcccttgttggctttgtgggtagctcagtggtttgcacctgtgcagcagtggtttc

SEQ ID NO: 26753 - DNA, 370 bp, Homo sapiens
tgtttctagtttttattgttagatattccctttcttcttaaaggcctcaatgggttcagaaacgtcccttcatagattctacaaaaagagagttttcaacctgctgaatcaaaacacaggtttcattctgtgagaagaatccacataacacaaagcattttcacagtgcacttgtttctaatttttatcactggatattcagtatttctttagaggcatcaaagggctcagaaatatccctttgtagattctccaaaaagagtgtttccaacctgctgaatcaaaacacaagttccattttagtgcaatgaatccgcacatcacaaagcattttcatacgtagcttgcttctactttttatcgctggata

SEQ ID NO: 26754 - DNA, 470 bp, Homo sapiens
ccgagattgtgccactgcacctccgcctgggtgatagaacaagactttgtctaaaaaaaaaaaaagacaacattgtcagattggattgaacacacatatatacacatttacacaagacccaatacatgctctctacataaaacccaccttaatgtaattacatagatagattaaaagtaaaatgatagaaaaggttaaaccatataaatactgatcaaaagacagctggagtggctatattaatatcagacaaagtagccttcaaaacaagcaatattaccagggataaagagagatattacatattaataaaaaggttaaggctaggtccagtggctcatgcctgtaattccaacactttgggaggttgaagtggttggatctattgagcccaggagttcaagaccgacctggccaacatggtgaaatcctgtctctactaaaaatacaaaaattagccaggtgtagtg

SEQ ID NO: 26755 - DNA, 245 bp, Homo sapiens
atagatgtctgtttactccactagagcaaagttctctatagtcagcaagtaaatcccttatcactcttttaaaaacattagtgtttaggctgggcgcggtggctcactcctgtaatcccagcactggccagcctggcgaaaccctgtctctactaaaaatacaaaaattggccaggtgtggtggcacgcacctataatcccatctactcaggtggctgaagcaggagaatcacttgaacccgcga

SEQ ID NO: 26756 - DNA, 515 bp, Homo sapiens
acctggtgaaaccctgtctctaccaaatatacaaaaattaaccaggtgtggtgacacacacttgtaatcccagctaccgaggaggctgaggtgggagaatcgcttgaacctgggaggcagaggttgcagtgagacaagatcacgccactgcactccagcctgggcaacagaggggttggaagaaggggtggaggaacaaggagacggaatgtgcaggagtggggtaaacatgcctctggcctcacccggcgctggcacgcagtaggtggctcagtaaatcctggctgtgtagactgagccgtggaaaagatggttactgactccagagggagttaatttcatttccttccccaagagcagctcttgggagggtacatgaaacttggataatggggcacacatttaggctgctgaaaatggcttcgccctgctcttccatcttcagggtttcaccacgtcctggttgcgtggctgtggggtgagttaatgaggaagagcagcctgtctggggagga

SEQ ID NO: 26757 - DNA, 501 bp, Homo sapiens
tagagataaggtcctctggctggactcaaactccggggctcaagcaatcctcccacctcatcctacagagtagctgggcctataggtacatgcaaccatgcctggttctattttcttcttaaaaaggaagaaaaaaaggaactctggctaccaatactgaaaacagatttgggagaaatctgctaggagtagaggaaaaggaatggtagtagagaaagcaagggcttcaactctgaaatctttgccaattttgaactgagaaactttaaaactgagaaaacgggtatattaaagaaagatgttttaaactgggaaaagattaggtatatgaggcagactattagtcatatgatatttttctttttctttttttctagacagagtcttgctctgtcacccaggctggagtacagtggtgtgatctcggctcactgcaacctttgcctcctggattcaagcgattctcctgcctcagtctcccgagtagctggggctacaagt

SEQ ID NO: 26758 - DNA, 380 bp, Homo sapiens
gcttacctttcccattctggggtctgcactaaggtctggaattgagagctgctatataggacctgatgttagcaggcgtgtgccccaactgttttctccagtatcctaaaagaagagaaaccccaagccagctacatggataattcttctctggccaagaaagaaaaatgctcgcatggattatgcattttcagaaggaaccgtgcattctcagaagggtgtttttcctttgccaagctctgtgctgggtttttcctgtgctgggctcagacagtgtttggcacagagtagtcattcatttcacaagtatgtattgagcacgtgtgatgtattgttctaggtgttacttaaatggacaaaagagtaaaataaaaccatag

SEQ ID NO: 26759 - DNA, 1287 bp, Homo sapiens
atggactctctgtggggcccaggagccgggagtcacccctttggggtccacaacacccggctgtccccagacttgtgtccagggaagatagtgttgagggccctcaaggagagcggggcagggatgcctgagcaggacaaggaccctagagtccaagagaatcctggtgatcagagaagggtcccggaggtcaccggggatgcaccgtctgcatttcggcccctgcgggacaatggaggcctctctccctttgtgcccgggcccgggcctctgcagacagacctccatgcccagaggtcagaaatcagatataaccagacatcccagacctcctggacgagctcctgcaccaaccgaaatgccatctccagctcctacagctccacgggaggcttgccggggctaaagcggaggagggggccagcctcatcccactgccagctgaccctcagttcctcaaagacagtgagtgaggacaggcctcaggctgtctcttcaggtcacacccagtgtgaaaaggcagcagatatagcaccagggcagacactcaccctcaggaatgactcctccacatccgaggcctctaggcccagtacacacaagtttcccctgctgccatgcaggcgaggggagcctttgatgctgccacctcccttagagctggggtaccgggtcactgttgaagaccttgaccgggagaaggaggcggcattccagcgcatcaacagtgcactgcaagttgaggacaaggccatctcggactgcagaccctcacggccttcccacactttgtcctcacttgcaacaggggcttctggtctgcctgccgtttctaaagcacccagtatggatgcacagcaggagacacacaagtcccaagactgcctgggcctactggcccccttagcatctgctgcagaggtcccctctacagctcccatgtctgggaagaagcacagaccaccaggccccctgttctcctcctcagatccccttcctgccacctcttcccattcccaggactcagcccaggtcacctcgctgattcctgcccccttcccagctgcaagcatggatgcgggcatgagaagaacaaggcgtggcacttctgctcctgcagctgccgcagcagcccctcccccctccgcattgaaccccacgttggggtcactactggagtggatggaggcccttcacatttctgggcctcagccacagctgcagcaggtgcccagaggtcagaaccagagatcgcagacctcccggaccagctcgtgccccaaatga

SEQ ID NO: 26760 - DNA, 108 bp, Homo sapiens
tttcctggagttttaaacgtgtcatttctagtgtaaggaacacagcttataaacttctggaactattaggtgatataaggtagtaattaccctataactataggtatt

SEQ ID NO: 26761 - DNA, 901 bp, Homo sapiens
tcacccaggaacagcctggttctgtcacgctgtgcagccctctcttgctctcctcctccagccttccccacggtggtggatgcaggccccttgacaccttgcgacgcatgacatggagagctctttttgtgttaccatgttttgaagcattcattccagcttgactcttcagttactgtgtgaacaaacattggccatcttctcagtgagttgctgttgtgttttcctttcagcaagtgaacaatggcctcaccctcagtgaccttcctctgcacatgctgaacaacatcctataccggttctcagacggatgggacatcatcaccttaggccaggtgacccccacgttgtatatgcttagtgaagacagacagctgtggaagaagctttgtcagtaccattttgctgaaaagcagttttgtagacatttgatcctttcagaaaaaggtcatattgaatggaagttgatgtactttgcacttcagaaacattacccagcgaaggagcagtacggagacacactgcatttctgtcggcactgcagcattctcttttggaaggactcaggacacccctgcacggcggccgaccctgacagctgcttcacgcctgtgtctccgcagcacttcatcgacctcttcaagttttaagggctgcccctgccatccctattggagattgtgaatcctgctgtctgtgcagggctcatagtgagtgttctgtgaggtgggtggagactcctcggaagcccctgcttccagaaagcctgggaagaactgcccttctgcaaaggggggactgcatggttgcattttcatcactgaaagtcagaggccaaggaaatcatttctacttctttaaaaactccttctaagcatattaaaatgtgaaattttgcgta

SEQ ID NO: 26762 - DNA, 1594 bp, Homo sapiens
gacggaggggcagtgcctactacgcaggcgcacgctgcgggcgacaggaccaggcagcaacattgccacgcggatccgcgccggccaatcagcatggccaggggcggggcttccctgaggcgcgccgggaggcggcggcccacttccggcaataaccgcctggtcgccgtcaggtgcgggcccaggtggccggcgcgcccgttgggcactgggggacgcgggcgcgtcaggtgaagactgggggccgcaggcgcgctaggagaactatgccatttttgggtcaggactggagatctcctggatggagttggattaagacagaagatggctggaagagatgtgaatcttgtagtcagaaacttgaaagagagaataaccgttgtaacatcagtcacagcattatcttaaatagtgaagatggagaaatattcaataatgaagagcatgaatatgcatcgaaaaaaaggaaaaaggaccattttagaaatgacacaaatactcaaagtttttatcgtgaaaaatggatctatgtccataaagaaagcacaaaggaaaggcatggctattgcaccttgggagaagcctttaatcggttagacttctcaagtgcaattcaagatatccgaaggttcaattatgtggtcaaactgttgcagctaattgcaaaatcccagttaacttcattgagtggcgtggcacagaagaattacttcaacattttggataaaatcgttcaaaaggttcttgatgaccaccacaatcctcgcttaatcaaagatcttctgcaagacctaagctctaccctctgcattcttattagaggagtagggaagtctgtattagtgggaaacatcaatatttggatttgccgattagaaactattctcgcctggcaacaacagctacaggatcttcagatgactaagcaagtgaacaatggcctcaccctcagtgaccttcctctgcacatgctgaacaacatcctataccggttctcagacggatgggacatcatcaccttaggccaggtgacccccacgttgtatatgcttagtgaagacagacagctgtggaagaagctttgtcagtaccattttgctgaaaagcagttttgtagacatttgatcctttcagaaaaaggtcatattgaatggaagttgatgtactttgcacttcagaaacattacccagcgaaggagcagtacggagacacactgcatttctgtcggcactgcagcattctcttttggaaggactcaggacacccctgcacggcggccgaccctgacagctgcttcacgcctgtgtctccgcagcacttcatcgacctcttcaagttttaagggctgcccctgccatccctattggagattgtgaatcctgctgtctgtgcagggctcatagtgagtgttctgtgaggtgggtggagactcctcggaagcccctgcttccagaaagcctgggaagaactgcccttctgcaaaggggggactgcatggttgcattttcatcactgaaagtcagaggccaaggaaatcatttctacttctttaaaaactccttctaagcatattaaaatgtgaaattttgcgta

SEQ ID NO: 26763 - DNA, 1592 bp, Homo sapiens
agcggagtgtgagcgcgcagtgatgccctagagtgcagtcatcccgggcttggcgcccagcgggtggaaatacggccgcagggtggaaatgcggcggcggggctgcccaggctcctgtgggacccgcgcggcgcgggcacgcacattctcagggacgcgcgtcctcaggccacgagaacacctgaaggccccggccagcgtcctcccgtgaagacccggaccggcgtcgtcacccgccgcgcaggcctaaatctcaggagaactatgccatttttgggtcaggactggagatctcctggatggagttggattaagacagaagatggctggaagagatgtgaatcttgtagtcagaaacttgaaagagagaataaccgttgtaacatcagtcacagcattatcttaaatagtgaagatggagaaatattcaataatgaagagcatgaatatgcatcgaaaaaaaggaaaaaggaccattttagaaatgacacaaatactcaaagtttttatcgtgaaaaatggatctatgtccataaagaaagcacaaaggaaaggcatggctattgcaccttgggagaagcctttaatcggttagacttctcaagtgcaattcaagatatccgaaggttcaattatgtggtcaaactgttgcagctaattgcaaaatcccagttaacttcattgagtggcgtggcacagaagaattacttcaacattttggataaaatcgttcaaaaggttcttgatgaccaccacaatcctcgcttaatcaaagatcttctgcaagacctaagctctaccctctgcattcttattagaggagtagggaagtctgtattagtgggaaacatcaatatttggatttgccgattagaaactattctcgcctggcaacaacagctacaggatcttcagatgactaagcaagtgaacaatggcctcaccctcagtgaccttcctctgcacatgctgaacaacatcctataccggttctcagacggatgggacatcatcaccttaggccaggtgacccccacgttgtatatgcttagtgaagacagacagctgtggaagaagctttgtcagtaccattttgctgaaaagcagttttgtagacatttgatcctttcagaaaaaggtcatattgaatggaagttgatgtactttgcacttcagaaacattacccagcgaaggagcagtacggagacacactgcatttctgtcggcactgcagcattctcttttggaaggactcaggacacccctgcacggcggccgaccctgacagctgcttcacgcctgtgtctccgcagcacttcatcgacctcttcaagttttaagggctgcccctgccatccctattggagattgtgaatcctgctgtctgtgcagggctcatagtgagtgttctgtgaggtgggtggagactcctcggaagcccctgcttccagaaagcctgggaagaactgcccttctgcaaaggggggactgcatggttgcattttcatcactgaaagtcagaggccaaggaaatcatttctacttctttaaaaactccttctaagcatattaaaatgtgaaattttgcgta

SEQ ID NO: 26764 - DNA, 2211 bp, Homo sapiens
gcattgctataattttactatactctcatctaaatctaaaatcagtcttcaaaataaaaacaaattgtcctttgccaaaaatttttttaatcgcacaattaattgacattaactgccaattctttttggctaattgactaattttaacttctgtgttgcttttccagaggcatggctattgcaccttgggagaagcctttaatcggttagacttctcaagtgcaattcaagatatccgaaggttcaattatgtggtcaaactgttgcagctaattgcaaaatcccagttaacttcattgagtggcgtggcacagaagaattacttcaacattttggataaaatcgttcaaaaggttcttgatgaccaccacaatcctcgcttaatcaaagatcttctgcaagacctaagctctaccctctgcattcttattagaggagtagggaagtctgtattagtgggaaacatcaatatttggatttgccgattagaaactattctcgcctggcaacaacagctacaggatcttcagatgactaagcaagtgaacaatggcctcaccctcagtgaccttcctctgcacatgctgaacaacatcctataccggttctcagacggatgggacatcatcaccttaggccaggtgacccccacgttgtatatgcttagtgaagacagacagctgtggaagaagctttgtcagtaccattttgctgaaaagcagttttgtagacatttgatcctttcagaaaaaggtcatattgaatggaagttgatgtactttgcacttcagaaacattacccagcgaaggagcagtacggagacacactgcatttctgtcggcactgcagcattctcttttggaaggactcaggacacccctgcacggcggccgaccctgacagctgcttcacgcctgtgtctccgcagcacttcatcgacctcttcaagttttaagggctgcccctgccatccctattggagattgtgaatcctgctgtctgtgcagggctcatagtgagtgttctgtgaggtgggtggagactcctcggaagcccctgcttccagaaagcctgggaagaactgcccttctgcaaaggggggactgcatggttgcattttcatcactgaaagtcagaggccaaggaaatcatttctacttctttaaaaactccttctaagcatattaaaatgtgaaattttgcgtactctctctctctatatatatagttcaaaaatactttaggtggtcagctccacattctttgttgacgtgacactaacggccaataatatgcttcttaattatcaaattatagtttcccaattgggaaactaattgggggtgggttacaaaacatttgatccttgtaaatacattgtacagaatatttattttttctcaaaatgcattttaactactacattggctgtgcccaaatgagtcctctttgaatagaaagtgaacccagggcaatgacagccattcttgtcttagggattatggatcggggtatgaattgtgcacacgcagcccaacaacgggcagtggtctctgtgctcctaggcatccagcacaggttctggcagggcacccctgctggggttgggggctggtctgtgcataatcctggactgtgatgggaacagcccagtgcagttctaaacttcaattgtgttgaaactactttaatagacaaagtaataaatcatgtttatctattgatttaaacttcatcagttttgcatcctactgagaaatgttagtgattttgatacttaaatccttaaaagattgcttcgtttttaaaataacgcatgtccattttagaaaattagaaaatcagtcccaccacccaaagattattgtgcatgctgaaaagagtatgaaaaatcccctcagcaggcataggatagaaacgtattgttgtatatttccatttttgaatagggtcaaggagcccaagcaaatcatttctactttttcctttaagcataataataaaagtatacttttatggcgttataaataggactaaaaaaagattctggatttttcagccccacttctgtgaactgacacaaatggccaagaatgcatttatttgtcaaattatagtttctcctgaggcgatgcaaatacctggggcctctgcgaatatatgttagtttttcataagaccataaatgtcccgcatacccgttacttcac

SEQ ID NO: 26765 - DNA, 1621 bp, Homo sapiens
gacggaggggcagtgcctactacgcaggcgcacgctgcgggcgacaggaccaggcagcaacattgccacgcggatccgcgccggccaatcagcatggccaggggcggggcttccctgaggcgcgccgggaggcggcggcccacttccggcaataaccgcctggtcgccgtcaggtgcgggcccaggtggccggcgcgcccgttgggcactgggggacgcgggcgcgtcaggtgaagactgggggccgcaggcgcgctaggagaactatgccatttttgggtcaggactggagatctcctggatggagttggattaagacagaagatggctggaagagatgtgaatcttgtagtcagaaacttgaaagagagaataaccgttgtaacatcagtcacagcattatcttaaatagtgaagatggagaaatattcaataatgaagagcatgaatatgcatcgaaaaaaaggaaaaaggaccattttagaaatgacacaaatactcaaagtttttatcgtgaaaaatggatctatgtccataaagaaagcacaaaggaaaggcatggctattgcaccttgggagaagcctttaatcggttagacttctcaagtgcaattcaagatatccgaaggttcaattatgtggtcaaactgttgcagctaattgcaaaatcccagttaacttcattgagtggcgtggcacagaagaattacttcaacattttggataaaatcgttcaaaaggttcttgatgaccaccacaatcctcgcttaatcaaagatcttctgcaagacctaagctctaccctctgcattcttattagaggagtagggaagtctgtattagtgggaaacatcaatatttggatttgccgattagaaactattctcgcctggcaacaacagctacaggatcttcagatgactaagcaagtgaacaatggcctcaccctcagtgaccttcctctgcacatgctgaacaacatcctataccggttctcagacggatgggacatcatcaccttaggccaggtgacccccacgttgtatatgcttagtgaagacagacagctgtggaagaagctttgtcagtaccattttgctgaaaagcagttttgtagacatttgatcctttcagaaaaaggtcatattgaatggaagttgatgtactttgcacttcagaaacattacccagcgaaggagcagtacggagacacactgcatttctgtcggcactgcagcattctcttttggaaggactaccatcttgctttactattcaaggactcaggacacccctgcacggcggccgaccctgacagctgcttcacgcctgtgtctccgcagcacttcatcgacctcttcaagttttaagggctgcccctgccatccctattggagattgtgaatcctgctgtctgtgcagggctcatagtgagtgttctgtgaggtgggtggagactcctcggaagcccctgcttccagaaagcctgggaagaactgcccttctgcaaaggggggactgcatggttgcattttcatcactgaaagtcagaggccaaggaaatcatttctacttctttaaaaactccttctaagcatattaaaatgtgaaattttgcgta

SEQ ID NO: 26766 - DNA, 2453 bp, Homo sapiens
gacggaggggcagtgcctactacgcaggcgcacgctgcgggcgacaggaccaggcagcaacattgccacgcggatccgcgccggccaatcagcatggccaggggcggggcttccctgaggcgcgccgggaggcggcggcccacttccggcaataaccgcctggtcgccgtcaggtgcgggcccaggtggccggcgcgcccgttgggcactgggggacgcgggcgcgtcaggtgaagactgggggccgcaggcgcgctaggagaactatgccatttttgggtcaggactggagatctcctggatggagttggattaagacagaagatggctggaagagatgtgaatcttgtagtcagaaacttgaaagagagaataaccgttgtaacatcagtcacagcattatcttaaatagtgaagatggagaaatattcaataatgaagagcatgaatatgcatcgaaaaaaaggaaaaaggaccattttagaaatgacacaaatactcaaagtttttatcgtgaaaaatggatctatgtccataaagaaagcacaaaggaaaggcatggctattgcaccttgggagaagcctttaatcggttagacttctcaagtgcaattcaagatatccgaaggttcaattatgtggtcaaactgttgcagctaattgcaaaatcccagttaacttcattgagtggcgtggcacagaagaattacttcaacattttggataaaatcgttcaaaaggttcttgatgaccaccacaatcctcgcttaatcaaagatcttctgcaagacctaagctctaccctctgcattcttattagaggagtagggaagtctgtattagtgggaaacatcaatatttggatttgccgattagaaactattctcgcctggcaacaacagctacaggatcttcagatgactaagcaagtgaacaatggcctcaccctcagtgaccttcctctgcacatgctgaacaacatcctataccggttctcagacggatgggacatcatcaccttaggccaggtgacccccacgttgtatatgcttagtgaagacagacagctgtggaagaagctttgtcagtaccattttgctgaaaagcagttttgtagacatttgatcctttcagaaaaaggtcatattgaatggaagttgatgtactttgcaacttcatcgacctcttcaagttttaagggctgcccctgccatccctattggagattgtgaatcctgctgtctgtgcagggctcatagtgagtgttctgtgaggtgggtggagactcctcggaagcccctgcttccagaaagcctgggaagaactgcccttctgcaaaggggggactgcatggttgcattttcatcactgaaagtcagaggccaaggaaatcatttctacttctttaaaaactccttctaagcatattaaaatgtgaaattttgcgtactctctctctctatatatatagttcaaaaatactttaggtggtcagctccacattctttgttgacgtgacactaacggccaataatatgcttcttaattatcaaattatagtttcccaattgggaaactaattgggggtgggttacaaaacatttgatccttgtaaatacattgtacagaatatttattttttctcaaaatgcattttaactactacattggctgtgcccaaatgagtcctctttgaatagaaagtgaacccagggcaatgacagccattcttgtcttagggattatggatcggggtatgaattgtgcacacgcagcccaacaacgggcagtggtctctgtgctcctaggcatccagcacaggttctggcagggcacccctgctggggttgggggctggtctgtgcataatcctggactgtgatgggaacagcccagtgcagttctaaacttcaattgtgttgaaactactttaatagacaaagtaataaatcatgtttatctattgatttaaacttcatcagttttgcatcctactgagaaatgttagtgattttgatacttaaatccttaaaagattgcttcgtttttaaaataacgcatgtccattttagaaaattagaaaatcagtcccaccacccaaagattattgtgcatgctgaaaagagtatgaaaaatcccctcagcaggcataggatagaaacgtattgttgtatatttccatttttgaatagggtcaaggagcccaagcaaatcatttctactttttcctttaagcataataataaaagtatacttttatggcgttataaataggactaaaaaaagattctggatttttcagccccacttctgtgaactgacacaaatggccaagaatgcatttatttgtcaaattatagtttctcctgaggcgatgcaaatacctggggcctctgcgaatatatgttagtttttcataagaccataaatgtcccgcatacccgttacttcac

SEQ ID NO: 26767 - DNA, 892 bp, Homo sapiens
gacggaggggcagtgcctactacgcaggcgcacgctgcgggcgacaggaccaggcagcaacattgccacgcggatccgcgccggccaatcagcatggccaggggcggggcttccctgaggcgcgccgggaggcggcggcccacttccggcaataaccgcctggtcgccgtcaggtgcgggcccaggtggccggcgcgcccgttgggcactgggggacgcgggcgcgtcaggtgaagactgggggccgcaggcgcgctaggagaactatgccatttttgggtcaggactggagatctcctggatggagttggattaagacagaagatggctggaagagatgtgaatcttgtagtcagaaacttgaaagagagaataaccgttgtaacatcagtcacagcataggcatggctattgcaccttgggagaagcctttaatcggttagacttctcaagtgcaattcaagatatccgaaggttcaattatgtggtcaaactgcaggacaaattcgagcatcttaaaatgattcaacaggaggagataaggaatctcgaggaagagaaaaaacaactggacggataaaccatagcagtagtttagcaaggactagaagcctttcctctctaagagagaaaggaatgtatgacgtgcagtccactactgagcctaccaacttgatggccaccattttttggatagcagcatctttattagaatcagattatgaatatgaatacgtcctggctctcaggcttctcaacaaactgcttatccatttgcctttgcataaatcagagagtcgagagaagattgaaaatgtccaaagcaaatcgaaatggactagtttgccaggagtccagcagctcttccttaaggggatcagcgggtaccgag

SEQ ID NO: 26768 - DNA, 460 bp, Homo sapiens
acttaaaggtagagatatgttgtcttaagactgtcttcaagtagtttgggaatttttgggttatctgatgagaacttgtttgcttttaataaccttgtactgtccaaatttagttacctgatgtttttagttattttcgtaaataatatgaatcaaacctgaatgcttagatacactctggctctttctaatcttaacttttcctttttttccctcccttcactgcattccttcctgattctttcttcatgatctcgaaggactaccatcttgctttactattcaaggtacttccctgtcttgccacacatcctgtgttcgggatgaaaacgttgcatcgtgctgcatctcatgcacgtcatcttggccactgcccggctcgattccagctctcgctgacttgagctttctcaggaccctgagcagggctgagtggccactttgatcaaacacctcagca

SEQ ID NO: 26769 - DNA, 1527 bp, Homo sapiens
cggcgggtgtggagggttcattcagggagctgcgggcgagtcgggtgggcacgggggccgcccacaggtgcaccgcgcgtcctcagccgcttcccctgcccaccttctgcgaccccttcccgcccccaccctcctgggccgtcttgcaggcccgagcttgtgtccgcctcgctgggcaaggtgtttcggggacgactcctgccggcgtttgccctccgggctcggtccttgcctcttcgccggagaactatgccatttttgggtcaggactggagatctcctggatggagttggattaagacagaagatggctggaagagatgtgaatcttgtagtcagaaacttgaaagagagaataaccgttgtaacatcagtcacagcattatcttaaatagtgaagatggagaaatattcaataatgaagagcatgaatatgcatcgaaaaaaaggaaaaaggaccattttagaaatgacacaaatactcaaaaggcatggctattgcaccttgggagaagcctttaatcggttagacttctcaagtgcaattcaagatatccgaaggttcaattatgtggtcaaactgttgcagctaattgcaaaatcccagttaacttcattgagtggcgtggcacagaagaattacttcaacattttggataaaatcgttcaaaaggttcttgatgaccaccacaatcctcgcttaatcaaagatcttctgcaagacctaagctctaccctctgcattcttattagaggagtagggaagtctgtattagtgggaaacatcaatatttggatttgccgattagaaactattctcgcctggcaacaacagctacaggatcttcagatgactaagcaagtgaacaatggcctcaccctcagtgaccttcctctgcacatgctgaacaacatcctataccggttctcagacggatgggacatcatcaccttaggccaggtgacccccacgttgtatatgcttagtgaagacagacagctgtggaagaagctttgtcagtaccattttgctgaaaagcagttttgtagacatttgatcctttcagaaaaaggtcatattgaatggaagttgatgtactttgcacttcagaaacattacccagcgaaggagcagtacggagacacactgcatttctgtcggcactgcagcattctcttttggaaggactcaggacacccctgcacggcggccgaccctgacagctgcttcacgcctgtgtctccgcagcacttcatcgacctcttcaagttttaagggctgcccctgccatccctattggagattgtgaatcctgctgtctgtgcagggctcatagtgagtgttctgtgaggtgggtggagactcctcggaagcccctgcttccagaaagcctgggaagaactgcccttctgcaaaggggggactgcatggttgcattttcatcactgaaagtcagaggccaaggaaatcatttctacttctttaaaaactccttctaagcatattaaaatgtgaaattttgcgta

SEQ ID NO: 26770 - DNA, 1207 bp, Homo sapiens
gcattgctataattttactatactctcatctaaatctaaaatcagtcttcaaaataaaaacaaattgtcctttgccaaaaatttttttaatcgcacaattaattgacattaactgccaattctttttggctaattgactaattttaacttctgtgttgcttttccagaggcatggctattgcaccttgggagaagcctttaatcggttagacttctcaagtgcaattcaagatatccgaaggttcaattatgtggtcaaactgttgcagctaattgcaaaatcccagttaacttcattgagtggcgtggcacagaagaattacttcaacattttggataaaatcgttcaaaaggttcttgatgaccaccacaatcctcgcttaatcaaagatcttctgcaagacctaagctctaccctctgcattcttattagaggagtagggaagtctgtattagtgggaaacatcaatatttggatttgccgattagaaactattctcgcctggcaacaacagctacaggatcttcagatgactaagcaagtgaacaatggcctcaccctcagtgaccttcctctgcacatgctgaacaacatcctataccggttctcagacggatgggacatcatcaccttaggccaggtgacccccacgttgtatatgcttagtgaagacagacagctgtggaagaagctttgtcagtaccattttgctgaaaagcagttttgtagacatttgatcctttcagaaaaaggtcatattgaatggaagttgatgtactttgcacttcagaaacattacccagcgaaggagcagtacggagacacactgcatttctgtcggcactgcagcattctcttttggaaggactcaggacacccctgcacggcggccgaccctgacagctgcttcacgcctgtgtctccgcagcacttcatcgacctcttcaagttttaagggctgcccctgccatccctattggagattgtgaatcctgctgtctgtgcagggctcatagtgagtgttctgtgaggtgggtggagactcctcggaagcccctgcttccagaaagcctgggaagaactgcccttctgcaaaggggggactgcatggttgcattttcatcactgaaagtcagaggccaaggaaatcatttctacttctttaaaaactccttctaagcatattaaaatgtgaaattttgcgta

SEQ ID NO: 26771 - DNA, 1542 bp, Homo sapiens
agcggagtgtgagcgcgcagtgatgccctagagtgcagtcatcccgggcttggcgcccagcgggtggaaatacggccgcagggtggaaatgcggcggcggggctgcccaggctcctgtgggacccgcgcggcgcgggcacgcacattctcagggacgcgcgtcctcaggccacgagaacacctgaaggccccggccagcgtcctcccgtgaagacccggaccggcgtcgtcacccgccgcgcaggcctaaatctcaggagaactatgccatttttgggtcaggactggagatctcctggatggagttggattaagacagaagatggctggaagagatgtgaatcttgtagtcagaaacttgaaagagagaataaccgttgtaacatcagtcacagcattatcttaaatagtgaagatggagaaatattcaataatgaagagcatgaatatgcatcgaaaaaaaggaaaaaggaccattttagaaatgacacaaatactcaaaaggcatggctattgcaccttgggagaagcctttaatcggttagacttctcaagtgcaattcaagatatccgaaggttcaattatgtggtcaaactgttgcagctaattgcaaaatcccagttaacttcattgagtggcgtggcacagaagaattacttcaacattttggataaaatcgttcaaaaggttcttgatgaccaccacaatcctcgcttaatcaaagatcttctgcaagacctaagctctaccctctgcattcttattagaggagtagggaagtctgtattagtgggaaacatcaatatttggatttgccgattagaaactattctcgcctggcaacaacagctacaggatcttcagatgactaagcaagtgaacaatggcctcaccctcagtgaccttcctctgcacatgctgaacaacatcctataccggttctcagacggatgggacatcatcaccttaggccaggtgacccccacgttgtatatgcttagtgaagacagacagctgtggaagaagctttgtcagtaccattttgctgaaaagcagttttgtagacatttgatcctttcagaaaaaggtcatattgaatggaagttgatgtactttgcacttcagaaacattacccagcgaaggagcagtacggagacacactgcatttctgtcggcactgcagcattctcttttggaaggactcaggacacccctgcacggcggccgaccctgacagctgcttcacgcctgtgtctccgcagcacttcatcgacctcttcaagttttaagggctgcccctgccatccctattggagattgtgaatcctgctgtctgtgcagggctcatagtgagtgttctgtgaggtgggtggagactcctcggaagcccctgcttccagaaagcctgggaagaactgcccttctgcaaaggggggactgcatggttgcattttcatcactgaaagtcagaggccaaggaaatcatttctacttctttaaaaactccttctaagcatattaaaatgtgaaattttgcgta

SEQ ID NO: 26772 - DNA, 2625 bp, Homo sapiens
gacggaggggcagtgcctactacgcaggcgcacgctgcgggcgacaggaccaggcagcaacattgccacgcggatccgcgccggccaatcagcatggccaggggcggggcttccctgaggcgcgccgggaggcggcggcccacttccggcaataaccgcctggtcgccgtcaggtgcgggcccaggtggccggcgcgcccgttgggcactgggggacgcgggcgcgtcaggtgaagactgggggccgcaggcgcgctaggagaactatgccatttttgggtcaggactggagatctcctggatggagttggattaagacagaagatggctggaagagatgtgaatcttgtagtcagaaacttgaaagagagaataaccgttgtaacatcagtcacagcattatcttaaatagtgaagatggagaaatattcaataatgaagagcatgaatatgcatcgaaaaaaaggaaaaaggaccattttagaaatgacacaaatactcaaagtttttatcgtgaaaaatggatctatgtccataaagaaagcacaaaggaaaggcatggctattgcaccttgggagaagcctttaatcggttagacttctcaagtgcaattcaagatatccgaaggttcaattatgtggtcaaactgttgcagctaattgcaaaatcccagttaacttcattgagtggcgtggcacagaagaattacttcaacattttggataaaatcgttcaaaaggttcttgatgaccaccacaatcctcgcttaatcaaagatcttctgcaagacctaagctctaccctctgcattcttattagaggagtagggaagtctgtattagtgggaaacatcaatatttggatttgccgattagaaactattctcgcctggcaacaacagctacaggatcttcagatgactaagcaagtgaacaatggcctcaccctcagtgaccttcctctgcacatgctgaacaacatcctataccggttctcagacggatgggacatcatcaccttaggccaggtgacccccacgttgtatatgcttagtgaagacagacagctgtggaagaagctttgtcagtaccattttgctgaaaagcagttttgtagacatttgatcctttcagaaaaaggtcatattgaatggaagttgatgtactttgcacttcagaaacattacccagcgaaggagcagtacggagacacactgcatttctgtcggcactgcagcattctcttttggaaggactaccatcttgctttactattcaaggactcaggacacccctgcacggcggccgaccctgacagctgcttcacgcctgtgtctccgcagcacttcatcgacctcttcaagttttaagggctgcccctgccatccctattggagattgtgaatcctgctgtctgtgcagggctcatagtgagtgttctgtgaggtgggtggagactcctcggaagcccctgcttccagaaagcctgggaagaactgcccttctgcaaaggggggactgcatggttgcattttcatcactgaaagtcagaggccaaggaaatcatttctacttctttaaaaactccttctaagcatattaaaatgtgaaattttgcgtactctctctctctatatatatagttcaaaaatactttaggtggtcagctccacattctttgttgacgtgacactaacggccaataatatgcttcttaattatcaaattatagtttcccaattgggaaactaattgggggtgggttacaaaacatttgatccttgtaaatacattgtacagaatatttattttttctcaaaatgcattttaactactacattggctgtgcccaaatgagtcctctttgaatagaaagtgaacccagggcaatgacagccattcttgtcttagggattatggatcggggtatgaattgtgcacacgcagcccaacaacgggcagtggtctctgtgctcctaggcatccagcacaggttctggcagggcacccctgctggggttgggggctggtctgtgcataatcctggactgtgatgggaacagcccagtgcagttctaaacttcaattgtgttgaaactactttaatagacaaagtaataaatcatgtttatctattgatttaaacttcatcagttttgcatcctactgagaaatgttagtgattttgatacttaaatccttaaaagattgcttcgtttttaaaataacgcatgtccattttagaaaattagaaaatcagtcccaccacccaaagattattgtgcatgctgaaaagagtatgaaaaatcccctcagcaggcataggatagaaacgtattgttgtatatttccatttttgaatagggtcaaggagcccaagcaaatcatttctactttttcctttaagcataataataaaagtatacttttatggcgttataaataggactaaaaaaagattctggatttttcagccccacttctgtgaactgacacaaatggccaagaatgcatttatttgtcaaattatagtttctcctgaggcgatgcaaatacctggggcctctgcgaatatatgttagtttttcataagaccataaatgtcccgcatacccgttacttcac

SEQ ID NO: 26773 - DNA, 1540 bp, Homo sapiens
gacggaggggcagtgcctactacgcaggcgcacgctgcgggcgacaggaccaggcagcaacattgccacgcggatccgcgccggccaatcagcatggccaggggcggggcttccctgaggcgcgccgggaggcggcggcccacttccggcaataaccgcctggtcgccgtcaggtgcgggcccaggtggccggcgcgcccgttgggcactgggggacgcgggcgcgtcaggtgaagactgggggccgcaggcgcgctaggagaactatgccatttttgggtcaggactggagatctcctggatggagttggattaagacagaagatggctggaagagatgtgaatcttgtagtcagaaacttgaaagagagaataaccgttgtaacatcagtcacagcattatcttaaatagtgaagatggagaaatattcaataatgaagagcatgaatatgcatcgaaaaaaaggaaaaaggaccattttagaaatgacacaaatactcaaagtttttatcgtgaaaaatggatctatgtccataaagaaagcacaaaggaaaggcatggctattgcaccttgggagaagcctttaatcggttagacttctcaagtgcaattcaagatatccgaaggttcaattatgtggtcaaactgttgcagctaattgcaaaatcccagttaacttcattgagtggcgtggcacagaagaattacttcaacattttggataaaatcgttcaaaaggttcttgatgaccaccacaatcctcgcttaatcaaagatcttctgcaagacctaagctctaccctctgcattcttattagaggagtagggaagtctgtattagtgggaaacatcaatatttggatttgccgattagaaactattctcgcctggcaacaacagctacaggatcttcagatgactaagcaagtgaacaatggcctcaccctcagtgaccttcctctgcacatgctgaacaacatcctataccggttctcagacggatgggacatcatcaccttaggccaggtgacccccacgttgtatatgcttagtgaagacagacagctgtggaagaagctttgtcagtaccattttgctgaaaagcagttttgtagacatttgatcctttcagaaacgaaggagcagtacggagacacactgcatttctgtcggcactgcagcattctcttttggaaggactcaggacacccctgcacggcggccgaccctgacagctgcttcacgcctgtgtctccgcagcacttcatcgacctcttcaagttttaagggctgcccctgccatccctattggagattgtgaatcctgctgtctgtgcagggctcatagtgagtgttctgtgaggtgggtggagactcctcggaagcccctgcttccagaaagcctgggaagaactgcccttctgcaaaggggggactgcatggttgcattttcatcactgaaagtcagaggccaaggaaatcatttctacttctttaaaaactccttctaagcatattaaaatgtgaaattttgcgta

SEQ ID NO: 26774 - DNA, 1734 bp, Homo sapiens
gacggaggggcagtgcctactacgcaggcgcacgctgcgggcgacaggaccaggcagcaacattgccacgcggatccgcgccggccaatcagcatggccaggggcggggcttccctgaggcgcgccgggaggcggcggcccacttccggcaataaccgcctggtcgccgtcaggtgcgggcccaggtggccggcgcgcccgttgggcactgggggacgcgggcgcgtcaggtgaagactgggggccgcaggcgcgctaggagaactatgccatttttgggtcaggactggagatctcctggatggagttggattaagacagaagatggctggaagagatgtgaatcttgtagtcagaaacttgaaagagagaataaccgttgtaacatcagtcacagcattatcttaaatagtgaagatggagaaatattcaataatgaagagcatgaatatgcatcgaaaaaaaggaaaaaggaccattttagaaatgacacaaatactcaaagtttttatcgtgaaaaatggatctatgtccataaagaaagcacaaaggaaaggcatggctattgcaccttgggagaagcctttaatcggttagacttctcaagtgcaattcaagatatccgaaggttcaattatgtggtcaaactgttgcagctaattgcaaaatcccagttaacttcattgagtggcgtggcacagaagaattacttcaacattttggataaaatcgttcaaaaggttcttgatgaccaccacaatcctcgcttaatcaaagatcttctgcaagacctaagctctaccctctgcattcttattagaggagtagggaagtctgtattagtgggaaacatcaatatttggatttgccgattagaaactattctcgcctggcaacaacagctacaggatcttcagatgactaagcaagtgaacaatggcctcaccctcagtgaccttcctctgcacatgctgaacaacatcctataccggttctcagacggatgggacatcatcaccttaggccaggtgacccccacgttgtatatgcttagtgaagacagacagctgtggaagaagctttgtcagtaccattttgctgaaaagcagttttgtagacatttgatcctttcagaaaaaggtcatattgaatggaagttgatgtactttgcacttcagaaacattacccagcgaaggagcagtacggagacacactgcatttctgtcggcactgcagcattctcttttggaaggactaccatcttgctttactattcaaggtacttccctgtcttgccacacatcctgtgttcgggatgaaaacgttgcatcgtgctgcatctcatgcacgtcatcttggccactgcccggctcgattccagctctcgctgacttgagctttctcaggaccctgagcagggctgagtggccactttgatcaaacacctcagcaaggacgagagtgttgatgaaatattttgcagaacaacacctgagtgctgagggaggctgctagatgtgcgcataaacacttcaccacacagcacctggtttggcagcactgccagggcatgccatggagagatccagcactgaccccagagcctctggtcccgtttacctgcgttcctcctaagagtctgccagtcttcatccacaaaattaatttttctgtcgtcacttctcatattaaatataattctggatccttaggtatgtgagcatggccagctc

SEQ ID NO: 26775 - DNA, 399 bp, Homo sapiens
tatttaattccccaccagattctaaattctacaaggacaaggacttggccttatcctttcatgccatcacccaatgcttatttcagggcttagcaaacagtatgccctcagtaaatatttgctgagaaaactaactaatgaggacattttaagaaaactttctgcctgcatacagtattttctgaggaatttcaagaagatgaaagttttatttgggatcatcactgctttggacaaaattctttttagataaactcttcccatccagaccatttttagtttatttattttctctccataatttaaaccagaaaggatatttcaatagaattgtgctatagaaaaaaagtacaggcagcaaaattgtgcttatgtagtctgctctcacggaattcctcc

SEQ ID NO: 26776 - DNA, 400 bp, Homo sapiens
tttctctatgagagcacggttagttcccaaataaatcctagcctcctctcttctgttaatttcttcggaaggatttgaggtagcttttgaagtatttggtcaaagttgcaaactcctcgggaggaggccaggcatggtacctcacgcctgtaatcccagcattttgggaggctgaggcgggaggatcacctgaggtcaggaggtcaagaccagcctggtcaacatggcgaaaccctgtctctattaaaaatataaaaatgagctgagtatggtgatgcacgcctgtaatcctagctacttgggaggcttgaggcaggagaatcacttgaacccagaaggcagaggttgccgtgagatgagattgtgccactgcactccagcctgtgtgacaaaacaagac

SEQ ID NO: 26777 - DNA, 965 bp, Homo sapiens
acaaaaaggttccattttagacactttttttgatcaggcagcaggcagtctctggctgtgggaggtgggaaccagtcatatatgcatatgaccaaacagcttttctactggagaagtttagcattggtaagagaaggtgttccaagttgatgtttaaatccacccatttccattttgcttccttacctacaagaaaatttagaagttggtgcaaatggcatttccatgagtacttctcatgcatctttgcatatttcacctggggggaagcacagaggctgagcctgggaggctggatccgcgagggcgcgtcacctcgcctacttgggagtccaggcacatgcacagcgtctaaaggtctaaacagaaagatgggatgtcctgccccagcaaaaatctaatgattttctctctctgtaggagaaaacgaatacagcagggatgacttccaccagctccactttgcagctctgaggtgtattaaaaatgacctggaagaagtcatgccacgggccagaccttaacattcctttcggcttaccccaggatttcagacgaagcttcactttcctaaccagtcacaaatcagagaatttttgattccacctatgacctgtgagctcctgcttcaagatattccaccttttttaggccaaaccaatgtataacctccaagtgtcgatttacactttcgactgtaacttctgctttcctgagatttacccctgcctttaaaaacccttgcttgtaatccctcagggaggccgtgtatttattaatcatgagctgcccaattctccttgcttggtgccctgcaaataaacaccctcttttctcccactgcaaaacctcagtgtggatgtttggctttacttcacccccaggaaagcagacccaggtttgactcagcaacaacatctgtttctatttttctctgtataaatattaaaaaccataagtacatg

SEQ ID NO: 26778 - DNA, 1600 bp, Homo sapiens
gtaagatctgtgccttccgaagagggtagagtcttctggagggacattacaaataatcaggcactcccagtgctgggagctaagttctgttacagggaagagaaagaaacaatgggaataccaaggaggatatttacagagggggaaggctttgagctgaaattgaacggtgaataaaggctgagcagccatgtagagacggggttccaccgtgttagccaggatggtctcgatctcctgacctcgtcatcctcccgccttggcctcccaaagtgctgggattacaggcttgagccaccgcgccccgctctttcgtgttccaaaggctttttaaataaacttccactcctgtcctggattctgctttatggccctcagtcgaattctttcttctgaggaggcaaggactgaagttgcttctgaccagtacagattgggaaggagaaagtcacttgactcacaggccaactgctatggactgaattgtgtcttcccctcattaatatgttgaaaccctatcctccctccaatgtgatggtatttgcagatggggcttttgggaagtaatgaagtttagatgaggcatgagggctggatggatatgatcagatgagtgcccaaagaagagacaccagagagctagcttcttctttctctttccacctttacacactgagaaaaggccaagtgagcacacaccaagaaggcagccatctgcaaacccaaggagagagtcctcactagacaccctgctggtaccttgatcttggacttctagcctccagaactgtgagaaataaattcctgttgttcaagctagtattaatacctggtgttttgttatggcagcctaagtgactaagacaccaacttaatttacttagccagggtcaatcagtggtagggcccaggattctgacccagttctgcctaactccacaattcatgctttttctggatataaacatctgccttcccagtttccctgactcttagagccgtggagcagtgtgtgtcatgtgctgcacacccaggctggaacagcctgtctccaggagaaaacgaatacagcagggatgacttccaccagctccactttgcagctctgaggtgtattaaaaatgacctggaagaagtcatgccacgggccagaccttaacattcctttcggcttaccccaggatttcagacgaagcttcactttcctaaccagtcacaaatcagagaatttttgattccacctatgacctgtgagctcctgcttcaagatattccaccttttttaggccaaaccaatgtataacctccaagtgtcgatttacactttcgactgtaacttctgctttcctgagatttacccctgcctttaaaaacccttgcttgtaatccctcagggaggccgtgtatttattaatcatgagctgcccaattctccttgcttggtgccctgcaaataaacaccctcttttctcccactgcaaaacctcagtgtggatgtttggctttacttcacccccaggaaagcagacccaggtttgactcagcaacaacatctgtttctatttttctctgtataaatattaaaaaccataagtacatg

SEQ ID NO: 26779 - DNA, 977 bp, Homo sapiens
gtaagatctgtgccttccgaagagggtagagtcttctggagggacattacaaataatcaggcactcccagtgctgggagctaagttctgttacagggaagagaaagaaacaatgggaataccaaggaggatatttacagagggggaaggctttgagctgaaattgaacggtgaataaaggctgagcagccatgtagagacggggttccaccgtgttagccaggatggtctcgatctcctgacctcgtcatcctcccgccttggcctcccaaagtgctgggattacaggcttgagccaccgcgccccgctctttcgtgttccaaaggctttttaaataaacttccactcctgtcctggattctgctttatggccctcagtcgaattctttcttctgaggaggcaaggactgaagttgcttctgaccagtacaggagaaaacgaatacagcagggatgacttccaccagctccactttgcagctctgaggtgtattaaaaatgacctggaagaagtcatgccacgggccagaccttaacattcctttcggcttaccccaggatttcagacgaagcttcactttcctaaccagtcacaaatcagagaatttttgattccacctatgacctgtgagctcctgcttcaagatattccaccttttttaggccaaaccaatgtataacctccaagtgtcgatttacactttcgactgtaacttctgctttcctgagatttacccctgcctttaaaaacccttgcttgtaatccctcagggaggccgtgtatttattaatcatgagctgcccaattctccttgcttggtgccctgcaaataaacaccctcttttctcccactgcaaaacctcagtgtggatgtttggctttacttcacccccaggaaagcagacccaggtttgactcagcaacaacatctgtttctatttttctctgtataaatattaaaaaccataagtacatg

SEQ ID NO: 26780 - DNA, 1205 bp, Homo sapiens
gtaagatctgtgccttccgaagagggtagagtcttctggagggacattacaaataatcaggcactcccagtgctgggagctaagttctgttacagggaagagaaagaaacaatgggaataccaaggaggatatttacagagggggaaggctttgagctgaaattgaacggtgaataaaggctgagcagccatgtagagacggggttccaccgtgttagccaggatggtctcgatctcctgacctcgtcatcctcccgccttggcctcccaaagtgctgggattacaggcttgagccaccgcgccccgctctttcgtgttccaaaggctttttaaataaacttccactcctgtcctggattctgctttatggccctcagtcgaattctttcttctgaggaggcaaggactgaagttgcttctgaccagtacagattgggaaggagaaagtcacttgactcacaggccaactgctatggactgaattgtgtcttcccctcattaatatgttgaaaccctatcctccctccaatgtgatggtatttgcagatggggcttttgggaagtaatgaagtttagatgaggcatgagggctggatggatatgatcagatgagtgcccaaagaagagacaccagagagctagcttcttctttctctttccacctttacacactgagaaaaggccaagtgagcacacaccaagaaggcagccatctgcaaacccaaggagagagtcctcactagacaccctgctggtaccttgatcttggacttctagcctccagaactgtgagaaataaattcctgttgttcaagctagtattaatacctggtgttttgttatggcagcctaagtgactaagacaccaacttaatttacttagccagggtcaatcagtggtagggcccaggattctgacccagttctgcctaactccacaattcatgctttttctggatataaacatctgccttcccagtttccctgactcttagagccgtggagcagtgtgtgtcatgtgctgcacacccaggctggaacagcctgtctccaggagaaaacgaatacagcagggatgacttccaccagctccactttgcagctctgaggtgtattaaaaatttgtttttcagaaacctagagccccaccaaatgaatccgctggcacgtggacctcagatgggggaaactgaggactgaattc

SEQ ID NO: 26781 - DNA, 1052 bp, Homo sapiens
gtaagatctgtgccttccgaagagggtagagtcttctggagggacattacaaataatcaggcactcccagtgctgggagctaagttctgttacagggaagagaaagaaacaatgggaataccaaggaggatatttacagagggggaaggctttgagctgaaattgaacggtgaataaaggctgagcagccatgtagagacggggttccaccgtgttagccaggatggtctcgatctcctgacctcgtcatcctcccgccttggcctcccaaagtgctgggattacaggcttgagccaccgcgccccgctctttcgtgttccaaaggctttttaaataaacttccactcctgtcctggattctgctttatggccctcagtcgaattctttcttctgaggaggcaaggactgaagttgcttctgaccagtacagtttccctgactcttagagccgtggagcagtgtgtgtcatgtgctgcacacccaggctggaacagcctgtctccaggagaaaacgaatacagcagggatgacttccaccagctccactttgcagctctgaggtgtattaaaaatgacctggaagaagtcatgccacgggccagaccttaacattcctttcggcttaccccaggatttcagacgaagcttcactttcctaaccagtcacaaatcagagaatttttgattccacctatgacctgtgagctcctgcttcaagatattccaccttttttaggccaaaccaatgtataacctccaagtgtcgatttacactttcgactgtaacttctgctttcctgagatttacccctgcctttaaaaacccttgcttgtaatccctcagggaggccgtgtatttattaatcatgagctgcccaattctccttgcttggtgccctgcaaataaacaccctcttttctcccactgcaaaacctcagtgtggatgtttggctttacttcacccccaggaaagcagacccaggtttgactcagcaacaacatctgtttctatttttctctgtataaatattaaaaaccataagtacatg

SEQ ID NO: 26782 - DNA, 486 bp, Homo sapiens
cttagagtaaaaaatgctttactctattactctgctccaaaattagacaagtagctgtctttactttcattctcttctgagttcttgtacctcaattaagacattctttggccatgaaactgcgtgggcttctagtttatttttaacttttaaaaatggatataactgaaacacaagaatagaaataatctccctgttcatcacccagcatcaacagtttgtatattggcaggcctcttgatcttcataaatactgtacggacttattgtttttgttaagccatcagcttaacagtgcacttgtataaaagtgcattctgggcaaaaaactggctcaacaccattagtcattggggaattacaaattaaaatcacattgggatgctactatacacccacgttaatggctcagattaaaaagactgacagaacgaagtgttgttgaggatatggagcaattggaatgctcatactttgctggaggga

SEQ ID NO: 26783 - DNA, 298 bp, Homo sapiens
atatataaagtacctacatgtatcactgttctagtataatcagtatgttataaagcatacagagaataagggtatttgaaaagaacgaggaagaaaatgaatcatcttgtaaacttcctgactgcacacaccacagagagatcatttgtctttttcgagacataggagttagttctttttttctgattatgcttgtaatgggtccttcaggttcttgtgtatgatatctaagcaatttaaaaaattgataaccaaggcccagaagtaaacttacattcatggttaatattattgatcc

SEQ ID NO: 26784 - DNA, 457 bp, Homo sapiens
gtgggagatgattagacaatgggtgcagtttctaatagtttaacaccatctacctgggtactgttctcgtgatactgagttctcaaaagacctggttgtttaaaagtgtgtagtacggtcccccctacggcaccccgcttcctccagccatgtaagacttgccagcttcccctttgctttctgccatgattgaaagcttcctgaggccgagtgcggtggctcacgcctgtctcaacattttggaaggccgaggcgggattataggcatgagccatggtgctcggcctcaggtatttctttatagcagcacgacaacaaaactgatacaaacctagataaaagttcttaaattttcaatgtgatgaaatttgttctaaaaaccctcttaaaaaagtacaccaggatacacgttgaataaagccagctaagctatttcctgttatgcacatgtatagcc

SEQ ID NO: 26785 - DNA, 399 bp, Homo sapiens
ggtacgacgtcgaggtgtcatgggttattattttattcaatagattataatctattgttatgattctttgttttgctaccctgtatttggccagtgaaagcctctgggaaatacagggggctcttgtatgtttttgatatctcttcatcattccacgagtacctccttatatcttgtcagttatcaagatgtgaaactatttttttggtatgtaaaggctcatgaaaatgtctctttgtgtggatgtaatttctcttttaattttataacatctatatacttttggtaaatagagttttttttttattgttgccaatagccatacttcttaacattgtggctcctttggtttttacagtaatattcaaaaggcaagcactagtcagggtagcggaatct

SEQ ID NO: 26786 - DNA, 633 bp, Homo sapiens
cgtctgtaccttagtaggtcattaggatccacgtaatgggtcatggcccggacttttcttttttaatgaagagaacagaaccaggcacagtggctcacacctgtaatccatcacagcattttgggaggcccaggccggatgattgtttgaggtcaggagtttgagacccagcctggccaatatggtgaaatcccatctctacctaaaaaatacaaaaaaattagctgagtgtggtgccacatgcctgtaatcccagctacttgggaggctgagggaggagaattgcttgaacctggcaggcggaggttgcagtgagccgagatcgcaccaccgcactacagcctgggcgacagagtgagactccgtcgcaaaaaaaaagaaggaccggggtcttcgatgtggtgttcactgactttccagggagttcttctcactcactccttggagttcggaggccaaaacagaacattcagtcagggctgacatgaatttgtcataagtctcccctttgcctataacatataactagtgggaaccttgctaattaaaacaatttggccagtgacagtggctcacacctgtagtcccagttacataggaggctgaggcaggaggattgcttgaggccaggag

SEQ ID NO: 26787 - DNA, 598 bp, Homo sapiens
gaaaacatagtcactatctgagacacaaataggttagaacacaaatatgaacatttttatgggaacagacagggcacacttggatttgtatttagactcagcattaaataaatcttaataatgtagtacaaacatctcattttgctgatgagcacactgaggcttaagaaggtcaagtgactcatctaatgatacatatttaattgggtgaagagctcagactgggaagcttcacatcaaggagaagggcagggaaagggagagagagagtgaatacaagaaaaaaacagaaaggtgagtcatgggagagatgttaagctatatgttttcctttgctgtgagctgttgtaaaaggtaagcatctctttgacaatcatttggtttccaggctatctctggggacccatgtctgggactggaaatgatctttgtgggctctgatggaagtcatttttttttcctttcctgtcttaacaattgcacatacttattttattgagcctcccaagtttcctcctaaggtttccttttggaaaccaagaattaatcaaattaaatgatataacccataactttgtagcaacgtaacaaaaaaaaa

SEQ ID NO: 26788 - DNA, 329 bp, Homo sapiens
gttttagcatcggttgatgaccattgctttattcagttatttcagtgggggttccaaaatggtaatttttctaattctagcatttcttcaacattagctaacatttttctataaaaaagagctttctactctccctttccaagtattactatggattctgaaattctttcctttggaaatttaatgttttataattccttaacataattaattttgatgctcacatagtgtcccaaatttgactccctcaagccagatcctgtgttttttttttcttttttttttttttaatgaccctataaatatttgagaacttccttgctttctgg

SEQ ID NO: 26789 - DNA, 271 bp, Homo sapiens
tcccggtgggactatttttaacctctgtaaagaaaaaggccagcgatccacgtcgtgcccgctgcctcacacttactgggcagcttcctctcctggagggtcatttactgacagtgatgggtttcaggtgggcctagtttagcaggtggtttctataaagagcagagctgcatccccagggaacgagagccgggcagaggggaagccaggggagacaggcactgtccgtgttatggattttatcgagtcataaacaaggctggagaataaa

SEQ ID NO: 26790 - DNA, 359 bp, Homo sapiens
gaattgtattaactcactgctaatgttttcttttagtacttattaaacattcactaaacaaacatttctgaatgcctattatgtgccaggtactattctagacatataggatatgttgattaataccacaaatatctaccattctgtaacttacatatattaaaagacccactttataaaaataatgtagtttacttaaaatctgtgttgatatattttaatatggctgcataaccttttttacattagtattatcaaatatatcttcttttatatctttaatttcaaccttactgaaagaatatcttttatttaggtatgtattttatatacatattacgagtttatttgtttttaag

SEQ ID NO: 26791 - DNA, 607 bp, Homo sapiens
agtcgataacaggtctggggatggagttgaagaatacttaaatttcatgagtgttttcctcttttctctaaatataaaagagacttgtagtttacatgtcatgatgttaaataatagatcaaatccatgtggtcacttttgaactgttctatacttttttaaaaggtgaaataagatcgtgagtaatgaggaatactgatgtttcggtttggtgaattggaaattgtggctattaactaatatttaccaactcaccagtatctaagatgtgcccaggacttgttcctaggtatgatggcaacccacaatgcccaaaacacaaaaatctgtccttgtaaatttacttcccatgagagagaaaatactaaatcaataaagacacaatatgctgcatagtaataagtgctaaggaagaaaacagactaggagcaagacattttttggaagagttgttattcaaaataacttcacggtctggcgagagggttcatgcctataatcccaatactttgggaggccagggcaggataatcatctgagcgcaggagtttgagaccagactgggcaaaaaaagtgagacaccttcctcccaccccacatctctcca

SEQ ID NO: 26792 - DNA, 437 bp, Homo sapiens
atctcaataaaacagagcttgatccctgtcacttccttggtacaacagcctttatgcctctttacaggacagaccatgcaggaaaactgcatatgacattgttctctctgagaagcctcagtgcccaccacactcacagcctgctgtggaccatgtgccccagatacccaagccataggtagtgggaccagggataggtactcctgggaattattcttaatttggaggaagtgtaactatgtttaaacattttttttcagctgggcgcaatggctcacgtctataatcccagcactctaggagtccgaggcagggggatcactagctgggaggctgaggcaggagaatcgcttgaacggagaggtggaggttgcagtaagccaagaacgcaccattgcactccagcctgggcgacaagagtgaaactccgtctcaaa

SEQ ID NO: 26793 - DNA, 492 bp, Homo sapiens
atggcggaggacaggccgcagcagccgcagctggacatgccgctggtcctggaccagggcctgaccaggcagatgcggctacgcgtggagagcctgaagcagcgcggggagaagcgccaggatggggagaagctgctgcagccagcggagtctgtgtaccgcctcaacttcacccagcagcagcggctacagttcgagcgctggaatgtcgtgctggacaagccgggcaaggtcaccatcacaggcacctcgcagaactggacgcctgacctcaccaacctcatgacacgccagctgctggaccccactgccatcttctggcgcaaggaggactcggatgccatagattggaatgaggccgacgccctggagtttggggagcgcctgtcggacctggccaagatccgcaaggtcatgtacttcctcgtcacctttggcgagggtgtggagcccgccaacctcaaggcctccgtggtttttaaccagctctga

SEQ ID NO: 26794 - DNA, 415 bp, Homo sapiens
ttgggaccctgagcctcatttctccagggtgggcggtgtcagggctccaggtagggctgctacaggtctgagggccccaggacaccctgtcagcctgcaggtcactgggatgaagcaggcagggtggtgggcgtgtgaggactcacccaggctggctggtggcactggtccctggtgtctgggtgagggcctggggctgcaggggtcctgctgggcagagcctcatgtctgtctccccactttcctcctttccccctcctgcctcctctatcttgttaatcttttcccttccgtttctttcctgcttttttctgtctctgccatcccatgcctggctgttccacctctgtctcccctgcttctctggtgtatctgtgacctctgttctgccattgtctcccctgcctgcctctcc

SEQ ID NO: 26795 - DNA, 193 bp, Homo sapiens
gttggatgttttgctcccttgtggcacacaattggagacgtgcaactgtgccacattaaaaacaaaacactgctggcctcaaaacacacctgccacctctgacagcatccacttccctcccccttatgactgctgcctttttcaaaatgagagtgtttggaatgatttcctggcagtatccatagtggttgct

SEQ ID NO: 26796 - DNA, 879 bp, Homo sapiens
gggtctggaggcagggaaccgaaagctgattcatgctgacttcccagaactcaatcaaaaggaaaaccccaactttccatgcccaagtaacaaaaggactggatgctattccctttgcaagcctctcctaccttctctgtgtggcagatggaaaactgaaagtatttctcattggttgctttgtgcaaccatttctactactggcgccaggaggctgtgagcgggtgctgggactcggggcaagctggcagcgctctacacctggatgctcacctaaaagtcactgccctccccactccctcgtcctgactgcagtgtgcagagagtgctggcacctaacacccctcaaagcctgtctgtgcagctccacagtgctgtcctatgctgtgagcacacccctcccggagggacagtgacttgattcaacccattgtggtcatttatctactcatttcctctcctttgaatcgagaggtccttgaggtaaggatttctcttgttcattatcctatactcctaaagacttagaaatccacaggagaaccaccacacatttagaaacagaaactgggccaggtgtggtggcccattcctgtaatcctagcactttgggaggctgaggcaggaggatcacttgagcccaggagtttgagaccagcctgaacaatatagtagggccctgtctctacagaaaagaaagaaataattagctgggcatggtggcacacatctgaagtgtcagctacttgagaggccaaggtgggaggatcgcttgggtttggggggatcacttgagccagggaggtcaaggctgcagtgagccatgactgcaccactacactccagccttggcaatagagtgagatcctgtgtcaaaca

SEQ ID NO: 26797 - DNA, 340 bp, Homo sapiens
ctttgtacccctcacaggaacaccaaattgtaacaagtatctgcacacagaaaagcaccatcacaagaaccaaaaatcaggtgagcaatcacagcacctgatttcatatctctgaaaaaggtattgaggagggtccaacagacagtcttgaatcaccaacaccaaccctcccctatcccctggcaacagctgtacagcatggagagtatctgcacttgcagagtacaccaactgggggacattacattgaactcattgctcccctgtcatagtggcgagcaaagccaggctgggctcacccagcacccacacacacaggagcatttggaccagccctagc

SEQ ID NO: 26798 - DNA, 581 bp, Homo sapiens
tggccatctaaaaatctatgatagtctctccatttcaaaatccttaactctaattgcatttgcaaagtctgtcctgccaggtaagctaacaaatttataaattatctggattaggaccgcatcatctctgaagagccattattctgactaccacatcagtatgttagtttatgtcaagattgctgtaataatcaataggttctggtaccacaaatccagtagcagtcattaaggttgattgagtttattgattgctttcagctccattctgctattaatcacttttggggatataaaatgaagaccttatcacatagaggaagaggtagatgtgataggagcttgaatatgtaataagaattttttatgatatgtaaatgtgagaaatgaattaagtatgtgccatttgttctcttctttttaagacatttctttctaaaggtttagtgacagaagttgcattctattaaagatccctaagtgctgttctgctgtaggcataagctttctttcctgggtgcagcatgttaggatttaagatttctatttatctaatactctgctgtttgtcagataaaata

SEQ ID NO: 26799 - DNA, 459 bp, Homo sapiens
caaaatccccttgacgaagaaaaagaaaggcagtgagcttgaatgggaagagggcgggctttagtcacaacttctctgagcctcagctttctcatctccagaatggctactgtgatgcctatctagtagatttgttgtaagaattacacttattatgaaggctgggcatggtggctcatgcctataatcgcaacactttgtgaagccaagaagggcagatcacccggggtcaggagttcaagaccagtctggccaacatggtgaaaccccatctctactaaaaatacaaaaattagccaaaaacaaaaattagccaggcgcatggtgcccacctgtaatcccagctactcaggaggctgaggcaggagaatcgcttgaatctgggaggtggaggttgcagtgagccgaggtcacgccactgtactccagcctgggcaacaagagagaaactccacttca

SEQ ID NO: 26800 - DNA, 579 bp, Homo sapiens
tgttattctagctttataaaacataacccatttgaaaaatattcacttggacttgcttggcaagttaaggtccacttttggtgagaactgtggttaccatgtctgagtaatctatgaccccttcaaactctagtcattgatgcctgtgattgcattcactggctcttggttcaacaaggctttctcagagtggttcaaggcataagaataggtgtttccttaatgaaacacctatttgtgattaaattctctagaataaagagtgttaaacagatttctttactgcaggtcttcacagaggctttaatgtactaatatgtatctcaattttcctagaaagagtgtgcaagcttcccagacttatttgaccttagagcatcttgttggatgtggcttccatgaattatactttaggggactaatgtatttctttccttgctctctgagggcacagaaccacctgagtaaccatggttgtctccacaagttctagtgctacatcctctttagtgctgtaagggttgtaggagaactttaagaaagaggaccaacatcctctgcatggatctggattcagtg

SEQ ID NO: 26801 - DNA, 568 bp, Homo sapiens
ttagcaaggaccaggaccttaatataaacccagctccccattttcccgggtttctcatgcttccctaaactcggtcgccccctacagccccctgcccctgggttcttttccacatcccccaccactcctccatttcgcatccaagacttcatgaaaggctttcccagaaaagaaaaaatgaggagtcttgcgacttgaacagccctcccctgcccgtctgcaaatttgaattcctggatttcacaacagtgagctcttcttgtgcctaccacccggcatgagcaagacaagggggtgggtggtgggagagtggggaagtgtgggaaagaaaagtgtagacaaatgggtggaacaaagaagtttgacttaaagtttagatttgggggctagagttctggtcccagttcaactaagtgtacaagcttgataatcgtgggccttcctatcacactggcctcttccagcaaaaccctacccattctcatctctagaggccttgacttcccttatcaccctgcattataatatttgataacatgggccgggagtggtggctcatgcctgcaag

SEQ ID NO: 26802 - DNA, 231 bp, Homo sapiens
tattcaattcagatcggggttgtgtaaaatatatttttatcctgaatcaggaggagaagactccactcaggaacaaccttttccaatgctcttgggctgttttcctgaactgtgtttggtgagcacgctgatacctagaagcagacccttacgactttacagtagcatttgtggggtcattaactttgaataaatgcctaaggatgacctctttttacaattgtccttacc

SEQ ID NO: 26803 - DNA, 395 bp, Homo sapiens
tcctgatggccatcattagaataaataagtttccttctagtcctagttggctgggagtgttttttttttctttttaaatcatgaatggatgctccattttgccagaagctttttctgcatctatttagatgaccatgtggtttttcttccttattctattcatatagtggaatacattaagtgattttctaatggtaaaccaaccatgcactcctgtgataaatcctgcttagtcatagtgaattacattattttcatgcgtcactgaatcagatatgctaatatgttgtgaataatttttgcatcagtgtttgtgcaaacattgatgggatattgtatgatatttttcttttcttatcaagtttatgtcaggttttggtatcagggttgtactg

SEQ ID NO: 26804 - DNA, 469 bp, Homo sapiens
gttatgatggtaaaatctatgtttttttaacgggattattgcaaaagttgaataccagtaaacagtgtttgcattatagtaatcaggtaagtattgttatctttaggagcactgggcatgctggaagtattcttccttctctcagatcttaatgccatagccactttgacacttggagaataatcctgagatttagttcaaaaagattcttctgcttcatactcatcaattgctaaattcacacttagtttgctacagatatgaatcatatctgtcttatatattaggttggggcaaaagtaattgccattacttttagtttgcagttaaaagtaatggcaaaaacctgccaggcacagtggctgacacctgtaatcccagcactttggaggccaaggtgggtgaatcacatcacaaggtcaggagttcgagaccagcttggccaacatagtgaaaccccgtctctact

SEQ ID NO: 26805 - DNA, 320 bp, Homo sapiens
ccatgcaaagtgtagtcaagattttgcattcttggcatacaagcaagaacgtgtaggggactgggtgcagtgtctcatggccataatcccggcaatttgggaggctgaggcaggtggatcacttgaggtcaggagcttgagactagcctggtcaatacagtgaaactccatctctacaaaaattaggccaggtgtggtggctcatgcctgtaatcccagtactctgggagggtgaggtgggcagatcacctgaggtcaggagtttgagacgagcctggccaaaatggtgaaacggctcactaaatacactaaattcacta

SEQ ID NO: 26806 - DNA, 495 bp, Homo sapiens
aatttgattaattaattgaaaagtacagtacaggccttcaaggagagacttgatcaagcagaacaaagaatctcagaacttgaagacgggttgtttgaaatattttctgcagaaaaaaataaatataacaaaggctacagtacttatggaacaccattaggcaaaaaaatattcatattatgggctttccagaaggagaagagaagggaaaagcatagaaaacctattaatgaaataatagctgaaaacttcccaaggctgtggagagatatggacatctggatccaggaagttcaaacatccccaatgagacttaacccaaacaggtcttttctgaggtatattacagacaaattttcaaaagtcaaagacaaagagaaaattctaaagctagccagaggtaagcagcaagtcacatataaaagaatctgtaattagaccaacagcatttctctgcagaaaccttatagaacaggagagaatggtcaaagtacc

SEQ ID NO: 26807 - DNA, 389 bp, Homo sapiens
agatcagtttggctgcaattttggctccttggaccctcaagcatagctggtaaatcaagttagagatgtaactgccttaaaacgtgccagcttaggctgggcgcggtggctcacgcctgtagtcccagcacttcgggaggctggggcaggcggatcacctgaggtcaggagttcgggaccggcctgaccaacgtggagaaattctgtccctactaaaaatgcaaaattggccgggtgtggtggtgcatgcctgtaatcccagctacttgggaggctgaggcaagagaattgcttgaacccagggaggcggaggttgcagtgagccgagatcacgccattgcattccagcttgggcaacaaaagcaaaactctgtctcaaaaaaaaaaaa

SEQ ID NO: 26808 - DNA, 284 bp, Homo sapiens
cctgaccctgccctggaaccggcaccatccaacagacatgggaaatggagggacagtggccgcagggggatgctggaagctcacgaaacctcctagggggcggccgggggctgagggaagctcacaaaacctcctaggaggtgggccctgtccttggtgccgccccctcctcgccactccccccaccccttccaggaatgcaaggtgcccggctcagagggaggaaccacagccctctcctggaggcacaggagacgctgccctgagagtcaagaattaaccag

SEQ ID NO: 26809 - DNA, 366 bp, Homo sapiens
aagttctggaaaaacaaactgcaatcagtcagctgtgaagggaaatcatttacaaccctaaggcatcagaggatgctgctccgaactgttggaaacaaggacattagcttttgtgtttgtttttgttctccctttcccagtgttaatgggggactttgaaaatgtttgggagataggatgaagtcatgattttgcttttgcaagttttcctttaaattatttctctctcgctctcctcttcccactcccacactgaaaaacaaagaagaaaaaagaaacaaaaccataaacaaaatctatgaagaaatgcattgtagaaacattcatgtccactgatggttcctaagaagagaagggaaaaagaaa

SEQ ID NO: 26810 - DNA, 394 bp, Homo sapiens
gatgaaattctgcctaacaacagaggcattttgtctttgtttacagacagtggaatgtctttggcaggactttaatgattccacttcagcagcattttgacaagcaagtttagcaatggatgagaccaacaatagcaaatcaacagtgaaaagttcacttacaagtcaagaccaaacatttcatttgaatattttgcttggcagtaaataggggactctctgaacagttatttaaaatttgacatgataatagggaagaaagagtacttcctcacagagcacctccatgcaccttctgctcagcagacactggaaaacaagttgattagaacactgttgggtcttgtgtttggttttatttttttggtagagctgatttgatccacctcaactt

SEQ ID NO: 26811 - DNA, 349 bp, Homo sapiens
gctgctaatccacacctctgccatcctcttctgatggagttcagaatggggaggagttttacaggatatttcatttgttactattccatttcacccagttaaactgagtccattcctccaactgccacaacatttttttcattgttgtaaaatatatataacatgaagttggccattttatccaggtttaagtgtataagtcggcagcattaactatatttacaatgctgtgtaaccctgtcgtgatcttttgaagtactcttttgactgttctggtgcatagacaatgctcaataatttgttggtggattaaaaaaagaatgaatgaatatcatctgaaaaggttact

SEQ ID NO: 26812 - DNA, 468 bp, Homo sapiens
gattaaaaatttaaatgtaagacatgaaaaattagactaccatacactgttgttggtaagttaaattatttcacttattatgaaaaactgtatggtggtttctcaaaacaaaaatagagacaccatatgatctagtgatcccactactaggtgtttatccaaaggaaaggaaatcattacacttaagaggcatctgcacctccatatttattgcagctgtcttcacaataaccaagatatggaattaagctaaatatccatcaatggatggatagataaaaaatgtggtatatacatataccaaatttgtatatacattcatatatatatatatatatatgaataatattctgccataaaaagaatgaaattctgtcatttgcagaatcatggataagactagcgaacattatgttaagtggaataagtcagactcagaaaaattaatactgtctgtccttacccata

SEQ ID NO: 26813 - DNA, 304 bp, Homo sapiens
cctgcattttccacaggagacaactgaggcaggaaggggtacagaagtccaacagggaggcaacagatgagaggggcatggctatcctagctgctactgttcccctgctctggaaagggtcttctctgagatgctttctacagtggacgttttggggtagtcaaagtacagcctgtgtagcctgccatgagcaaggctttttctttcgaaatgttcgtgttttagctttaaagtgtctgtgaagctgcctttcattccataatatgtctatacttcttttaattaaaaaacggtttgcattgtt

SEQ ID NO: 26814 - DNA, 339 bp, Homo sapiens
tgagtggccgcttttgaggatggaatttgaagtttttgtgcattaaagaaagcagattacctcacacctgtaatcccagcacttggagaggccgaggcaggcagatcacctgaggtcaggagttcaaaaccagcctgaccaacatggtgaaaccccgtctctattagaaatacaaaaattagccaggtgtggtggcgggtgcctgtaatcccagctacttgagaggctgaggcaggaaaattgcttgaacctgggaggcagaggttgcagtgagccgagattgcgccactgcactccagcctgggcaacagagcaagattccatgtcgacgcggccgcg

SEQ ID NO: 26815 - DNA, 2504 bp, Homo sapiens
taaattaaataattaaatagatgatttttacatactgtagagctatagagaaaatatagctggatgggtgatagtgacttggggatgggggtggctactctggatagggtagtttaaggtgacatctctgtgcagatgtagaatgggctagtgctttctaagaactgaaagatcagtgaagaaggggagcatagtgactgaggagtagtgtggcattagatggggtctgagagttacacaggaacatgtggagcctgtaggccatggtaaagcctttttctactcttctggtgatttaaagccattgtaaagttttgagcttgggagtaggtagcaaaataagatttatatttttatggggttactctggctgttgagaggagaaaaagacatgaatctgggaggccacttgggaagcaaggccatcagtgaagagaaagagtgggagaaaaaggtttgaggagagaaggtataggactttcactaaccttggaccatatatttgccaggaagaatgtaagttctccaacatcttcaaataaagaagtggttatgaggaatgatcagaataatggagatatgaaaccattccagaatttcacaacaataccaatcacacaggctctcaactacaatctgagcaaagaagggcatttagaaaaagaaccttggaatgcattcagccatcatggcccagttaatgtctccatcaatggaattccttgcattctcttctgggccaaaagaataatgattaaatttaagaatcaaacctggctggaccttacagacgagccatttggtcagaaggtaactgtggaccctgacaactcaaattgcagtgaagaaagtgctagaaaaaaaaagtaggctcctttgtataggaccctgacacacatctttgaggaagtatttactgtctaaaataaaggaacaagtcagaagttaacttcaaaaattgttggctgggcatggtggctcacgcctgtaatcccagcacttcgggaggccaagggagtggatcacctgaggtcaggagttggagacaagcctggccaacatggtgaaacctcgtctctactaaaatacaaaaattagccgggcgtggtggcaggtgcctgtaatcccagctactcaggaggctgagacaggagaattgcttgaacctgggaggtggaggttgtggtgagctgagatcgcgccattgctctccagcttgggtgacagagtgagtgagactccatctcaaaaaaaaaaaattgttatattttcccggcagttttcttctgaacctttttgctaattgtcggaataacttgtagaaaatgagactttggaaagcaagggttctcaaactcgttttgaaaacagcaaaggattccaggcttggtctcaactccaaatggttgtctttgaagcttggtgatgctggaaaccccagaagtcttgctataagattcatccttaccaattacaacaagttgtccatccagagttggtttagtttgcgccgagtcgagatcatttccaacaattcaatccaagcagtctttaacccaactggcgtatatgctccctctggttactcctaccgctgccaacgcgtgggcagcctgcagcaggaccaggccctcttgctgcccagcgacacggatgatgggtcgagcctgtgggaggtcacttttattgatttccagatccaaggttttgccatcaaggggggacgatttaccaaagcccaagactgcgcctcctccttctcgccagcttttctgatcggcctggcaatgtccctgatcctgctgctggtgttggcctatgccctgcacatgctcatctacctgcggtatctggaccaacaatatgatctcatcgcctctcctgcccacttctcgcagctgaaagctcgagacacagccgaagagaaggagctgctgaggagccagggggctgaatgctataaactgagaagccaacagatcagcaaaatctatgtttagcagcacaggctggcccccaccatgtccacagtgggctccgaaagttgtctctgttctgtgctatttgacttgtgaattacagattttcaccaaatggcttgattacaaaaaaaaagaaaaaacacaaaaaggaaatagataatgaattctttttgaaccatccactggcctacttaggtagacttggggcaatcaaaaaaggcatctcagggatcccacagagacaaatatgactgttagttgcctcaaagtaccctgaaagcaaaggggtatttcaagtacggaaaaagagagagagagaagaagaaggaggaggaggaggaggaggagaaggagaaggaggagcaggaggaagaggaggaggaggaggaaagggagggagggagggagagggagagagagagaaagattggcaacacagagaagggaaaacacacttggtcctccttgcctgtgccagtttggatgtgacaattatagaaataataaaccaagattatctgg

SEQ ID NO: 26816 - DNA, 1552 bp, Homo sapiens
gacgcggggctaggtcagagtaggaaggagtcgctgagctgaatctttgtggagtggagtggggcgagagtcctccgagtagtctggaaaattagacttctgagccttaattcatacttataagcagctagtaaattgtaaaatatagtgaagcaatgtagtgtagtaactaaaaccccaagctttggagccagattgggcctttaaccctaaagttgccgtttattttgactggcgagtcatttacttatagatttatttatttttatttttattttttttgagactccatctcaaaaaaaaaaaattgttatattttcccggcagttttcttctgaacctttttgctaattgtcggaataacttgtagaaaatgagactttggaaagcaagggttctcaaactcgttttgaaaacagcaaaggattccaggcttggtctcaactccaaatggttgtctttgaagcttggtgatgctggaaaccccagaagtcttgctataagattcatccttaccaattacaacaagttgtccatccagagttggtttagtttgcgccgagtcgagatcatttccaacaattcaatccaagcagtctttaacccaactggcgtatatgctccctctggttactcctaccgctgccaacgcgtgggcagcctgcagcaggaccaggccctcttgctgcccagcgacacggatgatgggtcgagcctgtgggaggtcacttttattgatttccagatccaaggttttgccatcaaggggggacgatttaccaaagcccaagactgcgcctcctccttctcgccagcttttctgatcggcctggcaatgtccctgatcctgctgctggtgttggcctatgccctgcacatgctcatctacctgcggtatctggaccaacaatatgatctcatcgcctctcctgcccacttctcgcagctgaaagctcgagacacagccgaagagaaggagctgctgaggagccagggggctgaatgctataaactgagaagccaacagatcagcaaaatctatgtttagcagcacaggctggcccccaccatgtccacagtgggctccgaaagttgtctctgttctgtgctatttgacttgtgaattacagattttcaccaaatggcttgattacaaaaaaaaagaaaaaacacaaaaaggaaatagataatgaattctttttgaaccatccactggcctacttaggtagacttggggcaatcaaaaaaggcatctcagggatcccacagagacaaatatgactgttagttgcctcaaagtaccctgaaagcaaaggggtatttcaagtacggaaaaagagagagagagaagaagaaggaggaggaggaggaggaggagaaggagaaggaggagcaggaggaagaggaggaggaggaggaaagggagggagggagggagagggagagagagagaaagattggcaacacagagaagggaaaacacacttggtcctccttgcctgtgccagtttggatgtgacaattatagaaataataaaccaagattatctgg

SEQ ID NO: 26817 - DNA, 1638 bp, Homo sapiens
gacgcggggctaggtcagagtaggaaggagtcgctgagctgaatctttgtggagtggagtggggcgagagtcctccgagtagtctggaaaattagacttctgagccttaattcatacttataagcagctagtaaattgtaaaatatagtgaagcaatgtagtgtagtaactaaaaccccaagctttggagccagattgggcctttaaccctaaagttgccgtttattttgactggcgagtcatttacttatagatttatttatttttatttttatttttttctgagacagggtctcactctgtcttctaggctgttgtggtgagctgagatcgcgccattgctctccagcttgggtgacagagtgagtgagactccatctcaaaaaaaaaaaattgttatattttcccggcagttttcttctgaacctttttgctaattgtcggaataacttgtagaaaatgagactttggaaagcaagggttctcaaactcgttttgaaaacagcaaaggattccaggcttggtctcaactccaaatggttgtctttgaagcttggtgatgctggaaaccccagaagtcttgctataagattcatccttaccaattacaacaagttgtccatccagagttggtttagtttgcgccgagtcgagatcatttccaacaattcaatccaagcagtctttaacccaactggcgtatatgctccctctggttactcctaccgctgccaacgcgtgggcagcctgcagcaggaccaggccctcttgctgcccagcgacacggatgatgggtcgagcctgtgggaggtcacttttattgatttccagatccaaggttttgccatcaaggggggacgatttaccaaagcccaagactgcgcctcctccttctcgccagcttttctgatcggcctggcaatgtccctgatcctgctgctggtgttggcctatgccctgcacatgctcatctacctgcggtatctggaccaacaatatgatctcatcgcctctcctgcccacttctcgcagctgaaagctcgagacacagccgaagagaaggagctgctgaggagccagggggctgaatgctataaactgagaagccaacagatcagcaaaatctatgtttagcagcacaggctggcccccaccatgtccacagtgggctccgaaagttgtctctgttctgtgctatttgacttgtgaattacagattttcaccaaatggcttgattacaaaaaaaaagaaaaaacacaaaaaggaaatagataatgaattctttttgaaccatccactggcctacttaggtagacttggggcaatcaaaaaaggcatctcagggatcccacagagacaaatatgactgttagttgcctcaaagtaccctgaaagcaaaggggtatttcaagtacggaaaaagagagagagagaagaagaaggaggaggaggaggaggaggagaaggagaaggaggagcaggaggaagaggaggaggaggaggaaagggagggagggagggagagggagagagagagaaagattggcaacacagagaagggaaaacacacttggtcctccttgcctgtgccagtttggatgtgacaattatagaaataataaaccaagattatctgg

SEQ ID NO: 26818 - DNA, 1120 bp, Homo sapiens
gacgcggggctaggtcagagtaggaaggagtcgctgagctgaatctttgtggagtggagtggggcgagagtcctccgagtagtctggaaaattagacttctgagccttaattcatacttataagcagctagtaaattgtaaaatatagtgaagcaatgtagtgtagtaactaaaaccccaagctttggagccagattgggcctttaaccctaaagttgccgtttattttgactggcgagtcatttacttatagatttatttatttttatttttattttttttgagactccatctcaaaaaaaaaaaattgttatattttcccggcagttttcttctgaacctttttgctaattgtcggaataacttgtagaaaatgagactttggaaagcaagggttctcaaactcgttttgaaaacagcaaaggattccaggcttggtctcaactccaaatggttgtctttgaagcttggtgatgctggaaaccccagaagtcttgctataagattcatccttaccaattacaacaagttgtccatccagagttggtttagtttgcgccgagtcgagatcatttccaacaattcaatccaagcagtctttaacccaactggcgtatatgctccctctggttactcctaccgctgccaacgcgtgggcagcctgcagcaggaccaggccctcttgctgcccagcgacacggatgatgggtcgagcctgtgggaggtcacttttattgatttccaggcacttggactagtaccctgcatgaaagttcatttcaaggcaaacagaacaatattcttggaatgggaggaaaaagcttcgagtttgaacaggcactatgctgagcacagaattgaatgtgtgggcacagcaataagctggcaggtgtgtctccagccagccttgtggatctacaaacataccaaagaggaggcgcacactggtgtaatgggccagatgacaatcttgtgtcttcccactctgagttccacttagagacggggtttcaccacgttagccaggatggtcttgatctcctgacctcatgacccgcccgcctcggcctccccaagtactgggattacagagatttggacttgcatatacaaatggcag

SEQ ID NO: 26819 - DNA, 480 bp, Homo sapiens
gtaagttgatctctcagtttgaggaagcccctagggctattgcgttctgttaactctgcattcaactttttttgtcatttcagaaaaaaaaagtaggctcctttgtataggaccctgacacacatctttgaggaagtatttactgtctaaaataaaggaacaagtcagaagttaacttcaaaaattgttggctgggcatggtggctcacgcctgtaatcccagcacttcgggaggccaagggagtggatcacctgaggtcaggagttggagacaagcctggccaacatggtgaaacctcgtctctactaaaatacaaaaattagccgggcgtggtggcaggtgcctgtaatcccagctactcaggaggctgagacaggagaattgcttgaacctgggaggtggaggttgtggtgagctgagatcgcgccattgctctccagcttgggtgacagagtgagtgagactccatctcaaaaaaa

SEQ ID NO: 26820 - DNA, 886 bp, Homo sapiens
cagaactgccagcccaactgggaagtagatcctaggagagaagggatgtatcacttcagctccttcctttctcctgcagatccaaggttttgccatcaaggggggacgatttaccaaagcccaagactgcgcctcctccttctcgccagcttttctgatcggcctggcaatgtccctgatcctgctgctggtgttggcctatgccctgcacatgctcatctacctgcggtatctggaccaacaatatgatctcatcgcctctcctgcccacttctcgcagctgaaagctcgagacacagccgaagagaaggagctgctgaggagccagggggctgaatgctataaactgagaagccaacagatcagcaaaatctatgtttagcagcacaggctggcccccaccatgtccacagtgggctccgaaagttgtctctgttctgtgctatttgacttgtgaattacagattttcaccaaatggcttgattacaaaaaaaaagaaaaaacacaaaaaggaaatagataatgaattctttttgaaccatccactggcctacttaggtagacttggggcaatcaaaaaaggcatctcagggatcccacagagacaaatatgactgttagttgcctcaaagtaccctgaaagcaaaggggtatttcaagtacggaaaaagagagagagagaagaagaaggaggaggaggaggaggaggagaaggagaaggaggagcaggaggaagaggaggaggaggaggaaagggagggagggagggagagggagagagagagaaagattggcaacacagagaagggaaaacacacttggtcctccttgcctgtgccagtttggatgtgacaattatagaaataataaaccaagattatctgg

SEQ ID NO: 26821 - DNA, 1830 bp, Homo sapiens
gacgcggggctaggtcagagtaggaaggagtcgctgagctgaatctttgtggagtggagtggggcgagagtcctccgagtagtctggaaaattagacttctgagccttaattcatacttataagcagctagtaaattgtaaaatatagtgaagcaatgtagtgtagtaactaaaaccccaagctttggagccagattgggcctttaaccctaaagttgccgtttattttgactggcgagtcatttacttatagatttatttatttttatttttattttttttgagactccatctcaaaaaaaaaaaattgttatattttcccggcagttttcttctgaacctttttgctaattgtcggaataacttgtagaaaatgagactttggaaagcaagggttctcaaactcgttttgaaaacagcaaaggattccaggcttggtctcaactccaaatggttgtctttgaagcttggtgatgctggaaaccccagaagtcttgctataagattcatccttaccaattacaacaagttgtccatccagagttggtttagtttgcgccgagtcgagatcatttccaacaattcaatccaagcagtctttaacccaactggcgtatatgctccctctggttactcctaccgctgccaacgcgtgggcagcctgcagcaggaccaggccctcttgctgcccagcgacacggatgatgggtcgagcctgtgggaggtcacttttattgatttccaggcacttggactagtaccctgcatgaaagttcatttcaaggcaaacagaacaatattcttggaatgggaggaaaaagcttcgagtttgaacagagctggggtctcccaaagttgccaatgctggtctccaactcctggcttcaggtgatcctcccacgtcagcctcccaaagggttgggattacaggcatgagccaccatgcccagcccagatgattcttataagatgagaacagctgctccaaaagagtcagatgctgagatccattgtccaccctggctcctgctctgaattgacatcagtttgcaactagtagtttcataaatcaagaaaaagaagaaaggtaaattaatgactgtgttaactagaggggctctgaatttctgctttacatgtactcattttgaatttcacttttattataatgaacttgcaaacacagcattgcaatagtatatgcacctcccaaagatgctgggaaatagctgatatttcatcatttgaggacagtttgtgcctgcaagtggcagaggtgcaggaggagacaaataaaagggatgcctacatcctatttccatgaatttctgtcctctgagctgaaagacaatttacaagttggctgataagaccttgaagaaagaagatattttaaaactttaattgaaaatccccattccttctcattgaagaagcaaaagaagaaactataatgatggacactctggtgctagtatcagtcattttgatcacaagacgtggaccagcccaccttggagctcactgtggtggtggcctggtcctaatgcaagtcctaatggagctcttggaactggctgtagcctttgctgagcaggagcaactatgtctctggttcttaaggattgaaaaggtttcttggaaaagctttcattttctgaaataaacatccccttgagcctggtgatgccactgctttgcttcgctttgagaactgctgtcagaaagacgcaagcacacacagctgaactggtggtctcttcagagaaaatacttgtaaatggaagactggcttattactaattacttttaataaagactgcagagagc

SEQ ID NO: 26822 - DNA, 158 bp, Homo sapiens
tgcgggtggtgtgggagctggaagaaggcaggtgggcacgctggcatggcgtgggcaccagcagaccccaggcaggccccaccagtgggagccactgcagaggaaagagatgagtgggaggctctgggtgtgggggttagagccagggcctgaccttg

SEQ ID NO: 26823 - DNA, 631 bp, Homo sapiens
ttatagcccaagttttggaggcacaaagtaagttatggggcacttactgtgtgccaggtgctgtgttataggcatttgattctcacaaggattttttcgttccctactccctgagtgggactgagatcagtaccatctcacagatgaagaaaatgaggctgagagattcagtaaccttcccaagatcacactgcaagtaggaggaagagctgagattcaaagtggtctttctgactcagaattcaccctccttcccaacacgccaactgtcccagggagcaccaaatggggaggaacctgagaaaccatctggttgacacgctccccattttgcagatggggaaactgccttgcccagggttagacccagagctcagctctcccgactcagtccagtgttgttttcccagtaccatttaccttcctgacctccatctctgcttgaacactcagagggatgaggcagatttggaggtgagttctgtcttggattcagggattcctttaataatttctgggctgggcgcagtggcccacgcctgtaatcccagcacttcaggaggccaaggcaggcggatcacctgagtttgagatcagcctggccaacattatgaaacccccatctctacta

SEQ ID NO: 26824 - DNA, 309 bp, Homo sapiens
caggcctctgaggccagggtcccaaagaaagggcccgtctctctggggctggccacaggggccagttgtccctcctgcgccatacatctgtgcctgctggctggagggacaagctgtggcgcccgagcccagccgttccccttccctggcattttcccaaaggaagggcccattcgtgcggaaccccagcagccagaaaacctgagtagctgacgtcctgggcggtgggtgctgcaggagtcggagctgccctgatggattggcgggggcagcagcacaggtggggtggatatgccagcacccccctag

SEQ ID NO: 26825 - DNA, 393 bp, Homo sapiens
cacatcaaaaaatactatatgcacttacctatgttcaacttctagatgccatacatatcctgaaggatttcaaaaatctgacctcctaaaaggacacagcttattaaagttaattcagcttgtgttttagtactttgatggtaggaaggacagagctccaagagtgggggagggctgggtttcagtgccaggtctcaggttagcaaaaaatcttggagaaccttaatctctctgggtctggctcatacatctgcaaaataaggtgtgctgaacaagaccactgaagtgtcttccaactcaaaaccagactgagaaatagaacatagattaagtcttcagcctaaatcttacagcatagtgactggtacagcgtagatgcttgatgtacactta

SEQ ID NO: 26826 - DNA, 626 bp, Homo sapiens
  misc_feature (622)..(622): n is a, c, g, or t
gtgacatgtcccttctaggccagagcctttcatggccatgaggatccacagaactcactttcctctggtagaccaaagtcaaggtggcaactgctcagtgagagggagcctccctgctaccccagtggatggtagtgtgaaggataaaccaacttttgttgttgtgagcccttgagatttgagagttttgttacagcaacatggctagcacatcctgactgattcttcatcatcatcatcatcatcactcaagcctgtcccccggccaggggtccatccaggagaacaacagccatggaggagacccgtcaaaaaatagaactttattaccaatctgtttctataattgtttgactcattttctcactcatttgtttgctttatcaccaatttctttacatcatttattccttcaaaaacacttcttggctgggtgcagtgggtcacgcctgtaatccgagcactctgggagcccaaggcaggcagatcacctgatgtcaggagtttgagaccagcctggccatcatatagtgaaaccccatctctactaaaaaatacaaaaattcggtgagctgagatcgtgccattgcactccagcctgggcaacaagaacgaaactccntctc

SEQ ID NO: 26827 - DNA, 397 bp, Homo sapiens
gagcaaaataatcagataaaactaattttaatattgtgttttttaactcactccaaattagtatttcaaagtttcaatataaaaattgagatatttcacattgttttttcctactaagtaattaaaatcaaatgcaaattttacttaatagcacatctcgaatgttcagtatccatacatgggcagagcagttctagaagatttattgtttttaccctttcacattatatcttatgttccacctgaaaatgattttttgaatgaattgtgaggtagaaatcattacttactcatttgggcatccagttgccttaagaccactttattgaatataaagacagtcctatcttcactgttctgttatgctactttggtattaaagtgtccacatatgtgt

SEQ ID NO: 26828 - DNA, 534 bp, Homo sapiens
gattactcaatggtttctaggactgactttggtaggcctcactagccccatgtcaattttgaagattctttactttaatgcctttagatagtcagttgctgctctcaaaccttccagcacaagaacagacatttcagaagaggatggaaataataactttcacgaggaggaaggacatcatgtgtggggcataattttaagaggaagcctttgagactcacggtgtgatgtctggactttgtcttaagcctctcttctagctattttgtaataagtataccttactgttaaccactgtctccctaatgtgcaacagaacaccagaaattattcctcctatgtcatggtaactttgtacctgttgaccaacctttttttcagacttccttcacccattaagtttttaacaaaatatacatcttgaaaaactaggaaggtcgcagaagatttagagtatatatattgactcaatgcccaccttcttttccaaagtgtttaccataatctgattaaactttatttaaaatgtttcta

SEQ ID NO: 26829 - DNA, 900 bp, Homo sapiens
cagagatcctttaccagtcatttagagttcctgtattgctcatttgattttgaactatctttaaacaattagtctaaaatatgcatttcctttggatccgtctcttctggtaggttttaaaatgaagccattttgaagttactcagctgcaatcaaaatttgaacattttctttaaaagtgtgaaacatgtactttgttctgctctaaaaattgttgagtgagcttttgggaattttcttcagataacattcagctttgcggggaaaacctgactaaaaattgaggagaaaaaaactcaaatcgcaaaggaaagacctaaagaacatttataagtagttacccgcctttatcgaatcttaatcaaattaggcctttggtacacttggcttggattcatgacctgattcataaggctattcctgaaagatgcctagcattttaatatttaacctctttcctctttcctcattactttgttcattttcagtcacttgtcccttttttaaactccttctctcacctttcattctttggcttttttttcttccctcattattgtactccttcttcatctctttgttctccttgcttcccttacgctagaaggaagttttctgattacccaattatgagtttgaaccagagacctggagttagtgctgatccgggtatagggaagcagacacacatgaacactttttgtatgcatataaattggaaaggttttaaagaatttacattgaatttatacagtataatctatgcaatagcttttttaaaagatgaattatgtgaaaaaggccgattgtggaatagtgtatttaatataatgcaatatttgtaattacaactaattatgaatataaaattattatttggatggttattcacccctctgc

SEQ ID NO: 26830 - DNA, 390 bp, Homo sapiens
cttcccccacaattttcctgtgttgaagtcctaacccccagtatttcagaatgtgactttatttaaagatggagttttataaaggtaaccaagtaaaaatgaagttgttaggtgggtcctaatccaatacgactggagtccttatgaaaaggggaaatttggaagcagaaatatgtacagagggaagatgatgtgaagacttggagcaagaagacagctgtctacactccaaggagagggcctggaacagatccttccatcacagcccccagagggaatcaaccctgctaacaccttgatttcagactcctggccatcagaactgtgagacagtgaattctgtggtggaagctgtccaatttgtggtacttggttatggcagccctagca

SEQ ID NO: 26831 - DNA, 536 bp, Homo sapiens
attcaaaattcagaatgctccaataatcgtttcctttgagcatcatgtcagtgctcaaaaagttgcagattttgaggtatttcagatttttgaattaggaagactcaacttgtactatcattctatagactttatgattgggtagactacatgagtattgaacccagaaatcattgtctagcaaaagccagtatagtgattaattaccctgtgactattatataatgttcaaaaaagctaacatattagaatgtccttagcgtgcagagagcaaacagagacaaaaagaaaagttaccctgaaaagtttgtcagaaaaatagaatatcagacgctaaactactcatccagaattttgtcaaaaaagaaaaataagataaaattcactggtagacaaaaagtagtaacataccagtttgtaatttctcagtttcaaaccatgaatatgtatttgtataccaaaaatcatttcaggagcagagaaggaggatatgccttttatgtggagactttaaacataaaattggaaaactaaaa

SEQ ID NO: 26832 - DNA, 300 bp, Homo sapiens
actttgtgttcacatctgtgccttaaataaaatcatcacgatgtgatgtgaggccctgagtagattctgtgacaggttgtagcactatgatgaaaccaaaggggaacatatatttatcctttgtatttggaaatttcctgtaactgcagcagtaatgattacagctgggactgttggaagacaaatgtacacactgccttcttcgtttgagaagtaccataacctcctttgtgaaaatgcactgtaatcaagtggaagagataaaaagtcccaagtttgaggtcttcactaataatatat

SEQ ID NO: 26833 - DNA, 406 bp, Homo sapiens
gatttgcaatctttcagtaattttaaatttctacataggtcttattttttaaatttttgtttattttgatttttagaaatttcaaataaaagtacttgatgaagcaaagtagccctgtgatcttgtgcacaccatttaaaagttagcttggtttttctgctgagctgtttggaataaattctcaacagcaaaagttaggtcttgaatgcttccttatttctggggtcttttttctggctatttctacgttcgtgaatctatctacgatccttgcacatgtagtcttttgtgatatagagatgggactaaaaaaacataaattctaattacttcccaaagtgctttgtgctcttttagatatgtccatgagtgctggttctggattcatgcaaaaatgcttattgct

SEQ ID NO: 26834 - DNA, 893 bp, Homo sapiens
gttaatattcttttaataaatgccttttttgtgtagaaatgcttgtttggtttctgatagttgtaacctaaagaatctttagtaagccattggtctgctgtggggagcgtcgagatgaaactggaacgttgtttgaacctagatcataaagtgactccaacatcttcataccagggagaggaggaagctgtgctgtgaaggatcctttttcatcatgattattgcatccacagaagcagtgataaattctaacagataatgcaactcagtctacttggatgttcacacctgagactggagaagacctgctgccttctgcagagccaaacattcctcacatgctcctccacaatgctagttaatgcagcaagaatagtcttatatagactataaactcctggtacactgtgtctacattgctcactgcagtatcccaacatctaagaccatggtcttagatgtctggtacaggactggtgctcagtatgcattgaatgaataaatgaatgaatatagcaaagcaaaaaaaaaaaaaaaaaaaaaaaaaaaaaaaaaaaaaaaaaaaaaaaaaaaaaaaaaaaaaaaataacaagggggggggcgccatgagaatacctcgccaggagggcaccaaataatgagccaccagcccttgtctggtaagcagggggaccccccatatgggggagacgcatataaaagaggcagaacaagggggaagcaccataagacaagcacgagggtaggggcaaagcagaggctgcagggagacacgcaggagggagaagaaaaccacatatgcgcgggggggggacaacagtcagggcgcgacgaactctcgtcagagatgaatagaaggccagggagaagaacaccaacatacgaggtgctaa

SEQ ID NO: 26835 - DNA, 836 bp, Homo sapiens
gttaatattcttttaataaatgccttttttgtgtagaaatgcttgtttggtttctgatagttgtaacctaaagaatctttagtaagccattggtctgctgtggggagcgtcgagatgaaactggaacgttgtttgaacctagatcataaagtgactccaacatcttcataccagggaagcagtgataaattctaacagataatgcaactcagtctacttggatgttcacacctgagactggagaagacctgctgccttctgcagagccaaacattcctcacatgctcctccacaatgctagttaatgcagcaagaatagtcttatatagactataaactcctggtacactgtgtctacattgctcactgcagtatcccaacatctaagaccatggtcttagatgtctggtacaggactggtgctcagtatgcattgaatgaataaatgaatgaatatagcaaagcaaaaaaaaaaaaaaaaaaaaaaaaaaaaaaaaaaaaaaaaaaaaaaaaaaaaaaaaaaaaaaaataacaagggggggggcgccatgagaatacctcgccaggagggcaccaaataatgagccaccagcccttgtctggtaagcagggggaccccccatatgggggagacgcatataaaagaggcagaacaagggggaagcaccataagacaagcacgagggtaggggcaaagcagaggctgcagggagacacgcaggagggagaagaaaaccacatatgcgcgggggggggacaacagtcagggcgcgacgaactctcgtcagagatgaatagaaggccagggagaagaacaccaacatacgaggtgctaa

SEQ ID NO: 26836 - DNA, 1156 bp, Homo sapiens
gttaatattcttttaataaatgccttttttgtgtagaaatgcttgtttggtttctgatagttgtaacctaaagaatctttagtaagccattggtctgctgtggggagcgtcgagatgaaactggaacgttgtttgaacctagatcataaagtgactccaacatcttcataccagggagaggaggaagctgtgctgtgaaggatcctttttcatcatgattattgcatccacagaagcagtgataaattctaacagataatgcaactcagtctacttggatgttcacacctgagactggagaagacctgctgccttctgcagagccaaacattcctcacatgctcctccacaatgctgtgagccatatttattcatttaaaagctagtacctcgctatttcttgtacattaattcttttaaaacgtttacaaaacaaactaaatttaaagaggaaattatttactgatagaactaatagcctgaaaatagttgcccaacatagcatcgcacatagcaacaggaagtagtttatatactaggaagtctctttaaaatgtgcttggatattgccaaaattctctgccttataaactaaggagttcttttttttattttttagagttaatgcagcaagaatagtcttatatagactataaactcctggtacactgtgtctacattgctcactgcagtatcccaacatctaagaccatggtcttagatgtctggtacaggactggtgctcagtatgcattgaatgaataaatgaatgaatatagcaaagcaaaaaaaaaaaaaaaaaaaaaaaaaaaaaaaaaaaaaaaaaaaaaaaaaaaaaaaaaaaaaaaataacaagggggggggcgccatgagaatacctcgccaggagggcaccaaataatgagccaccagcccttgtctggtaagcagggggaccccccatatgggggagacgcatataaaagaggcagaacaagggggaagcaccataagacaagcacgagggtaggggcaaagcagaggctgcagggagacacgcaggagggagaagaaaaccacatatgcgcgggggggggacaacagtcagggcgcgacgaactctcgtcagagatgaatagaaggccagggagaagaacaccaacatacgaggtgctaa

SEQ ID NO: 26837 - DNA, 312 bp, Homo sapiens
ttttttttcctttttatggagaacaaggtctcactatattgcccaagcaggtctcaaactcccgggctcaagctatcctcccacctctgcctccctaagagctgagattacaggtgtgaactactgtgcccagctaactaggatttttttaaactccaaattttatagcaagtgaatggtgaatcaagaaagtgattccagagacaaacaatgtagtaagccccattttaacacaggtggtgattccatgggtcaggatttgcaagtcacatatttatctgacatgtaaccagctctcacattgttttaacc

SEQ ID NO: 26838 - DNA, 2096 bp, Homo sapiens
  misc_feature (1319)..(1319): n is a, c, g, or t
tattcttatctgcattttgttagaagaacacagttaataaagtgggtgtggggaagaaaacagtgcaggagaaggagaactggaagaggaaccagagtggcttgagttatctagtaaagtcttcattgcatgatgtgaccagctctcagaggggcatctaatacagagcagtttagtttaacctcagaaggtcatcagggtgctagaatcatgtcccattttcatggtaattgggcaagactgggaaaatgttttgggaatacacattttatcttccacttccagcagtggcttctaaccactgaggactctccacgttaccaatctctactgacctacctcaagctttgtaaaatcttatttaccgaacaaattacatttttaagtaataattaagcccccccttttctgtagagatatataataactgttaacctggggtcatttttatcgggctttatataattccaacagaaagcaaaggactgtgagtgcttaagttagcctgagcagtaaagaggcttttagacctactgagaatagtttttggattcacattaccactgcttgacctgagactcgatttgggagctagaaactaaaaccagttatgcctttccattgaatagatggaggctgggaggctcgggcttgtctagcttgtagggactcaagggcactttggtcgtgtcacggtgctgctttctctcctgcgcgagcctcatacttgctttctctgttgaatggtaaaagccagcctcttgtttgctattccggggttagaatttcaattccttttttaaaaactctgtttagatcagaaaccatccagacactcattcagaaaccatctggggaaggtatgacttgagatagaaattgaagagatagagaggaggagaagaagatagtatacgagttagtttaaatgaccccagatgagtttggccgggaaatcaactgcagaatgcatcctctgtccctggcctgtatccctcaagggcctttgatagagtcttggcttagttgcagccacttttcctctagaactttaactcagtaaaggtgtgcagtaaaaatggggaagagggatgaggaggagccaggagagaatcgaggaagagcaaatattacgagcgtagaacgcgaagcttggcatgtctgcctggttccacttactcacgtttgttgagctccttctatgtctgaagctgtttctaaaacgtcagtttctagaaaacaggatcctgaattcagctaagcatgattcccagggccatccctgggaagctgtcctgaagatgcctcctgctaagacnggttgcggaggggagtcagtggctgaaagggtgatttcaggatagattgtcctggcaaataaggaggggtcctctgcatgaataagcagtgtaccctgccaaaggaagctggcaggaggtgattcctgctgaagcctgacagtacatgtccaccctgaactcatggccttggatgcagaccggccaactgtacacagttgagcgaggaagtggcgacagcacggtttgaatctggctgataaaacagatgttcgggggaagggctcttattttctcccagttataggatcgggggtgggggaagaaaacctaattccctatctgccaaatgtttctgttggtaatgtcctggcaacagtgagatgcccccaagaatggagtggttgaaagttctagctatcgactcagccctggatgtaaattctgaattctgtgtgaccttgggcaagttacttaacctctctgagtacccttggcctcatctgtaaaatgaggataatgatacctacttttggcggggtgcaggggcttgtgcctgtagtcccggcactttgggaggctgaggcaggtggatcacttgagatcatgagtttgagaccagcctggccaacacggtgaaaccccgtctctactaaaaatacaaaaattagctgggcgtagttgtgggtgcctgtaatcccagaatcgcttgaacccaggaggcagaggttgcagtgagccaagatcatgccattgtactccagcctgggccacaagagtgaaactctatctcaaaaa

SEQ ID NO: 26839 - DNA, 579 bp, Homo sapiens
catgattgcaccattgcactccagcctgggtgacagagggagaccctgtctaaaaaaaaaaaaaaacagtaataacaacacttgtctctgagaagggtaatacttggtctcaaagactagtaagaccacatcttacttcccttcagccatgcctgacccaggactaggtacacagttagttcaatgaagcttggcaggaaaaaagacaagcagccagccatgctcaataaatgctaacgattattagtgttcatcattattagtattctagacactccagtaatcattgcacaatatcagaagcaacatcatcttcaggacctgggctcccaggggactctgtcacgtttcccttcctcttccaaagacaacttctcttttaaaagagacatgagccaccagccttggcagaaccacagaccagagaaggagcagacacatagaccaagggaacagaatagagaacccagaaacaatctatacagtaaattaattttcacaagtgtgccaagaatatacattggggaaaggatgtcttcaatgaatgacactggacacccttcgggatcctctaactcg

SEQ ID NO: 26840 - DNA, 637 bp, Homo sapiens
cctgaagaaaatagctggtggcttccttggccttttgccatcaatgatgcttcttacttggatttaaactgccattaggaaacctcttgatcaagaatttagacaagaatttcattcccatgtgataatttaggttataacactagaatggaacaaagagtagaatgtctttagttctttattttgcattatgtcataagaaagttcttgctatgttgtaaaatcgttgttagattcaggcttttggggattctgaaaacacattttgttagagttgaagtctattacctgagaaaggtaaaattgtgtcataattgttcatcatactaggtattaagggtagagacaagttacttcaaggtatagaaacactgaccagtactcgactgtgaaaaacatctttacctttagcattttttttttgaaacagtctcgctccgttgctcagactggggggcaatggcgcaatctcagctcactgcaacttccacttcctgggtacaagcgattctcaatcctcagctactcaggaggctgaggcaggagagttgcttgaacccaggaggcggaggttgcagtgagccaagatcatgccactgcactccagcctggtgaacagacgatggtccgtctccaa

SEQ ID NO: 26841 - DNA, 439 bp, Homo sapiens
gtgtctgcaaagcatgtggacgcatgggcagttatgtgtatgaacttttttttttttgagaatggctttagtgttcagaccaaggatggaatgaaagatcacgtgtgctttccactgtagagctgccctgcttgttttgattttatagttattctaagtgttaagttccttcatctttcaaagcaaattcctttgatccctgaaaatcagctaatgtttgggaggcaattaaaagatgaggctgtggggttggggtgaaggcttccccagcaggaagagaggagaagcccactggatctgggagcacggtgctaggactctctaagcgtgacctccttcagtttggcccagagtggtcagatagtttgccggggcataggatggatgacaggcctcatacgcatcacgtctgaagggaaagcccttgaattttccacgc

SEQ ID NO: 26842 - DNA, 393 bp, Homo sapiens
tacccgttcctaatcagtatagacatggagtcaggagctaaacagaaatataattctttcagagttttatttctaattatgaattattttaagcattcagaaaagtacagaaaataatataacagacttctgtgtacctgccttcctgattgaacattttgccattttgacttcaaaattctggtgatctttaaatgaaactaaagactcctgttccctgcacgcttcctcctccacccttctcagtggtgaccactatcccgaggttagtgagtaacagtctcatgcatgtttttggctttttatcatatatgcatgtgggtgtaaaccatatatagtatcattgtgtgtgctttaagaattttaccaaaattgtaacataatgctctatct

SEQ ID NO: 26843 - DNA, 447 bp, Homo sapiens
gtttattttttgttaataattgccttatttattgtaattcacttttatcatgaattattctctagttattttatatctgtccattatttacaaatagaaataaactttctgatggcagagaacatgatttataataatggtgatgattaataagaaaaatagccgggctcagtggctcacgcctgtaatcctagcactttgggaggccaaggctggcagatcacaaggtcaagagatggagactatgctagccaacaaggtgaaaccccatctctactaaaaatacaaaaattagctgggtgtggtgacacatgcctgtagtcccagctacttgggagtctggggcaggagaatcgtttgaacccagaaggtggaggttgcagtgagccgagatcgtgccactgtactccagcctggcaacagagtgacactccgtctcaaaaaaaa

SEQ ID NO: 26844 - DNA, 406 bp, Homo sapiens
  misc_feature (256)..(257): n is a, c, g, or t
  misc_feature (259)..(259): n is a, c, g, or t
  misc_feature (261)..(262): n is a, c, g, or t
  misc_feature (265)..(265): n is a, c, g, or t
  misc_feature (270)..(271): n is a, c, g, or t
  misc_feature (277)..(277): n is a, c, g, or t
  misc_feature (290)..(290): n is a, c, g, or t
agtaataattttaagtttcataatcaaggagatgttgattttcttcctggttttctggtgctccttatcttttctggatcactaacttaaattaagatccacttatgaatgctgcattcaggagcacttgtgaaaataaacgatggcatgcccaccatttagtttgccaagctttccttgaaaacgcaggtgcaaactgaacaatgaggacgcatggacacaggaaggggaacatcacacaccagggcctgttgtnncncnnggngaagnngaaggnatagcattagggnatatacctaatgttaaatgacgagttaatgggtgcagcacaccaacatggcatatgtatacatatgtaacaaacctgcatgttgtgcacatgtaccctaaaacttaaagtataatt

SEQ ID NO: 26845 - DNA, 305 bp, Homo sapiens
cccactctaacctgtctgctatacctactcagtgctgacacccgtgcaggtgccaccagtgtgctcttcagtctagccgggctggactgctgctatcacctttatctgccctatcacttcctacctgtgcatgcggctcatcttcttcccacagcctggactgcttgtccattttagctcctcctcaccaaatcctccccacccttgaagagccacagctgaaacgagccctccaggaagccttctatgatctacaaccagaaagaatccttcttttttttttttttttttcaactgccataccc

SEQ ID NO: 26846 - DNA, 1417 bp, Homo sapiens
gtcaggccacaccggtggtctgggctgtggcgcgcgggtcggggcccgaggcgggcggccaggaaggtacggaccacgagcagccggccgcgcccccaagcctcggtatcttcgagacctgatgaccttcgaggatgtggccgtgtacttctcccaggaggagtgggggctcctggacacagcgcagagggccctgtaccgccacgtgatgctggaaaacttcacacttgtgacctcacttggactctctacctcccgacctcgtgtggtcattcaacttgagcgtggcgaggagccctgggttcccagtggaaaggacatgaccctggccaggaacacctacgggaggctcaactctggttcctggagtttgacagaggatagagatgtttctggagaatggccacgagctttcccagataccccacctgggatgactactagcgtcttcccagttgccgatgcctgccacagtgtaaaaagcctgcagcgacaaccgggtgcctccccatctcaggagagaaaacccacgggggtgtcggtgatctactgggagaggctcctgctaggctcgcgcagtgaccaggccagcatcagcctgcgactgacctccccactcaggccccccaagagcagccggcccagggaaaagaccttcacagagtaccgggtgcctgggaggcagcccaggacgcctgagcggcagaagccatgtgcacaggaggtccctgggagagccttcgggaatgcctcggacctgaaggccgccagtggtggcagggatcgcagaatgggcgcagcttggcaggagcctcatagactcctcggtggccaggagccctcgacctgggacgagctgggcgaggctcttcacgctggggagaagtccttcgaatgcagggcgtgcagcaaagtgttcgtgaagagctccgacctcctcaagcacctacgcacccacaccggggagcggccctacgagtgcacccagtgcggcaaggccttcagccagacgtcgcacttgacgcagcaccagcgcatccacagcggcgagacgccctacgcgtgccccgtgtgcggcaaggccttccggcatagctcctcgctggtgcggcaccagcgcatccacacggccgagaagtccttccgctgctccgagtgcggcaaggccttcagccacggctccaacctcagccagcaccgcaagatccacgcgggtgggcgtccttatgcttgcgcacagtgtggccgccgcttctgccgcaactcgcacctgatccagcacgagcgtacgcacacaggcgagaagcccttcgtatgcgcgctctgcggtgctgccttcagccagggctcctcgctctttttgcaccagcgcgtgcacacaggcgagaagcccttcgcctgcgcccagtgcggccgc

SEQ ID NO: 26847 - DNA, 341 bp, Homo sapiens
tgttcgttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagcccagggagtcttcactacctacactgccgctcagctcccggcgcgagtggaggtcggggtggggagacgcgactcctgcccgggatggctgacactctgcgagccccggcgccccgcggccgatagaaccatagcgcggagggcgcggacggctcgcgcgtgcggatcggcgct

SEQ ID NO: 26848 - DNA, 921 bp, Homo sapiens
  misc_feature (398)..(398): n is a, c, g, or t
  misc_feature (552)..(552): n is a, c, g, or t
atgtattcatttatggcaggatccatattcatcacaatatttggcaatcttgccatgataatttccatttcctacttcaagcagcttcacacaccaaccaacttcctcatcctctccatggccatcactgatttcctcctgggattcaccatcatgccatatagtatgatcagatcggtggagaactgctggtattttgggcttacattttgcaagatttattatagttttgacctgatgcttagcataacatccatttttcatctttgctcagtggccattgatagattttatgctatatgttacccattactttattccaccaaaataactattccagtcattaaaagattgctacttctatgttggtcggtccctggagcatttgccttcggggnggtcttctcagaggcctatgcagatggaatagagggctatgacatcttggttgcttgttccagttcctgcccagtgatgttcaacaagctatgggggaccaccttgtttatggcaggtttcttcactcctgggtctatgatggtggggatttanggcaaaatttttgcagtatccagaaaacatgctcatgccatcaataacttgcgagaaaatcaaaataatcaagtgaagaaagacaaaaaagctgccaaaactttaggaatagtgataggagttttcttattatgttggtttccttgtttcttcacaattttattggatccctttttgaacttctctactcctgtagttttgtttgatgccttgacatggtttggctattttaactccacatgtaatccgttaatatatggtttcttctatccctggtttcgcagagcactgaagtacattttgctaggtaaaattttcagctcatgtttccataatactattttgtgtatgcaaaaagaaagtgagtag

SEQ ID NO: 26849 - DNA, 688 bp, Homo sapiens
atgttaagtcatgtgttggatcaagccttttcttgctaaaacccttccagtgactttccacctccttagagtaaaatccaacttccttgctttctgcaaggccctgggggatacggtttcttctcaccttccctccttgtgtcagaccactttgcctatgcttcctccactccagtcacactggtcctccttccagtcctccagtagaaggctaattcttgctggcaccatgttttggctggggcttctgcaaaccactgggaagcctttggaaagcttgaagctggcatgatttgattaagaagaaatgaatgaatgaatgaatggatgaatttacatcgaattgaggagaaagcacttctttttttttcacaaacaggaacttaggcattttgcagagcactctgaaatgttttaaatgtcagtgattgataaacgtattatgaactagtgagaggtctttctaagtgtatttacaatgagtttaaatacagtcgagttaggattagcattctcagaacagacctgaatccaagcttagaaactggaatttactcttaactcgctccctcaacagccttctcacgtctctcgcacacccactaccgggttacccatttacgcgcaaccccctccctcgcacatctctcccttctcactgacccctcccacccttcccccgaccccc

SEQ ID NO: 26850 - DNA, 761 bp, Homo sapiens
atgttaagtcatgtgttggatcaagccttttcttgctaaaacccttccagtgactttccacctccttagagtaaaatccaacttccttgctttctgcaaggccctgggggatacggtttcttctcaccttccctccttgtgtcagaccactttgcctatgcttcctccactccagtcacactggtcctccttccagtcctccagtagaaggctaattcttgctggcaccatgttttggctggggcttctgcaaaccactgggaagcctttggaaagcttgaagctggcatgatttgattaagaagaaatgaatgaatgaatgaatggatgaatttacatcgaattgaggagaaagcacttctttttttttcacaaacaggaacttaggcattttgcagagcactctgaaatgttttaaatgtcagtgattgataaacgtattatgaactagtgagaggtctttctaagtgtatttacaatgagtttaaatacagtcgagttaggattagcattctcagaacagacctgaatccaagcttagaaactggaatttacatataaatagaaaattaaatcagttttctaaacaggtatttttgaaaatccaataacaggttaacaaatttaaggtttatacaaatacagagaatatttttgacttaattttaattaaacttcatgaagtattcgattgataaatgggaatggaacaaagcattctctcagcattccaaatagcactgaaagatgttgatggctta

SEQ ID NO: 26851 - DNA, 344 bp, Homo sapiens
ttgtgcactcgttatgagaatctaactaatgcctgatgacctgaggtggaacagtttcatcccgaaaccatccctcacctcccacgacctgccgcaatccatagaaaaactgtcttccacaaaactggtccctggtgccaaaaaggctggggacccctggcatagaggctcagcgtgcaaaggtatgtgtcaagtgagtgaggccagggataaggtagagaatgtgagaaaggactcctgctttcagctggctttgtctgctgctaatcctggcccatgaggtgaagcatctagcagagagtgagatgacagatgtacttttgcatctcctaacatgagtccct

SEQ ID NO: 26852 - DNA, 491 bp, Homo sapiens
ataacatacatttatgattgttaagtaaccatgaaatgtgaatgacaagcatatcttgtgtccagatagtttttaaacctcagtttctagtagctcaagaaaaggattaatatcttgttttgatgacttaggttaaagtaaatagcttaagcagctggttgaatagtgttaaaacacttagattggtcaaaattggtcatttactggatattaatctgcatgagacccaatatctggttgcattttatattttattgcacagatgagatcatttgttgtcatgtaacttcagtctacattttcataacagggactcagatgttccgaacatggctatgtgcccaaagtaccaaaatactgcacaaatagtcatttcaagacaatttgccaggggaatgaatttctcttcatattttaggaatctcttttggctccatacagagagttagagagaaaggaggcttggcaagatgtgtgctttgggtctaact

SEQ ID NO: 26853 - DNA, 363 bp, Homo sapiens
taactttatccttgaaggcattttcactggttatggaaaatcctaggttgggaagttattttgtttcaagccctgtgaaagatgtcaattcccattatcttctgtcttcctattgtttctgtggagatggtagctctcagacaaattgttggttgctcgtttgtacatactccccactcccatcctgccctgggtactctaacattttttcactttgtgtttagtttcagcagttttaagataacatgcctaggtcgggcgcgggtgcacgcctgtaatcccagcaccttgggaggccaaggctggtggatcatgaggtcaggagatcgagaccatcctggccaacatggtgaaaccccgtct

SEQ ID NO: 26854 - DNA, 513 bp, Homo sapiens
ccaaacctctggtaaaatactgctgtctttttcctatacatttttacatcattaaaattagagacgggctgggcacggtggctcacacctataatcccaacactttgggaggctgagttgggcggatcacttgagtccaggagtttgagaccagcctgggtgacagaatgagaccctgtcaaagagtatttacaaccctgtatctgttttcctcaactttatgacatagcctttcccatgtaactaaaaactttggctgggtgcagtggctcacacctataatcccagcactttggaaggccgaggtgggaggccaggagttcgagagcagtctgggaaacatagtgagactctgtctctacaaaaacaataagaaaattagctgggcttggtggtgcgcatccgtagccccagctactcaggaagctgaggcgagaggattccttgagcccaggaattcgaggatttgtgctcctgatgctgcactccaacctaggtgacagagtgaaaccc

SEQ ID NO: 26855 - DNA, 494 bp, Homo sapiens
atgactgaagtctctagaaacactgagttttaaccaatatgagacacacgaagaggaaaatgaatgcttgcttcttggaagaactgctaggaaagttagcatttttgcagttctaactaatttagatgtgaggccaagtaaaaatgccatttttttggccattgaatttgaaaatcaaattgattatcctccagaatctctacaaactttgaaatactctctaaggatcaaagaagtcaaagagctatgtgtgtctcagaataatctccttcttctggtcacagtatctttgtctctgccaggtggctcttcatttctttggtagctatttttagacttacagtcattcaccaatatacagttagcagtgttctgatagacacagtatcagtcatattctccgttgagtcataatttcaaactcaacaagatttcagaaaggtataatcatgtaatttctcatattaaaactgagaagagaggccaggcatggt

SEQ ID NO: 26856 - DNA, 788 bp, Homo sapiens
  misc_feature (39)..(40): n is a, c, g, or t
  misc_feature (50)..(50): n is a, c, g, or t
cctttccacacccacccccatgacccccttggactgccnnccttggaacncaccggggccttgccgttctagaactagtggactcctcgcgctgcaggaatttttcacgagctggccctgctgaatggatactaccaggaactagaaaagaactgacttactcacctgctttgcactggcctcctgaaagtccatggtcttaattataccagtttcattattgctctgaattttcatccttgcatgcttttaaggctatctgtattcaaacaacatacagtagcctcagaaataagaggccccttaccattctcaatagagaggtctataatggccacgtgcaatgatttgaaggctatctccaaaacttatcttgaaatttaattgccatcttgctggtgttaagatgtaggactgttaagaggtgattaggccatgagggctccaccttcattaatggattaatgttgttatcaattgagtgaatttgttatcatgagaatgggttagtatgaaagtgagtttggccctctctctcttgcttgctcttgtgttttcctgtccttctgccttctgccatggggtgatgcgctgccaccgccctcaaccccttatgacaatccccacgccacactcttacactaccaagcttcccaccaccatctcctacaaccacactacactctcctataacacacccccaccccacgcctccccctaacgctatctccctacgacctacaccccccccgcacaccctctcagcctccccctcctccccctcctcc

SEQ ID NO: 26857 - DNA, 658 bp, Homo sapiens
  misc_feature (39)..(40): n is a, c, g, or t
  misc_feature (50)..(50): n is a, c, g, or t
cctttccacacccacccccatgacccccttggactgccnnccttggaacncaccggggccttgccgttctagaactagtggactcctcgcgctgcaggaatttttcacgagctggccctgctgaatggatactaccaggaactagaaaagaactgacttactcacctgctttgcactggcctcctgaaagtccatggtcttaattataccagtttcattattgctctgaattttcatccttgcatgcttttaaggctatctgtattcaaacaacatacagtagcctcagaaataagaggccccttaccattctcaatagagaggtctataatggccacgtgcaatgatttgaaggctatctccaaaacttatcttgaaatttaattgccatcttgctggtgttaagatgtaggactgttaagaggtgattaggccatgagggctccaccttcattaatggattaatgttgttatcaattgagtgaatttgttatcatgagaatgggttagtatgaaagtgagtttggccctctctctcttgcttgctcttgtgttttcctgtccttctgccttctgccatggggtgatgacagcctcagattcatgtgtttccctttgatcttccagagaacttagccacttccagaaatctgttcct

SEQ ID NO: 26858 - DNA, 775 bp, Homo sapiens
  misc_feature (39)..(40): n is a, c, g, or t
  misc_feature (50)..(50): n is a, c, g, or t
cctttccacacccacccccatgacccccttggactgccnnccttggaacncaccggggccttgccgttctagaactagtggactcctcgcgctgcaggaatttttcacgagctggccctgctgaatggatactaccaggaactagaaaagaactgacttactcacctgctttgcactggcctcctgaaagtccatggtcttaattataccagtttcattattgctctgaattttcatccttgcatgcttttaaggctatctgtattcaaacaacatacagtagcctcagaaataagaggccccttaccattctcaatagagaggtctataatggccacgtgcaatgatttgaaggctatctccaaaacttatcttgaaatttaattgccatcttgctggtgttaagatgtaggactgttaagaggtgattaggccatgagggctccaccttcattaatggattaatgttgttatcaattgagtgaatttgttatcatgagaatgggttagtatgaaagtgagtttggccctctctctcttgcttgctcttgtgttttcctgtccttctgccttctgccatggggtgatggcggcactaagtccttcatgagatgtgagtgccacactcttagacttccaagtctccagaaccataaaataaacaagtttatactgtttataaattacccaatctcatgtattctcttatagtaaaacataatgaactaagacaaaaaactggtacacagaagtaaggctgttgctataacaaata

SEQ ID NO: 26859 - DNA, 210 bp, Homo sapiens
cctttgtgtgtgacctgtgtgcaatcatatgcacatatatttcatagctcagcagaagacacctcaactggcaccctatcttggtctctaatgccattacccactaaaaggaaccagttcttcaaagacatggccaatttcagggctgaggaagggtagaaaggagatgggcttggaacatcctactacaccaaaaagcaaataagtgct

SEQ ID NO: 26860 - DNA, 491 bp, Homo sapiens
gttggaattcaaacctaggcagaggttggggtcttataccctgccccaccctgcctcctcctatgtagtggctctatttgctcaagtggtggcttgatctgacccatcttttctgtggaaggatctagaccagtctctagggagataactttacccattttgctacaacatcccaagagattaaaatcttacatgaacccacaggagactggcgtttctcttaagtgtgttcttcagagtgctagccctgtaaaatttttctcaaaaagagagttctgttgtagaatgagttgggaaacactgcatgctctatctatacctcccacccactttgaagagatactttgttgatgacatattaatagctccagaagtctttcaagaaaggaacctgaaacacgatttgggagatgctaccaaagactgggttccataaggaaacagctggctttttatctaataatggatttaaatagtccatgagttctcat

SEQ ID NO: 26861 - DNA, 323 bp, Homo sapiens
ttctttttttaatttagtgtatgcgttgaattttatgcttaagatctctcacatcacagtttccaggataagaaaaataaagagccatacacatttttttctgtaaattttgctaaaaaaaatacagtaaacaagggttatttattagtaggtgattaggtattgataattaaattgccattacatttcagcgggaagtcagagtagagaaggaatatgtgcaattaaaatggggtttctattaatacattttgataactcactttctatggcttaacaatttgtaattatttataacaataccagattgtctaccaatgggg

SEQ ID NO: 26862 - DNA, 348 bp, Homo sapiens
cttattttcttgacaatgcatttagaaagatttaaaaatatttttatcttacccagtatcttcagtgttttcagctggggtgagttcagtgggttttggcccaggtattaatctgcattactgtttccccatctatgcttcaggaatgcagggactctgttcctttagttaattaactgctgtatccttcatgcctgaaaccgtgtccagtatgtttactgtttgtctaatgagtgattggctatactctgctgtgatgtactcttttgcatttttaaggaaattatagcaatgaaatagtcaaattctagcctgggcaagacaatgagaccctgtctataaaaaaaa

SEQ ID NO: 26863 - DNA, 365 bp, Homo sapiens
ggcctaaagcaaaaggttaagccaagtcagtcatcagtccgtaggacattatgacttaacatttaacattgagtggttctgtttatgagcattgtaaccatagtactaagttttttctttggtttgttttttttttttttttagaaacaaggtcttgctctgtcacccagggtgagtgcagtggtacaactgtagctcactgtgacctcaaactcctgggctcaggagaatcttctgctttggtctcctaagtagctgggactacaggcttgcaccaccataccagcctggccaacatggtaaaaccctgtcgctactaaaaatacaaaaattagctgggcatggtggtgcatgcctgtaatccc

SEQ ID NO: 26864 - DNA, 373 bp, Homo sapiens
ccctctatcgtccaggctggagtgcagtggcaccatcacgactgactgcagcctcctgcgccccgtgatcttcccacctcagtgccctgagtaactgggaccacagcttcccatgggtggccagccgaatgcattatgggagaaagcaggtctcgtggataatatttctgaagatcggagcaggttgtcaggtccacgtcggccatgactgcagcacgctccggaggcagcagggggcaccctggagttcgcatcctccttcaggcccgcggcatctcccctggctccaccatccccaggtgtctcaggttggacgcacggtagttcgctatggccatttctgattaaagacagaacaaatggattgtccgga

SEQ ID NO: 26865 - DNA, 423 bp, Homo sapiens
gtggcccgtaatggttttgagtacagtgcttaggaatgtgaagaagtccaagaaacatctgttcctaaaaatcatctagatttttaagagttcgagaaaggattggggcttgtcaaaaggaaatagggattgggtgcagtggctcacacctgttaacccagcacttcgggaggctgaggtgggcagatcacttgagcccaggagttcaaaaccagcctgggcaacacagtaagaccctatccctacaattaattagttaataagccaggcgtggtgtcatgtgcctgtatgtaatcccagctactcagaaggctgaggtgggaggttcacttgagcctggatatttgaggctgcagtgagctatgatcactccattgcatttcagcctgctcagtagagtgagaccccgtctctttttattta

SEQ ID NO: 26866 - DNA, 447 bp, Homo sapiens
ccatatcttgttcatgtaggctctttcatgactgtttttttcttgtgtgttttattatttcaacaataggttcatctttagtaacagtgattttctctagtattcctacatagggtctttaaggcaaccttatgcagtcatctatattttctttgctgggcctttcatggatgctgggccatttttaagttaattcctcactccatggaggaatatctttgggaccccactcttacaagcttcatgtttctttttgtttcttgtccccaggccagtgagcagagatactctgagcctgttttcaagatatgtgtcttctgggctgctggttttatgcagggagctctgtgagagtttccttgaccagggcttgtggccatagtggctactctctcaaggccttgtcacagtggttctcaggacaggctgtacactggaatcaaatgg

SEQ ID NO: 26867 - DNA, 263 bp, Homo sapiens
ggtgctgtggtgcacgcctgtaatcccagctactcaggaggctgaggaaggagaattgcttgaacccaagaggcggaggttgcagtgagccaagatcgtgccactgcactccagcctggctgacagagcaagaatccatctaaaaaaaaaaatgtttttaggcatttcattacatttgcaatatatttatctaataatataatcttaatcactgaaaatgtataaacatgtaaattaaaggtaaacataaattgaaagtatca

SEQ ID NO: 26868 - DNA, 504 bp, Homo sapiens
tggggagtgttctttaatttaaactaagtagattttctgtaggaaatctgaaaaagaacaatctgtatactaacatacaccgttacatatgaccactgaacacctctaagtgaagtgtgaagatgaactagttaagatgttctccaagtgtgctctcaagaccagcagcatgagcatcctctgagaactggttaggaagcatattctcaagggccagccatggaagctcacacctgtaatccctgccctttgggatgccatggtggcaggattacttgaggccaggactttgagatcagcctgggcaacatagtgggaccctatctctacataaaatttaaaataattagccaggtgtggtgatgcatacctgtggtcccagctacttgggaggccagggtgggaggatcacttgagcccgggaggtcaaggcaacagtgaggtatgacagggccactgcactccagcctagatgacagagtgagaccctatctcaaaataatt

SEQ ID NO: 26869 - DNA, 425 bp, Homo sapiens
gatgcacaaatcctgaagaggggagaagcttcctccacctccaccctcacccctacatcttctctagggcaggagtcatcacagcccctggtttagatgcttccctgggtggcccttttgaaagtatgtggaccctaagagacaggagactttgagtgcatggatgggggataatttgcttttgcagaaggacagaaaatttatctctaggttcttcctttattcggcagttaggaattacatcctctgtattgcacagaagaatctaccatattcagagcactgagtacatggattatattcactaaagattggagagccaaaagtttctctgcaagagtgacctgatctagtaagaatgtcaaaattgttactatatttgtacccatgctcttcggtttagagggcaggtgcttccgtgtgta

SEQ ID NO: 26870 - DNA, 392 bp, Homo sapiens
tatatcttcttcagagaaatgtctattcaagtcctttacctattttttgttttgttttactaattttaaaattttctctctaataagcactgtccccagacttcaatttgcccattttttgattggattgtttttgttgttgagttgtagtagctctttatgtattctgattattaacccccatcacgtatgtagtttatgatttctttctcccatttctttcattgtctttttactctgttatttccgttgctgtgcagagggttttgagtttgatattagccccatttgttcatattttcttttgttgcttgtgcatttggtgttatatccaagaaatctgccaaatccactgtcatgaagctttccccctttgtctcttataggtcttt

SEQ ID NO: 26871 - DNA, 542 bp, Homo sapiens
ccgggccgctgactctcttggctcccgaagggctgttgctttccgcagttgcagttggaattctcgccacacttcactttaaaaatgccaagacaaaatcacagcacactgggcttgagaacacaggcagtctttcagtgtgggtctgatgtttgctattttagctcagctccgcctggcagggtgtggtctgctgacagagggtatgcaggcagctggggtatgtggagtatgacgtttgaaagtggcatggtggtggctgggcgctctggctcatgcctgtcatctcagcactttggggggcccaggcgggtggatcacctgaggtcagcagttcgagaccagcctgaccaacatggtgaaaccccgtctctactaaaaatacaaaaaatagctggacattgtggcaggcatctataatcccagctactcaggaggctgaagcaggagaatcatttgaatctgggaggtggaggttgcagtgagctgagatcgcgtcactgcactctagcctgggcgacagggcaagactctgtctcaaa

SEQ ID NO: 26872 - DNA, 429 bp, Homo sapiens
acatgtaatgaaattccgattaaataatcttaagaatctacttaatacattaatttcttgaagccattgaatgtttcaacaatagaacatttacataaaatataaaatatttaactatgagtaattgataggtatttacttgttcttcataaatgggataatataagtgatttgtgttggattcataacatcttagagactatgtagtatcttgaggtagacacataaaaagcattaagacggggcttcttaaaagtttttaaaatataggaagtagcctcttatgtgtattatgaattatttaacctgcgaataacatgccccctagcttttaaaaatttatgacagaagtattttgttgaaacttaataaatgtcacacattttcaactttaatgagtggtttaaagggaatttcatacattcagtg

SEQ ID NO: 26873 - DNA, 468 bp, Homo sapiens
gtttaaacaaatgcttttcataattgctgtcttccccagccagaaactaaggcctgctgtgtgctttgggtgtgtgggtgggtgggttgctgggggaagggtccttgtaatattcggggagttttggctggggccaattatttgttcataattctaagtatttaaacaatgctacgtattttctgtcttttatggaggcagatatctctaagtggcccctcctggtgctggggtatgatcaaaagggacttctgtaagttttcactggactgctttaattttctatcagaacagtgtatttagtacttgattaagtaaaaaacaagaaaaaaccaaaactaaaaatctagtaacacatgttgatgatttgaaaaagaaaccaaaactgagaagggtgtgattgaagagcacctcccacttctcccttttcactcgcccccccgcatccataaacacactgaacagact

SEQ ID NO: 26874 - DNA, 714 bp, Homo sapiens
gttgtatggccatagctatccgaaaagcaagagacaaagcaagacaaatattcacacaaaaatgaagtgtgtcctctggagggtcatatatacaatttcttttgtacagatgaaaatcaatcagctgcttagatttagaaatctactcttgctggtctttgtaagttgcatgaatatttgactttgaaaaaatatcttaacgacatggggcaaaaagtgcaatctaaatggtagcctttactaatgtgtgtggaaagaggtgttcctcattatctaatatttcaatgtgttaagagtttaatttttttgttatcattaaaaaagacaggattataaagagatatcaaagcacgattttagataacctaaacggcccagcctatacgaagttgattatatctcgatgtctgtaaaagattgctgttcttggagtcttgaggtcttgtgaattgatttcctgctttctttcatttttttcaatttaagtaataatacatttgttatattcctttcagtgtaagtttctatttggacaattttatgggaacatgtgcattctctatgtgagcttctatcatattcctgttttattagcagaacctaaaggaatttatttaatgatgttgtgacattactgctttttcttttttcttttcttagttcatatttgcattttcgttcaaggatatgcttagcaataaaatgttcttccca

SEQ ID NO: 26875 - DNA, 544 bp, Homo sapiens
ttattttgtgatataaggtaacatatatccagggattaggacatgtatctctctgagggccactgttcagctgaccacagaggtgactataatgtactcttgcactcatagaccttaccatgaattagacagacatccatgattcaagtgtgtgaaatttgctgtcacacaaagaaaggactgagggaacatggaggatgaatttaattttgttcgaagggattggggatgacatgcaaaatgaagaaaaatggcttgaataagtggggaagagtatatcaagtaaaatagcaaaagcagaggcattgaaggatatgccaaagtcagacatggcaagtcatgctgtgacgattcaccagaaaggtgccgggctgggagaagggggatgtggcaagaaatatggcagaaaaggacaggctggggccatattatggagagccttgaatgatgagccaagagttagaatttaacttgccagatagtgtggagcccttagggctttctgagctggggaatacgtgattagatttgtgtgaaatagaga

SEQ ID NO: 26876 - DNA, 368 bp, Homo sapiens
taaaactggacacaagaacacaaaacgcttgggctgctgagagattagaccaacaaccctccacggctacaaaccttttccacgttatatggcacgttataagtgggtgttcctagtgatggttctgattttttttttaaaaagtctaaatatgtttaatgttgtctcagaagacaaaatatattttagacagatattcctcagtgatgagtaagcctcagctatctggaaaattcatgcaggcgccagagatcattactgagtaattcaagctaataactgcgtcatgctggttgtaccctgcatgccaatatctgctaaaagcagcaccacgaaagggaaatacgaatctcactaagcactcgccc

SEQ ID NO: 26877 - DNA, 399 bp, Homo sapiens
tttttttttgagacagggtctagttctgtcacccaggcgggagtgcagtggcatgatcacggctcattgcagccttgacctccccaggcttaagcaatcctcccaactcagccttccaattagctgggactaccgacatgcaccaccacgcctggctaattgttgtatttttcatagagatggggttttaccacattgtccaggctggtcccaaactcctggactcaaacgagccacgtacctccgcctcccaaagtgctgggatgacaggcatgagccaccgaacccagccctgagattctatctccgggaataactgtatgaaggagagggcgttgctgagagggaatttaaaacacaaaaccctgaagcaatccttcttggagaacagggagcaac

SEQ ID NO: 26878 - DNA, 395 bp, Homo sapiens
tttttttttttggcgatagagtatcactgtgtggcccaggctggagggcagtggcgcaatcttggctcactgcaacttttgcctcctgggttcaagcaattctcctgcctcagcctcccaagtagctgagattacaggtacccactaccaggccagctaatttttgtatttttagtaaagacagggtttcaccatgttggccaggctggtctcgaactcctgacctcaagtgatccacctgactcagcctcccaaagtactgggattacaggcgtgagccaccacgcccagccatgacagcaaacttaatcaatgttgtatgtgttctgactgctctaccaactggccattcctacatctctctccctctcgtatagcctcccttttccctgaga

SEQ ID NO: 26879 - DNA, 472 bp, Homo sapiens
gaaaaagtcagtggttccagcatttgctttagtctgtgacttaaatggattataactcttgaccgctgacatttaccaagataaatcagtggtcatagatgtggagcttgatgtctcttcggctctgggaccaatccccttggacaaaagttttcctgtgttcttagtattctgaactggctacagcaacttttaggaaaataaaggttacaaaaaaagttctgacaatttgtttgcttttacattttcaaatttgtgaaatgtagagataattttgttttcaaatctttgtaattccctgaagcaaatactttcaagccagttgcaaaatgctgctttagaaataattcatataaacatgcttctctatttaatcacaaggggagatgtggagaatggatgttttattttttcagtagtttttgctctataaaaatattaaattgctattatgattactaaagataaaaaa

SEQ ID NO: 26880 - DNA, 447 bp, Homo sapiens
gatgtgttgacaaggactatacagagatttagttaaacccagtgtccagcacctgatgaaaaagcctgatgttacgttggctggactttgctctgtgtgcactgttaacccattgtactaccaggaaagagccatgtccattggtacttaaagaagaactaaagggccgagcacagtggctcacaccggtaatcccagcattttgggaggctgaggcgggcagatcacttgaagtcaggagttcaaaaccagcctggccaatctggtgaaaccccgtctctactaaaaatacaaaaattagctgggcttggtggtgcgtgcctgtagtcccagctacttgggaggctgaggcagattgaatcgcttgaaaacccaggaggcggaggttacagtgagccgagatcacgccactgcactccagcctaggtaacagagcaagactccgtc

SEQ ID NO: 26881 - DNA, 509 bp, Homo sapiens
  misc_feature (89)..(89): n is a, c, g, or t
caatgagccttgtgcagttctgaataagcctgagtgggtgcagctgagagagattagtgttttacagtgcaccttcacgagcacttgangaacaggccagggacattcacatcacatggggatgcagaccccacatcccatgcccactgggtgctcaggccccctgaaagcaaaatgccaggcaggccaccttgagtacctcgtgtttcaactcatctatgaggtcctgaggtcactaaggataaatttagttcccattttatgacacaagtatctgagggtcagatatcccaggatttatgagccctatgaggattagcaaatgtacatacccatagagtgataaaaatgaggtaatgaagcaagcagtagtttgaatctttgcttcataacatgctaattttgctactttagaaaaatttatagactttttcaaagcttaatttcttcattatgtcttttcttatataaaacttcatcatgggtttgtgtaggggtgaaaaaaaaaa

SEQ ID NO: 26882 - DNA, 2707 bp, Homo sapiens
cgctgggaatcctgctcctcctcaggtcctggcaagtttcagggcccctccctaggccttacttaaaaggctgaggcatccttggaggaacaggcagactccacagctcccgccaggagaaaggaacattctgaggggagtctacaccctgtggagctcaagatggtcctgagtggggcgctgtgcttccgaatgaaggactcggcattgaaggtgctttatctgcataataaccagcttctagctggagggctgcatgcagggaaggtcattaaaggtgaagagatcagcgtggtccccaatcggtggctggatgccagcctgtcccccgtcatcctgggtgtccagggtggaagccagtgcctgtcatgtggggtggggcaggagccgactctaacactagagccagtgaacatcatggagctctatcttggtgccaaggaatccaagagcttcaccttctaccggcgggacatggggctcacctccagcttcgagtcggctgcctacccgggctggttcctgtgcacggtgcctgaagccgatcagcctgtcagactcacccagcttcccgagaatggtggctggaatgcccccatcacagacttctacttccagcagtgtgactagggcaacgtgccccccagaactccctgggcagagccagctcgggtgaggggtgagtggaggagacccatggcggacaatcactctctctgctctcaggacccccacgtctgacttagtgggcacctgaccactttgtcttctggttcccagtttggataaattctgagatttggagctcagtccacggtcctcccccactggatggtgctactgctgtggaaccttgtaaaaaccatgtggggtaaactgggaataacatgaaaagatttctgtgggggtggggtgggggagtggtgggaatcattcctgcttaatggtaactgacaagtgttaccctgagccccgcaggccaacccatccccagttgagccttatagggtcagtagctctccacatgaagtcctgtcactcaccactgtgcaggagagggaggtggtcatagagtcagggatctatggcccttggcccagccccacccccttccctttaatcctgccactgtcatatgctacctttcctatctcttccctcatcatcttgttgtgggcatgaggaggtggtgatgtcagaagaaatggctcgagctcagaagataaaagataagtagggtatgctgatcctcttttaaaaacccaagatacaatcaaaatcccagatgctggtctctattcccatgaaaaagtgctcatgacatattgagaagacctacttacaaagtggcatatattgcaatttattttaattaaaagatacctatttatatatttctttatagaaaaaagtctggaagagtttacttcaattgtagcaatgtcagggtggtggcagtataggtgatttttcttttaattctgttaatttatctgtatttcctaatttttctacaatgaagatgaattccttgtataaaaataagaaaagaaattaatcttgaggtaagcagagcagacatcatctctgattgtcctcagcctccacttccccagagtaaattcaaattgaatcgagctctgctgctctggttggttgtagtagtgatcaggaaacagatctcagcaaagccactgaggaggaggctgtgctgagtttgtgtggctggaatctctgggtaaggaacttaaagaacaaaaatcatctggtaattctttcctagaaggatcacagcccctgggattccaaggcattggatccagtctctaagaaggctgctgtactggttgaattgtgtccccctcaaattcacatccttcttggaatctcagtctgtgagtttatttggagataaggtctctgcagatgtagttagttaagacaaggtcatgctggatgaaggtagacctaaattcaatatgactggtttccttgtatgaaaaggagaggacacagagacagaggagacgcggggaagactatgtaaagatgaaggcagagatcggagttttgcagccacaagctaagaaacaccaaggattgtggcaaccatcagaagcttggaagaggcaaagaagaattcttccctagaggctttagagggataacggctctgctgaaaccttaatctcagacttccagcctcctgaacgaagaaagaataaatttcggctgttttaagccaccaaggataattggttacagcagctctaggaaactaatacagctgctaaaatgatccctgtctcctcgtgtttacattctgtgtgtgtcccctcccacaatgtaccaaagttgtctttgtgaccaatagaatatggcagaagtgatggcatgccacttccaagattaggttataaaagacactgcagcttctacttgagccctctctctctgccacccaccgcccccaatctatcttggctcactcgctctgggggaagctagctgccatgctatgagcaggcctataaagagacttacgtggtaaaaaatgaagtctcctgcccacagccacattagtgaacctagaagcagagactctgtgagataatcgatgtttgttgttttaagttgctcagttttggtctaacttgttatgcagcaatagataaataatatgcagagaaagagaaacaaaaaaaaa

SEQ ID NO: 26883 - DNA, 2678 bp, Homo sapiens
ggagagtcccacctctaacatctcctgtaggcctggcaatggcaggcaggaaagacagaggaaggaaggagggagaagggaaggagtgaaggaaggagtgaaaaaggggagtctacaccctgtggagctcaagatggtcctgagtggggcgctgtgcttccgaatgaaggactcggcattgaaggtgctttatctgcataataaccagcttctagctggagggctgcatgcagggaaggtcattaaaggtgaagagatcagcgtggtccccaatcggtggctggatgccagcctgtcccccgtcatcctgggtgtccagggtggaagccagtgcctgtcatgtggggtggggcaggagccgactctaacactagagccagtgaacatcatggagctctatcttggtgccaaggaatccaagagcttcaccttctaccggcgggacatggggctcacctccagcttcgagtcggctgcctacccgggctggttcctgtgcacggtgcctgaagccgatcagcctgtcagactcacccagcttcccgagaatggtggctggaatgcccccatcacagacttctacttccagcagtgtgactagggcaacgtgccccccagaactccctgggcagagccagctcgggtgaggggtgagtggaggagacccatggcggacaatcactctctctgctctcaggacccccacgtctgacttagtgggcacctgaccactttgtcttctggttcccagtttggataaattctgagatttggagctcagtccacggtcctcccccactggatggtgctactgctgtggaaccttgtaaaaaccatgtggggtaaactgggaataacatgaaaagatttctgtgggggtggggtgggggagtggtgggaatcattcctgcttaatggtaactgacaagtgttaccctgagccccgcaggccaacccatccccagttgagccttatagggtcagtagctctccacatgaagtcctgtcactcaccactgtgcaggagagggaggtggtcatagagtcagggatctatggcccttggcccagccccacccccttccctttaatcctgccactgtcatatgctacctttcctatctcttccctcatcatcttgttgtgggcatgaggaggtggtgatgtcagaagaaatggctcgagctcagaagataaaagataagtagggtatgctgatcctcttttaaaaacccaagatacaatcaaaatcccagatgctggtctctattcccatgaaaaagtgctcatgacatattgagaagacctacttacaaagtggcatatattgcaatttattttaattaaaagatacctatttatatatttctttatagaaaaaagtctggaagagtttacttcaattgtagcaatgtcagggtggtggcagtataggtgatttttcttttaattctgttaatttatctgtatttcctaatttttctacaatgaagatgaattccttgtataaaaataagaaaagaaattaatcttgaggtaagcagagcagacatcatctctgattgtcctcagcctccacttccccagagtaaattcaaattgaatcgagctctgctgctctggttggttgtagtagtgatcaggaaacagatctcagcaaagccactgaggaggaggctgtgctgagtttgtgtggctggaatctctgggtaaggaacttaaagaacaaaaatcatctggtaattctttcctagaaggatcacagcccctgggattccaaggcattggatccagtctctaagaaggctgctgtactggttgaattgtgtccccctcaaattcacatccttcttggaatctcagtctgtgagtttatttggagataaggtctctgcagatgtagttagttaagacaaggtcatgctggatgaaggtagacctaaattcaatatgactggtttccttgtatgaaaaggagaggacacagagacagaggagacgcggggaagactatgtaaagatgaaggcagagatcggagttttgcagccacaagctaagaaacaccaaggattgtggcaaccatcagaagcttggaagaggcaaagaagaattcttccctagaggctttagagggataacggctctgctgaaaccttaatctcagacttccagcctcctgaacgaagaaagaataaatttcggctgttttaagccaccaaggataattggttacagcagctctaggaaactaatacagctgctaaaatgatccctgtctcctcgtgtttacattctgtgtgtgtcccctcccacaatgtaccaaagttgtctttgtgaccaatagaatatggcagaagtgatggcatgccacttccaagattaggttataaaagacactgcagcttctacttgagccctctctctctgccacccaccgcccccaatctatcttggctcactcgctctgggggaagctagctgccatgctatgagcaggcctataaagagacttacgtggtaaaaaatgaagtctcctgcccacagccacattagtgaacctagaagcagagactctgtgagataatcgatgtttgttgttttaagttgctcagttttggtctaacttgttatgcagcaatagataaataatatgcagagaaagagaaacaaaaaaaaa

SEQ ID NO: 26884 - DNA, 1376 bp, Homo sapiens
ggagagtcccacctctaacatctcctgtaggcctggcaatggcaggcaggaaagacagaggaaggaaggagggagaagggaaggagtgaaggaaggagtgaaaaaggggagtctacaccctgtggagctcaagatggtcctgagtggggcgctgtgcttccgaatgaaggactcggcattgaaggtgctttatctgcataataaccagcttctagctggagggctgcatgcagggaaggtcattaaaggtgaagagatcagcgtggtccccaatcggtggctggatgccagcctgtcccccgtcatcctgggtgtccagggtggaagccagtgcctgtcatgtggggtggggcaggagccgactctaacactagagccagtgaacatcatggagctctatcttggtgccaaggaatccaagagcttcaccttctaccggcgggacatggggctcacctccagcttcgagtcggctgcctacccgggctggttcctgtgcacggtgcctgaagccgatcagcctgtcagactcacccagcttcccgagaatggtggctggaatgcccccatcacagacttctacttccagcagtgtgactagggcaacgtgccccccagaactccctgggcagagccagctcgggtgaggggtgagtggaggagacccatggcggacaatcactctctctgctctcaggacccccacgtctgacttagtgggcacctgaccactttgtcttctggttcccagtttggataaattctgagatttggagctcagtccacggtcctcccccactggatggtgctactgctgtggaaccttgtaaaaaccatgtggggtaaactgggaataacatgaaaagatttctgtgggggtggggtgggggagtggtgggaatcattcctgcttaatggtaactgacaagtgttaccctgagccccgcaggccaacccatccccagttgagccttatagggtcagtagctctccacatgaagtcctgtcactcaccactgtgcaggagagggaggtggtcatagagtcagggatctatggcccttggcccagccccacccccttccctttaatcctgccactgtcatatgctacctttcctatctcttccctcatcatcttgttgtgggcatgaggaggtggtgatgtcagaagaaatggctcgagctcagaagataaaagataagtagggtatgctgatcctcttttaaaaacccaagatacaatcaaaatcccagatgctggtctctattcccatgaaaaagtgctcatgacatattgagaagacctacttacaaagtggcatatattgcaatttattttaattaaaagatacctatttatatatttctttatag

SEQ ID NO: 26885 - DNA, 576 bp, Homo sapiens
tagctccctctctgcattattaggagtcaggtaactggggtaccagtcccacctctgcatctcatgctctccacaactcaggtccagcacatccattctcaaagtctgcctgctcacctgtggaatgagagtctggactaagggaactcccagccccctcctcctgacactgtgagtttttcctttctcgaaggctactggtaggccccactggagactgaaaggggaagattgcagtaaaaggcgcaggctgtcgaaggataacatgtccttctacatcattcactagcctaggatgccagtcaacttcattcttggaacctttattttccaatttgcgggcattttgcaataggctgattttaatcacattttatactttttttcctttgttgcagaaatgtttgtattacctgttctttgaatgcagcatctgtagaccacaaggtctttccataggaactaagcctgttatattgctgctagttttgagtaaatgagctgaatcttgcagccaagcctcagtgcaaacaaaaacattttctggccaaacattttctggttattcaactccat

SEQ ID NO: 26886 - DNA, 1369 bp, Homo sapiens
caaaaatgtaggcttctctgtttctttgcagtgaactaaaacttcttatgaactctggttatactgaaaacaggagtcatgggagacttgatcttgcttaaaggatattttagtctttgatttctttgaggtaaatgttcaatctttttgcgtatcttcctcctaccttttcatagccaagatgacagctgaacaggctctcatcttaaacctgaacaggcatcagaatcacttggagagcttgttaaaatacagattgatgggccccacccccagaatatctgattccatacatatgagtcagggcccaagaatttgcattacaaatgcattctcagatgatgcctttgctagtctgggcaacacactttaagaatagttggtataacagaaagcttcttgtgtgtcttgtgtgtctatgtggacaggagttgtgggcttcagattcatcctctgtgtcctctggtctcagttgtgaggagggggaagagtgggaagtctggccttgtctctggactcctgagtaaataatgtgctgatgcagtgttgggcccagcaggccttttagagggtcatgccagcacccactgctgaggtctgtagtctctaccatctgccctacacataataagtacccttcctctgctattctctcttgctgaccccaagcccaccaatgaattaattgaatcaagagttccaaggcattaggttaaagacattgaaaaatatatccatttattttttcaaatatacataaagaaatccatacaaactaaggccaattgtggcaaaactacatgagacttgactaaaataacccacaattcaaatttccttcataacatttctacctataaatttgattcagagaaattacacttcatagataaactagccataaaaaagattacagcggcaaaagctatcatcagtaatatttgatatgcataagaaaccgtgaggaaccaaatcatggtaaaattgattctaaggaaatggttgcacaaaaataaaagtgaaatggtattttttaaaaggaagtggttcaactgtattgcatagaaaatgaatcaaggaattacattggcttaaatggcattagctcaaaaaagtgttctcaaaaattaatggaaattggtgtattctgattgagatatgttttattcaataacatggagtcaaaacaagaagattttttaaatgtcctctgttcccatggagcttgcattctgcaagagcaacagacatcaaaaagataactgggcaaatgaccacatgattgcagttgggataagtgctaagtctagggtaatcttcatatcaccctgtggcatgtataaaggaagaccttttgctggtgttttgt

SEQ ID NO: 26887 - DNA, 161 bp, Homo sapiens
acatggttttaatcattatagtttactgttgtgaaataagggagaaaaacatctacatttgaaaaaaggacaaataaaaaataaaaatggtgagaaaaggtctgtgatatcttgatatttatctttctgatattttgaactgtgaagtatctattaaattc

SEQ ID NO: 26888 - DNA, 426 bp, Homo sapiens
accttcacacttactagtttggccaggtgtacagttctagtttgaaagtccttttccctcagaactttaaagagattgttcccttaagttccagctttttattaaaaaaaaaaaaatagagtttcccctcacttctctttaaaagtttttaggggcggggcgcgatggctcatgcctgtaatcacagcactcctgatcacaaggtcaggagattgagaccatcctggccaacatggtgaaaccctgtctgtactaaaaatacaaaaaattagccaggcgtggtggcgggcgcctgtatagtcccagctactcgggaggctgaggcgggagaatggcatgaacccgggaggtggagcttgcagtgagccgagatcgtgccactgcactccatcgagcctgggcaacagagcgagactccgtctcggg

SEQ ID NO: 26889 - DNA, 759 bp, Homo sapiens
aagcacacttttatttttcatcccttttagccagaaaattgcattcttattgactcttagaccaagaatgatcctcagtcatttagatcacaaaattaagaaatatttacttttccatagaaatattaaatggttataaaaattataacacccctatgttcctaaatggtgctttattaaaaatgtagatatacattcttttctgttttcagtctgcatttgaagtgtttgacaccgtcaggtgttctggatttaaatgataaaaagcattatccaaaaggaattagtgaccctgaacttaaaaacatctaatagtctctctccctttttctttttactagacgtgtgcctatagtttgttcatatgaaatagtctttatgcttcagatgcaaagtgtaatgtacataacagtatatacttagtttttcaatcatatgagctttttgccaaccttaaagataaatcattggctgctttgggcacactgcctattgggcagtcctgctccacagggagcagtgtaaaaaaaaaaaaagatatgtggtggagattttgtacattaaagatattgctttaaaagcctagtgtatttggctaaatgtggattctccaaggaattacgtcttagttattttgaaaaacatgcatccatttacatggaagacctctccagcacttagaaatttctgaatggggggagcctatggccattgataacacatccaagatatctttgagataagtcaatgtcttccagg

SEQ ID NO: 26890 - DNA, 2453 bp, Homo sapiens
ctggccaagggcgtccactagacaactctatcccttgcgctgaagctcaatcgtgctgagggagagctttcttaatattactgtgttgctcttagcccttctctgggttaggatctgtcagcatttctatgataaactcctattctcaaaggtttttaatttgaccataaaaatgtgccccaggctgaagtttgctatacagggctgtaccaaagagtcaaggtttacttccttctctttccaacttcttccccattctccaaggaaaagaacaacaaaaaaatctggtatggtccctccttaatagtgatttcagaattttggaaagcaccaagatccaagatggtagttttaatgtagttactcattcgcacacattttttaaatttaatgggtcacctggcatatattgtagataacatatcttttctataatttgtaagtcaataatttttttaactgctacatgatatttttttttgcccaaagattttaaaagacttgaagttggtcagttcaaaactcagatttttctacacattgtctgccatgtccattaggagtttggggaaaatactctcacacagacccttactttgcatgcagtttagagggtaagatacgtgcttcttttggggataaagatttccttacttaattgtcaaatttcatggagccattctagtctgttggggaaaatagtgattaaaaccacttccaaaattaacattttttgacaattcagatatgataagaagcaggggaaaataatacactttactcttttcttgcttaaaggcaaagaaatcaatgaaacttgaggacacactaaacatttgataactgcaaatgtgctttaaaaattggttcaatggtgcttacacatgaaacggtaacaaatggggttcctaggacgtcagaaggaatctttagtttgtatgtaattacacactagaggaggaggtgcttttaagccagtcttttatttttaatcatctcaaatatgcaaccatacatgcagtaacattaagggtcgtaaactggtgggaaacaggaacttcagtggagaggcttaaatgcctctggttagagtgggggtttttgtttgtttgtttattgttgggtttcaacactgagcatcatttctgtgatcaagtttctaactggcatgtgttttgatcatgaggtttaccatatcttgcccatacagacaaatgagagatctagtttcattttgttccctaaagaaagaacactctctaaaattaaatcatacctgtaaatttcttcagcatttgtttctgttcaatgaaattgagacccttaatgttgctttaatgtaaaattgaatattttgtctgtgatatactttaataatttaaagtaagtaatagttctaaagtcttcactgttgctactaagagaaaatagaattttaaaggtgatgataaagatgctataatgtcagttcactccagtccaatcaaatgtagtaagaaaaagtccttgaatagttctctagggacaatttctcacttgccattgacattaatctttggtgtattctcagaaaaaataaaaagaaattgaaactggtccaaggttatagtcatatcctcgataacttttgaaaaaaaattttattaggaaattaatactagcctttttcattctggctgaaagaaaattattaaaggattagttgagtgtgaaattcaacagtattttgctcatacatactaaaaaggtgcgtagggacttggcgcatttaaacaagtttctgaaaggtttcaatttgactcaagaaaaaaattcaatatttcttttgaaaatactgaatttatcacttgctgcatggatcagatggcataggttaatctttgattttcagaatcctaatgaaataactttcaaacaatttgtgtccttaattaaaggtggaatgagatccaatttttccccctaatccttcagtttaagctgatacatgtaggttaatgtggaatgaaatcatctgtgatatattatgttcatttatcaactgagcttttttgatgttgcctgtttttatgtaaaacatgttcttaaagttaataaaataatagtacttggtgtatgaactactacataataccttagctgaagggtacgctcctcagttcatttgccatattggagtaaaatttcaccttagttcaattcacaattgacacattcagttcacgaaggaatagcccagctgtgttcttagggggaattctctctatgcaaggctttaaaaattagtcatgcggtcagagtgtagctttcccacatgtcctccatagcacagtgtgtatttcatgagcataattcaaaaacagctatttcaaaaatgtcccttttcatatattacgttcctgcctgggccactgacttggataaatacaaataaaccaaataccattcagccc

SEQ ID NO: 26891 - DNA, 329 bp, Homo sapiens
caaaaataacaaaatataaaaaggaaaaaacgtaattctaccaaaacacattaacattttaaggtatatttatcctttcaaagttaaaaataacttttaccacctccctaaattataaatatattgtaaaaaagcctaaatggtagcgtagtgcttccttgcttctgcccctgatggtctttgtttagcgttttttgtttgtttgtttgttttttgagactgagtgtcgctctgtcgcccatgggcgatctctgctcactgcatcctccgtctcccgggttcaagcgattctcccgcctcagcctcctgggtagctgggattacaggcg

SEQ ID NO: 26892 - DNA, 545 bp, Homo sapiens
ccctttttatatagttttctctttagcaggaaataaagggcatgaaatatgttgaattctggtttttcctggtaatcctttaacaatacttcattggttccaaaaagtgagtcttattcagaacttttatcatccttagcatttcagggacacttctattcactataggctctaacctttttgtgagtattataatagctatttgctcttctgatatatggctatgtggcttttcctccaatttttgtacataattggttcagtctgaacttaaaagaaatctgcctgctccagtactttagtgttttgatatttatctttttctcttcattgagataattcttctttgcactaaaaggatccttttgagctgttcgccttttagcatttcacatcatggaaacatacctatctttttgagattttgaaaatctaattgccaaactattattaatcacttcttcacataggctgtagactttagcttggaaacaatgtccagatttaatggttttaaatgaaaccttttgattatttactcacag

SEQ ID NO: 26893 - DNA, 496 bp, Homo sapiens
tctagaatgagccctggggcaccgaccttttccagtatagaggaatggccagagagaggaggaaaaccagaggaatatgaagtcataatataagtgaagacatggtgatctttgctgaggctttgaagggattgcaaaatgaagacagaatttattattggatgcaacaaaacaatgtattggtgactgacaagagctatctaaagagacatggggggaaaagcctaatggcagaattttgaaagaaattttcagttaaacatggcagactgagcataaacattaacctccatttcctgcccaaaccctactcacataaagtaataaaagaccaaaaaaaccccacaaagaatgggagaggagacactagtaagcaagagaagtcaacaaaattatagagactgggaatggatggagaagtgataactgagttagctagagaaagttgagacttacgtttgtgggtgaagccaacaagagaccattcctgccagca

SEQ ID NO: 26894 - DNA, 415 bp, Homo sapiens
ccgagagttgcattttcaaggcattagcatatctgttaattccagagaggcttgtcgcctcttggtagggctttagtagttttataccctttagagagaagagaagagctaagcctagagactgtaagtgatttgcccagggtcccagtgttcttgggagtagaaagcatgccttatgtatctttgtgtggctcacaagtctcagaacagacagtgtcaggcccagaaggagctcagtccaagttcattgtattgaattggttctgtatgcactagattctgggtctctggactcctggtcactcacttgatgttgaaaatacccaaagtcaagtgtacccctagagatgagtttggctgtagactacagtggacacagggtggtgggataccccagctcctatcgtatgttttc

SEQ ID NO: 26895 - DNA, 281 bp, Homo sapiens
gaggaggctgacaaatacaggctacatattcaaattcttctgtcagtagcagttgcaatttactatacaccaaagcctatacaaagcagggatctcagcagcatcctttcctggggtattagtcaaagttctccagagaaacagaagcaataggatatatttagagtgagaggaagagatttgtttttttttaattggctcacacaattgtggggctcacaagtctgaaatatgtagagcaggctagcagactggaagctcaggcaagagttgatgctacc

SEQ ID NO: 26896 - DNA, 497 bp, Homo sapiens
gtgtgggtgaaagagctatgcattgcagaagtaactgcatttccaaatgaccgaaaatccttgacctgtcataggaatacctcagggtaaatgttgctgagggcagttgcaatctaagaaagaaaacatgcttgccctttatcatagtgtcaccttgcaggcctttttttttcctttgtgactcaccgggagtgctgatatgtgtatgtcttttccccctcatagtaccaagcagagtaatagggaaccggtgtgcttttaggatttctaccttctgtggcgcgatcctcccactgctgcatgccagtcgcctgcctctttcatgaaatctccttcccgttttggtttggctttgtttctatgttcgtttttatgggatagattttttttttcaggttaaacaaattttaaggggatttgcttattcaaaaagaacactgaatacatgcatcttactgaaagcttgtaatacagtgagtgctttagattggtttttt

SEQ ID NO: 26897 - DNA, 442 bp, Homo sapiens
atcccttccagaacaaacaaaagtgattcagctataactaaagcaccctcgtgccagctggctctatcagggacaaacacagctttccgcgccctctcttttcctttccctcctaatccctgggtttggccctccaggccatacacagtcacacacaacacacaacacacacacacacacacacacacacacacacacacactcccaactcaagctagacctgaaatgaggcaaacctgagagcacagcctgccttcctaattgtgcgatccctggttctccactgaacttgtactccacctgctgctgaaatgactcattctttctcattcattcattcattcattttgtgttagggaatggggaatcctttatcaaaactgccgtaatactgacattaagctagttaaataaaagacatctaattataaactgggaggtg

SEQ ID NO: 26898 - DNA, 418 bp, Homo sapiens
aagtaagacgtaacgggatgaacgggatgttttctaaacttggtgaaacgtataaatctacaaattcataaagctccagaaagcccaaccaggatgtgtgtccagaaatccctgtctaggcttgtcattgtcaaactgctgaaaagcagcagtaaagagaatctttaaggcagccagagaaaaaaggatccatgacatacaaggggacactcatgggaatcaccacagccgccctgtcagaaaccatggggttcaggacacagtggatcacatcttcgaagatctgggctgggaggaattaacccagaattctgtgtgcagcagaaatattcttcaagagtgtaagtgtaataaggagagttcagacagaatccaagagcatttgtcgtcagcagagcccctcctattagaaatgcta

SEQ ID NO: 26899 - DNA, 430 bp, Homo sapiens
aatcacttgaacccagaaggcggaggttgcagtgacctgagattgcatcattgcactccagcctgggcaatgagcaagactccgtctcaaacaaacaaacaaaaccaaaaagttaatactacatgctagatattatgccaagggtgcagtggttaccaaatcagacatagttcctactcttatggagcctacattctttttagcgttgtacaacttatgcaatactttaattataataactcattaaatggttttatgtttaaagcctttgtttaggtctcacattcatgattttcaccactctgtatatcacttatactattaattatttacaatgtttctttaaatgactcacaacctgtgctataggtaaggtaccttatgtatgttttctcatttaatgttcacatgaacctttcaaagtaaagct

SEQ ID NO: 26900 - DNA, 540 bp, Homo sapiens
tggtgctgttgttctagtttgagggacatggagctggaaacctggggaggagccggtgttgatcttctttgagggtcatggagctggagatccgaggaggagccggtgttgttctagtttgagggtcgtggagccggagacccggggaggagctggtactgttgttctggtttgagtgtcgtgaagctggagacctggggaggagccagtttcgttctaatttgggagtcgtggagctggagacccggggagcagtcgctgtttttttagtttgagggtcgtgaagctgcagacctagggaggagcgctgttgttctagtttaaggatcgtggagctggaaactcagggaggagccggtgttgttctagttttcaggtcgtggacctggagacctggggatgagtggtattgttcttgttttaaggtcatggagctagagacccaaggaggagccattgtttttttagttttagggtcatggagctggagacccaaggaggagctggtgttgttccagttatagagtcgtggagctgaag

SEQ ID NO: 26901 - DNA, 939 bp, Homo sapiens
atggatggagataaccagagtgagaactcacagttccttctcctggggatctcagagagtcctgagcagcagcggatcctgttttggatgttcctgtccatgtacctggtcacggtgctgggaaatgtgctcatcatcctggccatcagctctgattcccacctgcacacccccatgtacttcttcctggccaacctctccttcactgacctcttctttgtcaccaacacaatccccaagatgctggtgaacttccagtcccagaacaaagccatctcctatgcagggtgtctgacacagctctacttcctggtctccttggtgaccctggacaacctcatcctggccgtgatggcgtatgatcgctatgtggccacctgctgccccctccactatgtcacagccatgagccctgggctctgtgtcttgctcctctccttgtgttgggggctgtctgttctctatggcctcctcctcaccttcctcctgaccagggtgaccttctgtgggcctcgagagatccactacctcttctgtgacatgtacatcctgctgtggctggcatgttccaacacccacatcattcacacagcgttgattgccactggctgcttcatcttcctcacccccttagggttcatgaccacatcctatgtacgtattgtcagaaccatccttcaaatgccctcggcctctaagaaatacaaaaccttctctacctgtgcctcccatttgggtgtggtctccctcttttatgggacgcttgctatggtgtacctgcagcccctccatacctactccatgaaggactcagtagccacagtgatgtatgctgtgctgacacctatgatgaaccctttcatctacaggctgaggaacaaagacatgcatggggctccgggaagagtcctatggagaccctttcagaggcctaaatga

SEQ ID NO: 26902 - DNA, 203 bp, Homo sapiens
taaatcattttaagacaggttttaaattttaacttttgtcagcagatccctgctcccattccccacaatgaggcactgagacacacttctaaaatgacttttaagtaaaagatcatgtggtaaagacacaggttgacataccaagtccaattctattcgtacaaaataatttcctgctgttgattaaaaccgttatctcctga

SEQ ID NO: 26903 - DNA, 338 bp, Homo sapiens
taaatttttatttatttttttttgagatggagtttcactcttgttgcccaggctggagtgcaatggcgcaatctcggctcaacgcaacctccacctcccaggttcaagcggttctcctgcctcagtcatgcatgcgccaccacgcctggctaattttgtatttttagtagaggcggggtttctccatgttgccaggcatggtggcgcatgtttgtaatccccccgcaaggctgaggaggagaattgcttgaacctgggaggtggaggttgtagcgagctcagattgtgccactgctttccaccctaggcgatagagtgagaccctgtttcaaaaaaaa

SEQ ID NO: 26904 - DNA, 328 bp, Homo sapiens
taactatctgaatgtcgtgctatgaattccagttctattttctttctattttcccaaattctgttgctagcatagaggatctctaataacatactaaccagttttacttcagggcaattatttcttttcagtattctgaggtctgtttaagttctcccaaatgtaacacagggataaggaataagtattttctctctaggttctccttggcccattttcattttatcgcatgccaaaaggagcttatagtgaagaatacttagaaaatatctaaatgattctgagtaaactgtttcaagtaaggccatggctctttaagttacacact

SEQ ID NO: 26905 - DNA, 193 bp, Homo sapiens
gtagaatgtgttgttttctctttctgtatttcctcccccagtcacctatagattcctggaattagagctagcacttcacagaacagagctggacttgctctgaagcttacagctggaacctctgagtgtgtatacgtgcacactctagaatcagatgagccagactgcattccagctcagcacctttctcgct

SEQ ID NO: 26906 - DNA, 447 bp, Homo sapiens
caaagaatagaacagtggttaccagagactaggaaggggcaggggtatgggccccaggagtggttggccaaccagtaccaagttacagttaggcaagaggaccgagctctggtattctattacacagtaggataaccagagcaaataacaaggtattgcgtatttcaagatagccagaagagaagatttagaatattattaccaccaagataaatggtaaaagtttaaaatgatggacatggtaacttcctcaattccatcatgatactatgtatatacgcattgacacatcacactgtattccataaacatgtacaattaccacgtgtcaattagaaatgaaaattaggcagggcggggtggctcatgcctgtaatcccagcactttgggaggcctaggcgagtggatcataaggtcaggagcttgagatcagcttgaccaacatg

SEQ ID NO: 26907 - DNA, 392 bp, Homo sapiens
gtgtgttttagtctaatataatttgaagagggaaatacttcaaggcccaaaggcttataatgtgtacaagcaataatcaaaattttaaacctatttttctctaggtcttagccaggcacagtggctcacgcctgtaatcccagcacttgggaggccgaggcaggcagatcacttgaggttaggagttcgagaccagcctggccagcatggtgaaaccccgtctctactaaaaatacaaaaattagctgggtgtgatggcgtgcacctgtaatcccagctacttgggaggctgaggcaggagaatcacttgaacccgggaggcggaggttgcagtgagccaagatcatgccactgcgctccagcctgggcaacagaacaagactccatctcaa

SEQ ID NO: 26908 - DNA, 410 bp, Homo sapiens
atctcttgccttgggggagaggcatgggtggtggtggtataaacttggctcctggcttactaagctgggtggaggaaactatgagatgatatctcactgattagcatacgatctttcacttgctctccttcttgtaggtccagtggctctctcctgatagttcccctgatgtacccaagtgggaagtcctcctggttcaatttcactacagtacactttgtctcctgctagcatggaggagggatggagttttgggctgaactgtatctccctaaattcaagtgttgaagtcctaaccccctcataccccagaacgtgagtgtatttggagatagggcctttaaagaggtaaataaggtaagatggagtcaaatgggtgggccctaatcccatatgtttataagaaaagg

SEQ ID NO: 26909 - DNA, 510 bp, Homo sapiens
ataaccccattaaaaaatgggcaaagaacatgaacagacagttttcaaaagaacacatatgtggccaacaaacatattaacacatgcataccatcactaatcattagagaatgcaaaacaaaacatcaatgagatactatctcacacgagttagaatgacttctgttaaaaataataaaaatatttaaatattcaatattaaaatgttatttagattgagataaattaatttgtcattattctcaaaacatggatatttaagaataaccttacttcacatgtaataacacaacaactacctgaaaaaataaaagctggggcctagcatggtgtctcaagtctgtaatcccagcactttgggaagctgaggtgggctgatcacgaggtcaggagtttgagacaagcctggccaacatggtgaaaccccgtctctactaaaaatacaaaaattaactgggcatggtggtgggcacctgtaatcccagctacttgggaggctgaggcaggaga

SEQ ID NO: 26910 - DNA, 198 bp, Homo sapiens
aagtgcatatacttactttccccaactgcctacactgagaaaacctatactcaaccttcctataaaacatctcataaaatctgtttcaccatatttagaggctcattctccttatgcttttatatagacaatgatcccacattttttttttttttttttttgaggcagagtcttgctctgtctcctaggctggagtgc

SEQ ID NO: 26911 - DNA, 9197 bp, Homo sapiens
cacttactacagatgggtgctaatgtccacgctcgtgatgatggaggtctcatcccgcttcataatgcctgttcttttggccatgctgaggttgtgagtctgttattgtgccaaggagctgatccaaatgccagggataactggaactatacacctctgcatgaagctgctattaaagggaagatcgatgtgtgcattgtgctgctgcagcacggagctgacccaaacattcggaacactgatgggaaatcagccctggacctggcagatccttcagcaaaagctgtccttacaggtgaatacaagaaagacgaactcctagaagctgctaggagtggtaatgaagaaaaactaatggctttactgactcctctaaatgtgaattgccatgcaagtgatgggcgaaagtcgactcctttacatctagcagcgggctacaacagagttcgaatagttcagcttcttcttcagcatggtgctgatgttcatgcaaaagacaaaggtggacttgtgcctcttcataatgcatgttcatatggacattatgaagtcacagaactgctactaaagcatggagcttgtgttaatgccatggatctctggcagtttactccactgcacgaggctgcttccaagaaccgtgtagaagtctgctctttgttacttagccatggcgctgatcctacgttagtcaactgccatggcaaaagtgctgtggatatggctccaactccggagcttagggagagattgacttatgaatttaaaggtcattctttactacaagcagccagagaagcagacttagctaaagttaaaaaaacactcgctctggaaatcattaatttcaaacaaccgcagtctcatgaaacagcactgcactgtgctgtggcctctctgcatcccaaacgtaaacaagtgacagaattgttacttagaaaaggagcaaatgttaatgaaaaaaataaagatttcatgactcccctgcatgttgcagccgaaagagcccataatgatgtcatggaagttctgcataagcatggcgccaagatgaatgcactggacacccttggtcagactgctttgcatagagccgccctagcaggccacctgcagacctgccgcctcctgctgagttacggctctgacccctccatcatctccttacaaggcttcacagcagcacagatgggcaatgaagcagtgcagcagattctgagtgagagtacacctatacgtacttctgatgttgattatcgactcttagaggcatctaaagctggagacttggaaactgtgaagcaactttgcagctctcaaaatgtgaattgtagagacttagagggccggcattccacgcccttacacttcgcagcaggctacaaccgcgtgtctgttgtagagtacctgctacaccacggtgccgatgtccatgccaaagacaagggtggcttggtgccccttcataatgcctgttcatatggacactatgaggtggctgagcttttagtaaggcatggggcttctgtcaatgtggcggacttatggaaatttacccctctccatgaagcagcagctaaaggaaagtatgaaatctgcaagctccttttaaaacatggagcagatccaactaaaaagaacagagatggaaatacacctttggatttggtaaaggaaggagacacagatattcaggacttactgaaaggggatgctgctttgttggatgctgccaagaagggctgcctggcaagagtgcagaagctctgtaccccagagaatatcaactgcagagacacccagggcagaaattcaacccctctgcacctggcagcaggctataataacctggaagtagctgaatatcttctagagcatggagctgatgttaatgcccaggacaagggtggtttaattcctcttcataatgcggcatcttatgggcatgttgacatagcggctttattgataaaatacaacacgtgtgtaaatgcaacagataagtgggcgtttactcccctccatgaagcagcccagaaaggaaggacgcagctgtgcgccctcctcctagcgcatggtgcagaccccaccatgaagaaccaggaaggccagacgcctctggatctggcaacagctgacgatatcagagctttgctgatagatgccatgcccccagaggccttacctacctgttttaaacctcaggctactgtagtgagtgcctctctgatctcaccagcatccaccccctcctgcctctcggctgccagcagcatagacaacctcactggccctttagcagagttggccgtaggaggagcctccaatgcaggggatggcgccgcgggaacagaaaggaaggaaggagaagttgctggtcttgacatgaatatcagccaatttctaaaaagccttggccttgaacaccttcgggatatctttgaaacagaacagattacactagatgtgttggctgatatgggtcatgaagagttgaaagaaataggcatcaatgcatatgggcaccgccacaaattaatcaaaggagtagaaagactcttaggtggacaacaaggcaccaatccttatttgacttttcactgtgttaatcagggaacgattttgctggatcttgctccagaagataaagaatatcagtcagtggaagaagagatgcaaagtactattcgagaacacagagatggtggtaatgctggcggcatcttcaacagatacaatgtcattcgaattcaaaaagttgtcaacaagaagttgagggagcggttctgccaccgacagaaggaagtgtctgaggagaatcacaaccatcacaatgagcgcatgttgtttcatggttctcctttcattaatgccattattcataaagggtttgatgagcgacatgcatacataggaggaatgtttggggccgggatttattttgctgaaaactcctcaaaaagcaaccaatatgtttatggaattggaggaggaacaggctgccctacacacaaggacaggtcatgctatatatgtcacagacaaatgctcttctgtagagtgacccttgggaaatcctttctgcagtttagcaccatgaaaatggcccacgcgcctccagggcaccactcagtcattggtagaccgagcgtcaatgggctggcatatgctgaatatgtcatctacagaggagaacaggcatacccagagtatcttatcacttaccagatcatgaagccagaagccccttcccagaccgcaacagccgcagagcagaagacctagtgaatgcctgctggtgaaggccagatcagatttcaacctgggactggattacagaggattgtttctaataacaacatcaatattctagaagtccctgacagcctagaaataagctgtttgtcttctataaagcattgctatagtgatgaatagtatgagtaactgatacatactcaactgctactgttccctttgaggaaatgtttacaggggcggccttttaacatatctcaggctcattttcattgcaattatccatttctaaaacaagattgcttcgatctagacttggaaatggaaaataagaaaaccaatgctttttcaaatgttcacaattcacacactacatttgttttgttatgcatgacgtgtctataacaaatatacacatacgacaggcaacaagcttgtttttgatttgccagacatgcatcattggctattgtttgtttgttttttgtttttttgtgttttttgggttactttgaaaatgagccagagccttcttgaggatattttgcacaaagtcacgctgacaaaatcattagcagtgcaacccaagcttctggctgagcaagattcagtttccactttttaaaatttttttattttgctctgtagctgcacttctcgttatcataaattgagatgaaaaggaaaaaacatcaagttttagtacctttttatgaattggcctatcttacaagagaagggcacaaacaccaacctgacttaggaacgcctaaattcagagaagtcaaagccggtgaaggccacttgctctttccaacacaagcctgccacagaggtcttcgggacagtactggagatgcaggttgacacgggcttgagttccaaggtgaaaaaactggggaggctgtgaaggaagagctgcattaaggagggtgaggagcgtgtggttctgtatcatggcagccccaatggatccaggggatgcctccaaaaaatacatgcttcccttcccttaatctgtactgttgggattgttacccctccaaattagctgccttatttcaaaagtcagtgaaattactgcacttgatgagggtcacaaaaataccacttgattgtttctttagttgagaatgctgggattcagactcgaatagtggatagatacacacaaatgcaaggacttttttgtttactccagatttggggtttattttgagtggcatgcttcaaatagttcataaagatccttgcattaaatttctgaaccatttcttcaaacttcttagtgtgtttagacaaggagaacaaaaattgaaaccaaagccctttctgttattttttcaatgaaggtgagaaagaaataccatacaattttctttgtgaaattactgtttattttcatcaacatttaccaagtgccattgacatttataaaaaaaatgatcctttatagttcttacacttgcccttttcaccttaactgaatatgaattgagtgcactaacttatttacttgatatactgtgcatctactctgctttgaagcgaaagaaatataaacacgaggaggaataggaaagacagtgtgacacaaacttgccattgcaattcaaagccctgaaaacgatgggtttaatgcaaggtgattaagctgtgacctcctttaatctcctgaagcaaaataaaatggttacatgcaaaacttctagaaatagactcttaaaatatatacattttgctttgattttggcttcaacccagtgctggaactaggcatccagactagtttgaatgtttgtagctgaatttttatgggtcctcaaaattaaatcgagaattagcctcagttgttgcttcttttgaagtttcagtgacccaagctgggtgtttgtgtcttggctacttgtttaatagcactagaattccaggtgaagctttgagagttgatattcattaagagggctttttttccccttctttccttctcttttgctgtaacaaagggttgaagaaattgccatctgtgtagttttcagtagctgtcaagtgtgtcttacttaccttcccccagacgtagtttaaaatggtaaacacagctgtgatttttagttaagtaaaagagttaatatgatatagatatggaaagctttatggcttcattaaaaagataaaccactacctaactgtggttgtatgttgtttccatcatactaactagatgaatggatgcgccagttttcatcttggtccttacacttgagaagttaaactgtggttcagtatttaaactgccagtgttatacgtctcatgctctgtgtgccaggtgaaggtactgtgtaaggaagacatttgcggtgcttcttgtcctataatgattcaagtatatagtagttcttgaaagagtgtgcatatattactcatctgcttaagagagtgggttaatggatatatcagaggagccaaatacatttttttcagaacttgaaaaccaaaggtcatcatgagtgcactcaaaagttaggacaagtttattacatttgggattttcatctgtagccgtatgaagaaccctttccaatataaaagcatggcattaaattaggctgaagtcttttattttttgtatatgtactatatagaaatactagcaagttaggatcatccaatatggcctaccccgaaatggcccctctgtttccctaaccacatggaagaaagaatctgaacgtctccaccggctctacccgagttccaaaactaaagggcttctccagacctgatggttccagtttacctgctgttggcctgctggatacttgactcaggcataaattaagtgccctggtcccgaactttctccctgtatttgacctccttccctctttcctaaattactagtctggaattaaaattagctccagcaatgacctttgactccattcattttctcctcatcttgggtcttaaaaaaggagaccagatacctcctagcttttgtatcacaaccaggaatgggtattaggcctcatgcgctttgctcagaacactgccgctttgttaacaaatgacagcatggaacccagagttttgattcgatgcaaaataacagcagtgcaaccaggattcttgttttccttttccttcttggagtttggaatttctagcttttcaagcagcataagtagaatcaacattaggatgttttcatgaaatagcatccttatacttctttgagcttgatgttagtggctagactgatttccctttgctctcaaaatacaaagtgcattgaagtatacagagaaatgcctgaatatggcaagcaaataatgtagattaacattctattattgtatccgttttacaaaaaataaaattttgatatatgccggagaacggcattagaatgcaataagttgtctaggtttttctgtttcagtgtctctcccaatggcacgaagggttattgggcattgtccccacccccgcctttttaacatgtgcactatctggattcctgtaaatggccttgcaaacagaagtggtgtgtattttcaagcacctttcccccattgtatccgaatccctcttgtgtgatatctgtgacaaatagccttcttcttgtgttttctgttggactaattgtctcacgtaaagctatagaccttactaatttggcaggtattcaaaactgccattaagataggatttcatgtcagatacgtatttaaagagtaaagtcaaatttgtttaatgtcagatcagtgacagaagtgaaaagaaagtaattgtgaaagtgatgtttgagctattgtacacatctagcatatggaaagcaaatgcactcgaaaactactattctagaacatgaggcttcttcagcaacttgtgcactctgccattaataaattaaatttttcccctctagaaagccttaactatggcggaaactttttaaccttttatattttaataaataaaacattgtagtcccatttcttagtgtttgaaaggtgtgtcagtgagtcggccatgtctccatgtgtttcagacctgttcatcttattttatgatggtatatttcataagtaatattcccttacatgcaatggagctgattaaaattaatccatttcaatttctccatattggaacttcctcagctaccagatttctggtttggagaagtgctggaaagatttcaaagcctattcagttgtgtatgtggggatacgacagcaactgtgataccttgtagaatatgagtgatatgcaagctgtgttttttaattgttttaaaatgtaaattatggttatgctaaagtgaaaacctagaggaagctaatgattttatatactttgcacgaccaaatatggtcgtagtatgacgagttttatacattgccagagagttctgcctcctctgaaataacattcgcactgtagattgcatttcggcttttcctcctttcacattcttttttgctttacacttcacgtcttcgcacctgccctacctcccatcctttcaaagaggtttctttcacgttccagaattcagattgttctgtgatttcttttacatcagtctacccatttctgcaggcagccctgaaagcccttgtgttgattcagagtgtttgcagagaaatgcagttgaaccctggtagtggggtgtccctcacacacccgcgcacccctcccaaagttcaggatgaaaggctagaaaacccattcaaagttaggaaagaacacagatctttgaggccgatagcctagacctagaagatgaccttgagtatgtaaacattgtctccgtgacacaaaacactgaaactcttcatgtgcatataacacctgcttctgctcccattgtttcaagctcatcttatctttgtagtagtaatgtttgtctttgatacctacaaactaaaaaggtacttttatcaaggtttctcaaaacatttacaaaaccagctttgagaaaatgttatgttgcctggcaacagcactcggagtagtaattgtgttttctcattgtgatgttggtctgtgtgagcaaccagtgtagtgactctttggttcattattcgtgttgtttttatttttagtctctgtgtgacccaacagtggcaggggttacaaccccctctcctttcttttttgtatttatctatttgtaggattgtcagatcaagtacaagatgcccagttaagtttgaatttcagagaaacaatttcacgttaagaatgtttcatgcaatatttggcatatatttacagtaaaagcattcattatttgtctgaaattcaaatttaactgagcatgctggtttttctcattgtttggtttttctaaatctggcaatcctacagctgtggtcatgggaaatcacctacagcatgttaaagtcctctagtcatcatctcgtcacctgaaatggaagtcctttttccctcaccctccacttctttccaaaggagggcatcaaggaacttaacctgcctgcctggtgggtttctatttaagacatctttgtgattatatttaacctgcaattgtgctttggcttaatgtctagctcactgtacttgtaaatgattaatattcaataaaaccatttttaaagtaaaaagaaaaagataaagaaaaagaaaaacaagagaagaaaaagaaaaaaaagagagggagcccctaaaaagaagcctccgagacgacaagggggaaccactaaagatagaaacagaggaccaaacaaaggcggcaacaaaaaacgacacgagcgacaaacacggcggcgggcaaacaagcagaggaacacacgtgagagagaacaccatgtaggggacccacagggggagcacccagaacaacaccaacgagacaaacagcggacaggagacaaagtatgcgggcaagtgcggaacgaacata

SEQ ID NO: 26912 - DNA, 591 bp, Homo sapiens
  misc_feature (557)..(557): n is a, c, g, or t
cgcctactactactaaattcgcggccgcgtcgacattaagagggctttttttccccttctttccttctcttttgctgtaacaaagggttgaagaaattgccatctgtgtagttttcagtagctgtcaagtgtgtcttacttaccttcccccagacgtagtttaaaatggtaaacacagctgtgatttttagttaagtaaaagagttaatatgatatagatatggaaagctttatggcttcattaaaaagataaaccactacctaactgtggttgtatgttgtttccatcatactaactagatgaatggatgcgccagttttcatcttggtccttacacttgagaagttaaactgtggttcagtatttaaactgccagtgttatacgtctcatgctctgtgtgccaggtgaaggtactgtgtaaggaagacatttgcggtgcttcttgtcctataatgattcaagtatatagtagttcttgaaagagtgtgcatatattactcatctgatatatccattaacccactctcttaagcagatgagggcgacgcggccgcnaatttattaatagtaggccgccgctccttaggat

SEQ ID NO: 26913 - DNA, 8894 bp, Homo sapiens
cacttactacagatgggtgctaatgtccacgctcgtgatgatggaggtctcatcccgcttcataatgcctgttcttttggccatgctgaggttgtgagtctgttattgtgccaaggagctgatccaaatgccagggataactggaactatacacctctgcatgaagctgctattaaagggaagatcgatgtgtgcattgtgctgctgcagcacggagctgacccaaacattcggaacactgatgggaaatcagccctggacctggcagatccttcagcaaaagctgtccttacaggtgaatacaagaaagacgaactcctagaagctgctaggagtggtaatgaagaaaaactaatggctttactgactcctctaaatgtgaattgccatgcaagtgatgggcgaaagtcgactcctttacatctagcagcgggctacaacagagttcgaatagttcagcttcttcttcagcatggtgctgatgttcatgcaaaagacaaaggtggacttgtgcctcttcataatgcatgttcatatggacattatgaagtcacagaactgctactaaagcatggagcttgtgttaatgccatggatctctggcagtttactccactgcacgaggctgcttccaagaaccgtgtagaagtctgctctttgttacttagccatggcgctgatcctacgttagtcaactgccatggcaaaagtgctgtggatatggctccaactccggagcttagggagagattgacttatgaatttaaaggtcattctttactacaagcagccagagaagcagacttagctaaagttaaaaaaacactcgctctggaaatcattaatttcaaacaaccgcagtctcatgaaacagcactgcactgtgctgtggcctctctgcatcccaaacgtaaacaagtgacagaattgttacttagaaaaggagcaaatgttaatgaaaaaaataaagatttcatgactcccctgcatgttgcagccgaaagagcccataatgatgtcatggaagttctgcataagcatggcgccaagatgaatgcactggacacccttggtcagactgctttgcatagagccgccctagcaggccacctgcagacctgccgcctcctgctgagttacggctctgacccctccatcatctccttacaaggcttcacagcagcacagatgggcaatgaagcagtgcagcagattctgagtgagagtacacctatacgtacttctgatgttgattatcgactcttagaggcatctaaagctggagacttggaaactgtgaagcaactttgcagctctcaaaatgtgaattgtagagacttagagggccggcattccacgcccttacacttcgcagcaggctacaaccgcgtgtctgttgtagagtacctgctacaccacggtgccgatgtccatgccaaagacaagggtggcttggtgccccttcataatgcctgttcatatggacactatgaggtggctgagcttttagtaaggcatggggcttctgtcaatgtggcggacttatggaaatttacccctctccatgaagcagcagctaaaggaaagtatgaaatctgcaagctccttttaaaacatggagcagatccaactaaaaagaacagagatggaaatacacctttggatttggtaaaggaaggagacacagatattcaggacttactgaaaggggatgctgctttgttggatgctgccaagaagggctgcctggcaagagtgcagaagctctgtaccccagagaatatcaactgcagagacacccagggcagaaattcaacccctctgcacctggcagcaggctataataacctggaagtagctgaatatcttctagagcatggagctgatgttaatgcccaggacaagggtggtttaattcctcttcataatgcggcatcttatgggcatgttgacatagcggctttattgataaaatacaacacgtgtgtaaatgcaacagataagtgggcgtttactcccctccatgaagcagcccagaaaggaaggacgcagctgtgcgccctcctcctagcgcatggtgcagaccccaccatgaagaaccaggaaggccagacgcctctggatctggcaacagctgacgatatcagagctttgctgatagatgccatgcccccagaggccttacctacctgttttaaacctcaggctactgtagtgagtgcctctctgatctcaccagcatccaccccctcctgcctctcggctgccagcagcatagacaacctcactggccctttagcagagttggccgtaggaggagcctccaatgcaggggatggcgccgcgggaacagaaaggaaggaaggagaagttgctggtcttgacatgaatatcagccaatttctaaaaagccttggccttgaacaccttcgggatatctttgaaacagaacagattacactagatgtgttggctgatatgggtcatgaagagttgaaagaaataggcatcaatgcatatgggcaccgccacaaattaatcaaaggagtagaaagactcttaggtggacaacaaggcaccaatccttatttgacttttcactgtgttaatcagggaacgattttgctggatcttgctccagaagataaagaatatcagtcagtggaagaagagatgcaaagtactattcgagaacacagagatggtggtaatgctggcggcatcttcaacagatacaatgtcattcgaattcaaaaagttgtcaacaagaagttgagggagcggttctgccaccgacagaaggaagtgtctgaggagaatcacaaccatcacaatgagcgcatgttgtttcatggttctcctttcattaatgccattattcataaagggtttgatgagcgacatgcatacataggaggaatgtttggggccgggatttattttgctgaaaactcctcaaaaagcaaccaatatgtttatggaattggaggaggaacaggctgccctacacacaaggacaggtcatgctatatatgtcacagacaaatgctcttctgtagagtgacccttgggaaatcctttctgcagtttagcaccatgaaaatggcccacgcgcctccagggcaccactcagtcattggtagaccgagcgtcaatgggctggcatatgctgaatatgtcatctacagaggagaacaggcatacccagagtatcttatcacttaccagatcatgaagccagaagccccttcccagaccgcaacagccgcagagcagaagacctagtgaatgcctgctggtgaaggccagatcagatttcaacctgggactggattacagaggattgtttctaataacaacatcaatattctagaagtccctgacagcctagaaataagctgtttgtcttctataaagcattgctatagtgatgaatagtatgagtaactgatacatactcaactgctactgttccctttgaggaaatgtttacaggggcggccttttaacatatctcaggctcattttcattgcaattatccatttctaaaacaagattgcttcgatctagacttggaaatggaaaataagaaaaccaatgctttttcaaatgttcacaattcacacactacatttgttttgttatgcatgacgtgtctataacaaatatacacatacgacaggcaacaagcttgtttttgatttgccagacatgcatcattggctattgtttgtttgttttttgtttttttgtgttttttgggttactttgaaaatgagccagagccttcttgaggatattttgcacaaagtcacgctgacaaaatcattagcagtgcaacccaagcttctggctgagcaagattcagtttccactttttaaaatttttttattttgctctgtagctgcacttctcgttatcataaattgagatgaaaaggaaaaaacatcaagttttagtacctttttatgaattggcctatcttacaagagaagggcacaaacaccaacctgacttaggaacgcctaaattcagagaagtcaaagccggtgaaggccacttgctctttccaacacaagcctgccacagaggtcttcgggacagtactggagatgcaggttgacacgggcttgagttccaaggtgaaaaaactggggaggctgtgaaggaagagctgcattaaggagggtgaggagcgtgtggttctgtatcatggcagccccaatggatccaggggatgcctccaaaaaatacatgcttcccttcccttaatctgtactgttgggattgttacccctccaaattagctgccttatttcaaaagtcagtgaaattactgcacttgatgagggtcacaaaaataccacttgattgtttctttagttgagaatgctgggattcagactcgaatagtggatagatacacacaaatgcaaggacttttttgtttactccagatttggggtttattttgagtggcatgcttcaaatagttcataaagatccttgcattaaatttctgaaccatttcttcaaacttcttagtgtgtttagacaaggagaacaaaaattgaaaccaaagccctttctgttattttttcaatgaaggtgagaaagaaataccatacaattttctttgtgaaattactgtttattttcatcaacatttaccaagtgccattgacatttataaaaaaaatgatcctttatagttcttacacttgcccttttcaccttaactgaatatgaattgagtgcactaacttatttacttgatatactgtgcatctactctgctttgaagcgaaagaaatataaacacgaggaggaataggaaagacagtgtgacacaaacttgccattgcaattcaaagccctgaaaacgatgggtttaatgcaaggtgattaagctgtgacctcctttaatctcctgaagcaaaataaaatggttacatgcaaaacttctagaaatagactcttaaaatatatacattttgctttgattttggcttcaacccagtgctggaactaggcatccagactagtttgaatgtttgtagctgaatttttatgggtcctcaaaattaaatcgagaattagcctcagttgttgcttcttttgaagtttcagtgacccaagctgggtgtttgtgtcttggctacttgtttaatagcactagaattccaggtgaagctttgagagttgatattcattaagagggctttttttccccttctttccttctcttttgctgtaacaaagggttgaagaaattgccatctgtgtagttttcagtagctgtcaagtgtgtcttacttaccttcccccagacgtagtttaaaatggtaaacacagctgtgatttttagttaagtaaaagagttaatatgatatagatatggaaagctttatggcttcattaaaaagataaaccactacctaactgtggttgtatgttgtttccatcatactaactagatgaatggatgcgccagttttcatcttggtccttacacttgagaagttaaactgtggttcagtatttaaactgccagtgttatacgtctcatgctctgtgtgccaggtgaaggtactgtgtaaggaagacatttgcggtgcttcttgtcctataatgattcaagtatatagtagttcttgaaagagtgtgcatatattactcatctgcttaagagagtgggttaatggatatatcagaggagccaaatacatttttttcagaacttgaaaaccaaaggtcatcatgagtgcactcaaaagttaggacaagtttattacatttgggattttcatctgtagccgtatgaagaaccctttccaatataaaagcatggcattaaattaggctgaagtcttttattttttgtatatgtactatatagaaatactagcaagttaggatcatccaatatggcctaccccgaaatggcccctctgtttccctaaccacatggaagaaagaatctgaacgtctccaccggctctacccgagttccaaaactaaagggcttctccagacctgatggttccagtttacctgctgttggcctgctggatacttgactcaggcataaattaagtgccctggtcccgaactttctccctgtatttgacctccttccctctttcctaaattactagtctggaattaaaattagctccagcaatgacctttgactccattcattttctcctcatcttgggtcttaaaaaaggagaccagatacctcctagcttttgtatcacaaccaggaatgggtattaggcctcatgcgctttgctcagaacactgccgctttgttaacaaatgacagcatggaacccagagttttgattcgatgcaaaataacagcagtgcaaccaggattcttgttttccttttccttcttggagtttggaatttctagcttttcaagcagcataagtagaatcaacattaggatgttttcatgaaatagcatccttatacttctttgagcttgatgttagtggctagactgatttccctttgctctcaaaatacaaagtgcattgaagtatacagagaaatgcctgaatatggcaagcaaataatgtagattaacattctattattgtatccgttttacaaaaaataaaattttgatatatgccggagaacggcattagaatgcaataagttgtctaggtttttctgtttcagtgtctctcccaatggcacgaagggttattgggcattgtccccacccccgcctttttaacatgtgcactatctggattcctgtaaatggccttgcaaacagaagtggtgtgtattttcaagcacctttcccccattgtatccgaatccctcttgtgtgatatctgtgacaaatagccttcttcttgtgttttctgttggactaattgtctcacgtaaagctatagaccttactaatttggcaggtattcaaaactgccattaagataggatttcatgtcagatacgtatttaaagagtaaagtcaaatttgtttaatgtcagatcagtgacagaagtgaaaagaaagtaattgtgaaagtgatgtttgagctattgtacacatctagcatatggaaagcaaatgcactcgaaaactactattctagaacatgaggcttcttcagcaacttgtgcactctgccattaataaattaaatttttcccctctagaaagccttaactatggcggaaactttttaaccttttatattttaataaataaaacattgtagtcccatttcttagtgtttgaaaggtgtgtcagtgagtcggccatgtctccatgtgtttcagacctgttcatcttattttatgatggtatatttcataagtaatattcccttacatgcaatggagctgattaaaattaatccatttcaatttctccatattggaacttcctcagctaccagatttctggtttggagaagtgctggaaagatttcaaagcctattcagttgtgtatgtggggatacgacagcaactgtgataccttgtagaatatgagtgatatgcaagctgtgttttttaattgttttaaaatgtaaattatggttatgctaaagtgaaaacctagaggaagctaatgattttatatactttgcacgaccaaatatggtcgtagtatgacgagttttatacattgccagagagttctgcctcctctgaaataacattcgcactgtagattgcatttcggcttttcctcctttcacattcttttttgctttacacttcacgtcttcgcacctgccctacctcccatcctttcaaagaggtttctttcacgttccagaattcagattgttctgtgatttcttttacatcagtctacccatttctgcaggcagccctgaaagcccttgtgttgattcagagtgtttgcagagaaatgcagttgaaccctggtagtggggtgtccctcacacacccgcgcacccctcccaaagttcaggatgaaaggctagaaaacccattcaaagttaggaaagaacacagatctttgaggccgatagcctagacctagaagatgaccttgagtatgtaaacattgtctccgtgacacaaaacactgaaactcttcatgtgcatataacacctgcttctgctcccattgtttcaagctcatcttatctttgtagtagtaatgtttgtctttgatacctacaaactaaaaaggtacttttatcaaggtttctcaaaacatttacaaaaccagctttgagaaaatgttatgttgcctggcaacagcactcggagtagtaattgtgttttctcattgtgatgttggtctgtgtgagcaaccagtgtagtgactctttggttcattattcgtgttgtttttatttttagtctctgtgtgacccaacagtggcaggggttacaaccccctctcctttcttttttgtatttatctatttgtaggattgtcagatcaagtacaagatgcccagttaagtttgaatttcagagaaacaatttcacgttaagaatgtttcatgcaatatttggcatatatttacagtaaaagcattcattatttgtctgaaattcaaatttaactgagcatgctggtttttctcattgtttggtttttctaaatctggcaatcctacagctgtggtcatgggaaatcacctacagcatgttaaagtcctctagtcatcatctcgtcacctgaaatggaagtcctttttccctcaccctccacttctttccaaaggagggcatcaaggaacttaacctgcctgcctggtgggtttctatttaagacatctttgtgattatatttaacctgcaattgtgctttggcttaatgtctagctcactgtacttgtaaatgattaatattcaataaaaccatttttaaagta

SEQ ID NO: 26914 - DNA, 5933 bp, Homo sapiens
agcttaattgacagtattcgaagtagaaataacattcagttttctagattgtagggtttatacacatttatttacagttaagtaggtgaacctcaaattcttcaggcacctattaagaaactgagtctatatagaatattggtcacgattaacagcctttgaggcttccacattcggcaaggctttaatattgtgcctactagaagggtgatttgtttttcttcttgtccttcccaggcatacccagagtatcttatcacttaccagatcatgaagccagaagccccttcccagaccgcaacagccgcagagcagaagacctagtgaatgcctgctggtgaaggccagatcagatttcaacctgggactggattacagaggattgtttctaataacaacatcaatattctagaagtccctgacagcctagaaataagctgtttgtcttctataaagcattgctatagtgatgaatagtatgagtaactgatacatactcaactgctactgttccctttgaggaaatgtttacaggggcggccttttaacatatctcaggctcattttcattgcaattatccatttctaaaacaagattgcttcgatctagacttggaaatggaaaataagaaaaccaatgctttttcaaatgttcacaattcacacactacatttgttttgttatgcatgacgtgtctataacaaatatacacatacgacaggcaacaagcttgtttttgatttgccagacatgcatcattggctattgtttgtttgttttttgtttttttgtgttttttgggttactttgaaaatgagccagagccttcttgaggatattttgcacaaagtcacgctgacaaaatcattagcagtgcaacccaagcttctggctgagcaagattcagtttccactttttaaaatttttttattttgctctgtagctgcacttctcgttatcataaattgagatgaaaaggaaaaaacatcaagttttagtacctttttatgaattggcctatcttacaagagaagggcacaaacaccaacctgacttaggaacgcctaaattcagagaagtcaaagccggtgaaggccacttgctctttccaacacaagcctgccacagaggtcttcgggacagtactggagatgcaggttgacacgggcttgagttccaaggtgaaaaaactggggaggctgtgaaggaagagctgcattaaggagggtgaggagcgtgtggttctgtatcatggcagccccaatggatccaggggatgcctccaaaaaatacatgcttcccttcccttaatctgtactgttgggattgttacccctccaaattagctgccttatttcaaaagtcagtgaaattactgcacttgatgagggtcacaaaaataccacttgattgtttctttagttgagaatgctgggattcagactcgaatagtggatagatacacacaaatgcaaggacttttttgtttactccagatttggggtttattttgagtggcatgcttcaaatagttcataaagatccttgcattaaatttctgaaccatttcttcaaacttcttagtgtgtttagacaaggagaacaaaaattgaaaccaaagccctttctgttattttttcaatgaaggtgagaaagaaataccatacaattttctttgtgaaattactgtttattttcatcaacatttaccaagtgccattgacatttataaaaaaaatgatcctttatagttcttacacttgcccttttcaccttaactgaatatgaattgagtgcactaacttatttacttgatatactgtgcatctactctgctttgaagcgaaagaaatataaacacgaggaggaataggaaagacagtgtgacacaaacttgccattgcaattcaaagccctgaaaacgatgggtttaatgcaaggtgattaagctgtgacctcctttaatctcctgaagcaaaataaaatggttacatgcaaaacttctagaaatagactcttaaaatatatacattttgctttgattttggcttcaacccagtgctggaactaggcatccagactagtttgaatgtttgtagctgaatttttatgggtcctcaaaattaaatcgagaattagcctcagttgttgcttcttttgaagtttcagtgacccaagctgggtgtttgtgtcttggctacttgtttaatagcactagaattccaggtgaagctttgagagttgatattcattaagagggctttttttccccttctttccttctcttttgctgtaacaaagggttgaagaaattgccatctgtgtagttttcagtagctgtcaagtgtgtcttacttaccttcccccagacgtagtttaaaatggtaaacacagctgtgatttttagttaagtaaaagagttaatatgatatagatatggaaagctttatggcttcattaaaaagataaaccactacctaactgtggttgtatgttgtttccatcatactaactagatgaatggatgcgccagttttcatcttggtccttacacttgagaagttaaactgtggttcagtatttaaactgccagtgttatacgtctcatgctctgtgtgccaggtgaaggtactgtgtaaggaagacatttgcggtgcttcttgtcctataatgattcaagtatatagtagttcttgaaagagtgtgcatatattactcatctgcttaagagagtgggttaatggatatatcagaggagccaaatacatttttttcagaacttgaaaaccaaaggtcatcatgagtgcactcaaaagttaggacaagtttattacatttgggattttcatctgtagccgtatgaagaaccctttccaatataaaagcatggcattaaattaggctgaagtcttttattttttgtatatgtactatatagaaatactagcaagttaggatcatccaatatggcctaccccgaaatggcccctctgtttccctaaccacatggaagaaagaatctgaacgtctccaccggctctacccgagttccaaaactaaagggcttctccagacctgatggttccagtttacctgctgttggcctgctggatacttgactcaggcataaattaagtgccctggtcccgaactttctccctgtatttgacctccttccctctttcctaaattactagtctggaattaaaattagctccagcaatgacctttgactccattcattttctcctcatcttgggtcttaaaaaaggagaccagatacctcctagcttttgtatcacaaccaggaatgggtattaggcctcatgcgctttgctcagaacactgccgctttgttaacaaatgacagcatggaacccagagttttgattcgatgcaaaataacagcagtgcaaccaggattcttgttttccttttccttcttggagtttggaatttctagcttttcaagcagcataagtagaatcaacattaggatgttttcatgaaatagcatccttatacttctttgagcttgatgttagtggctagactgatttccctttgctctcaaaatacaaagtgcattgaagtatacagagaaatgcctgaatatggcaagcaaataatgtagattaacattctattattgtatccgttttacaaaaaataaaattttgatatatgccggagaacggcattagaatgcaataagttgtctaggtttttctgtttcagtgtctctcccaatggcacgaagggttattgggcattgtccccacccccgcctttttaacatgtgcactatctggattcctgtaaatggccttgcaaacagaagtggtgtgtattttcaagcacctttcccccattgtatccgaatccctcttgtgtgatatctgtgacaaatagccttcttcttgtgttttctgttggactaattgtctcacgtaaagctatagaccttactaatttggcaggtattcaaaactgccattaagataggatttcatgtcagatacgtatttaaagagtaaagtcaaatttgtttaatgtcagatcagtgacagaagtgaaaagaaagtaattgtgaaagtgatgtttgagctattgtacacatctagcatatggaaagcaaatgcactcgaaaactactattctagaacatgaggcttcttcagcaacttgtgcactctgccattaataaattaaatttttcccctctagaaagccttaactatggcggaaactttttaaccttttatattttaataaataaaacattgtagtcccatttcttagtgtttgaaaggtgtgtcagtgagtcggccatgtctccatgtgtttcagacctgttcatcttattttatgatggtatatttcataagtaatattcccttacatgcaatggagctgattaaaattaatccatttcaatttctccatattggaacttcctcagctaccagatttctggtttggagaagtgctggaaagatttcaaagcctattcagttgtgtatgtggggatacgacagcaactgtgataccttgtagaatatgagtgatatgcaagctgtgttttttaattgttttaaaatgtaaattatggttatgctaaagtgaaaacctagaggaagctaatgattttatatactttgcacgaccaaatatggtcgtagtatgacgagttttatacattgccagagagttctgcctcctctgaaataacattcgcactgtagattgcatttcggcttttcctcctttcacattcttttttgctttacacttcacgtcttcgcacctgccctacctcccatcctttcaaagaggtttctttcacgttccagaattcagattgttctgtgatttcttttacatcagtctacccatttctgcaggcagccctgaaagcccttgtgttgattcagagtgtttgcagagaaatgcagttgaaccctggtagtggggtgtccctcacacacccgcgcacccctcccaaagttcaggatgaaaggctagaaaacccattcaaagttaggaaagaacacagatctttgaggccgatagcctagacctagaagatgaccttgagtatgtaaacattgtctccgtgacacaaaacactgaaactcttcatgtgcatataacacctgcttctgctcccattgtttcaagctcatcttatctttgtagtagtaatgtttgtctttgatacctacaaactaaaaaggtacttttatcaaggtttctcaaaacatttacaaaaccagctttgagaaaatgttatgttgcctggcaacagcactcggagtagtaattgtgttttctcattgtgatgttggtctgtgtgagcaaccagtgtagtgactctttggttcattattcgtgttgtttttatttttagtctctgtgtgacccaacagtggcaggggttacaaccccctctcctttcttttttgtatttatctatttgtaggattgtcagatcaagtacaagatgcccagttaagtttgaatttcagagaaacaatttcacgttaagaatgtttcatgcaatatttggcatatatttacagtaaaagcattcattatttgtctgaaattcaaatttaactgagcatgctggtttttctcattgtttggtttttctaaatctggcaatcctacagctgtggtcatgggaaatcacctacagcatgttaaagtcctctagtcatcatctcgtcacctgaaatggaagtcctttttccctcaccctccacttctttccaaaggagggcatcaaggaacttaacctgcctgcctggtgggtttctatttaagacatctttgtgattatatttaacctgcaattgtgctttggcttaatgtctagctcactgtacttgtaaatgattaatattcaataaaaccatttttaaagta

SEQ ID NO: 26915 - DNA, 8840 bp, Homo sapiens
cacttactacagatgggtgctaatgtccacgctcgtgatgatggaggtctcatcccgcttcataatgcctgttcttttggccatgctgaggttgtgagtctgttattgtgccaaggagctgatccaaatgccagggataactggaactatacacctctgcatgaagctgctattaaagggaagatcgatgtgtgcattgtgctgctgcagcacggagctgacccaaacattcggaacactgatgggaaatcagccctggacctggcagatccttcagcaaaagctgtccttacaggtgaatacaagaaagacgaactcctagaagctgctaggagtggtaatgaagaaaaactaatggctttactgactcctctaaatgtgaattgccatgcaagtgatgggcgaaagtcgactcctttacatctagcagcgggctacaacagagttcgaatagttcagcttcttcttcagcatggtgctgatgttcatgcaaaagacaaaggtggacttgtgcctcttcataatgcatgttcatatggacattatgaagtcacagaactgctactaaagcatggagcttgtgttaatgccatggatctctggcagtttactccactgcacgaggctgcttccaagaaccgtgtagaagtctgctctttgttacttagccatggcgctgatcctacgttagtcaactgccatggcaaaagtgctgtggatatggctccaactccggagcttagggagagattgacttatgaatttaaaggtcattctttactacaagcagccagagaagcagacttagctaaagttaaaaaaacactcgctctggaaatcattaatttcaaacaaccgcagtctcatgaaacagcactgcactgtgctgtggcctctctgcatcccaaacgtaaacaagtgacagaattgttacttagaaaaggagcaaatgttaatgaaaaaaataaagatttcatgactcccctgcatgttgcagccgaaagagcccataatgatgtcatggaagttctgcataagcatggcgccaagatgaatgcactggacacccttggtcagactgctttgcatagagccgccctagcaggccacctgcagacctgccgcctcctgctgagttacggctctgacccctccatcatctccttacaaggcttcacagcagcacagatgggcaatgaagcagtgcagcagattctgagtgagagtacacctatacgtacttctgatgttgattatcgactcttagaggcatctaaagctggagacttggaaactgtgaagcaactttgcagctctcaaaatgtgaattgtagagacttagagggccggcattccacgcccttacacttcgcagcaggctacaaccgcgtgtctgttgtagagtacctgctacaccacggtgccgatgtccatgccaaagacaagggtggcttggtgccccttcataatgcctgttcatatggacactatgaggtggctgagcttttagtaaggcatggggcttctgtcaatgtggcggacttatggaaatttacccctctccatgaagcagcagctaaaggaaagtatgaaatctgcaagctccttttaaaacatggagcagatccaactaaaaagaacagagatggaaatacacctttggatttggtaaaggaaggagacacagatattcaggacttactgaaaggggatgctgctttgttggatgctgccaagaagggctgcctggcaagagtgcagaagctctgtaccccagagaatatcaactgcagagacacccagggcagaaattcaacccctctgcacctggcagcaggctataataacctggaagtagctgaatatcttctagagcatggagctgatgttaatgcccaggacaagggtggtttaattcctcttcataatgcggcatcttatgggcatgttgacatagcggctttattgataaaatacaacacgtgtgtaaatgcaacagataagtgggcgtttactcccctccatgaagcagcccagaaaggaaggacgcagctgtgcgccctcctcctagcgcatggtgcagaccccaccatgaagaaccaggaaggccagacgcctctggatctggcaacagctgacgatatcagagctttgctgatagatgccatgcccccagaggccttacctacctgttttaaacctcaggctactgtagtgagtgcctctctgatctcaccagcatccaccccctcctgcctctcggctgccagcagcatagacaacctcactggccctttagcagagttggccgtaggaggagcctccaatgcaggggatggcgccgcgggaacagaaaggaaggaaggagaagttgctggtcttgacatgaatatcagccaatttctaaaaagccttggccttgaacaccttcgggatatctttgaaacagaacagattacactagatgtgttggctgatatgggtcatgaagagttgaaagaaataggcatcaatgcatatgggcaccgccacaaattaatcaaaggagtagaaagactcttaggtggacaacaaggcaccaatccttatttgacttttcactgtgttaatcagggaacgattttgctggatcttgctccagaagataaagaatatcagtcagtggaagaagagatgcaaagtactattcgagaacacagagatggtggtaatgctggcggcatcttcaacagatacaatgtcattcgaattcaaaaagttgtcaacaagaagttgagggagcggttctgccaccgacagaaggaagtgtctgaggagaatcacaaccatcacaatgagcgcatgttgtttcatggttctcctttcattaatgccattattcataaagggtttgatgagcgacatgcatacataggaggaatgtttggggccgggatttattttgctgaaaactcctcaaaaagcaaccaatatgtttatggaattggaggaggaacaggctgccctacacacaaggacaggtcatgctatatatgtcacagacaaatgctcttctgtagagtgacccttgggaaatcctttctgcagtttagcaccatgaaaatggcccacgcgcctccagggcaccactcagtcattggtagaccgagcgtcaatgggctggcatatgctgaatatgtcatctacagaggagaacaggcatacccagagtatcttatcacttaccagatcatgaagccagaagccccttcccagaccgcaacagccgcagagcagaagacctagtgaatgcctgctggtgaaggccagatcagatttcaacctgggactggattacagaggattgtttctaataacaacatcaatattctagaagtccctgacagcctagaaataagctgtttgtcttctataaagcattgctatagtgatgaatagtatgagtaactgatacatactcaactgctactgttccctttgaggaaatgtttacaggggcggccttttaacatatctcaggctcattttcattgcaattatccatttctaaaacaagattgcttcgatctagacttggaaatggaaaataagaaaaccaatgctttttcaaatgttcacaattcacacactacatttgttttgttatgcatgacgtgtctataacaaatatacacatacgacaggcaacaagcttgtttttgatttgccagacatgcatcattggctattgtttgtttgttttttgtttttttgtgttttttgggttactttgaaaatgagccagagccttcttgaggatattttgcacaaagtcacgctgacaaaatcattagcagtgcaacccaagcttctggctgagcaagattcagtttccactttttaaaatttttttattttgctctgtagctgcacttctcgttatcataaattgagatgaaaaggaaaaaacatcaagttttagtacctttttatgaattggcctatcttacaagagaagggcacaaacaccaacctgacttaggaacgcctaaattcagagaagtcaaagccggtgaaggccacttgctctttccaacacaagcctgccacagaggtcttcgggacagtactggagatgcaggttgacacgggcttgagttccaaggtgaaaaaactggggaggctgtgaaggaagagctgcattaaggagggtgaggagcgtgtggttctgtatcatggcagccccaatggatccaggggatgcctccaaaaaatacatgcttcccttcccttaatctgtactgttgggattgttacccctccaaattagctgccttatttcaaaagtcagtgaaattactgcacttgatgagggtcacaaaaataccacttgattgtttctttagttgagaatgctgggattcagactcgaatagtggatagatacacacaaatgcaaggacttttttgtttactccagatttggggtttattttgagtggcatgcttcaaatagttcataaagatccttgcattaaatttctgaaccatttcttcaaacttcttagtgtgtttagacaaggagaacaaaaattgaaaccaaagccctttctgttattttttcaatgaaggtgagaaagaaataccatacaattttctttgtgaaattactgtttattttcatcaacatttaccaagtgccattgacatttataaaaaaaatgatcctttatagttcttacacttgcccttttcaccttaactgaatatgaattgagtgcactaacttatttacttgatatactgtgcatctactctgctttgaagcgaaagaaatataaacacgaggaggaataggaaagacagtgtgacacaaacttgccattgcaattcaaagccctgaaaacgatgggtttaatgcaaggtgattaagctgtgacctcctttaatctcctgaagcaaaataaaatggttacatgcaaaacttctagaaatagactcttaaaatatatacattttgctttgattttggcttcaacccagtgctggaactaggcatccagactagtttgaatgtttgtagctgaatttttatgggtcctcaaaattaaatcgagaattagcctcagttgttgcttcttttgaagtttcagtgacccaagctgggtgtttgtgtcttggctacttgtttaatagcactagaattccaggtgaagctttgagagttgatattcattaagagggctttttttccccttctttccttctcttttgctgtaacaaagggttgaagaaattgccatctgtgtagttttcagtagctgtcaagtgtgtcttacttaccttcccccagacgtagtttaaaatggtaaacacagctgtgatttttagttaagtaaaagagttaatatgatatagatatggaaagctttatggcttcattaaaaagataaaccactacctaactgtggttgtatgttgtttccatcatactaactagatgaatggatgcgccagttttcatcttggtccttacacttgagaagttaaactgtggttcagtatttaaactgccagtgttatacgtctcatgctctgtgtgccaggtgaaggtactgtgtaaggaagacatttgcggtgcttcttgtcctataatgattcaagtatatagtagttcttgaaagagtgtgcatatattactcatctgcttaagagagtgggttaatggatatatcagaggagccaaatacatttttttcagaacttgaaaaccaaaggtcatcatgagtgcactcaaaagttaggacaagtttattacatttgggattttcatctgtagccgtatgaagaaccctttccaatataaaagcatggcattaaattaggctgaagtcttttattttttgtatatgtactatatagaaatactagcaagttaggatcatccaatatggcctaccccgaaatggcccctctgtttccctaaccacatggaagaaagaatctgaacgtctccaccggctctacccgagttccaaaactaaagggcttctccagacctgatggttccagtttacctgctgttggcctgctggatacttgactcaggcataaattaagtgccctggtcccgaactttctccctgtatttgacctccttccctctttcctaaattactagtctggaattaaaattagctccagcaatgacctttgactccattcattttctcctcatcttgggtcttaaaaaaggagaccagatacctcctagcttttgtatcacaaccaggaatgggtattaggcctcatgcgctttgctcagaacactgccgctttgttaacaaatgacagcatggaacccagagttttgattcgatgcaaaataacagcagtgcaaccaggattcttgttttccttttccttcttggagtttggaatttctagcttttcaagcagcataagtagaatcaacattaggatgttttcatgaaatagcatccttatacttctttgagcttgatgttagtggctagactgatttccctttgctctcaaaatacaaagtgcattgaagtatacagagaaatgcctgaatatggcaagcaaataatgtagattaacattctattattgtatccgttttacaaaaaataaaattttgatatatgccggagaacggcattagaatgcaataagttgtctaggtttttctgtttcagtgtctctcccaatggcacgaagggttattgggcattgtccccacccccgcctttttaacatgtgcactatctggattcctgtaaatggccttgcaaacagaagtggtgtgtattttcaagcacctttcccccattgtatccgaatccctcttgtgtgatatctgtgacaaatagccttcttcttgtgttttctgttggactaattgtctcacgtaaagctatagaccttactaatttggcaggtattcaaaactgccattaagataggatttcatgtcagatacgtatttaaagagtaaagtcaaatttgtttaatgtcagatcagtgacagaagtgaaaagaaagtaattgtgaaagtgatgtttgagctattgtacacatctagcatatggaaagcaaatgcactcgaaaactactattctagaacatgaggcttcttcagcaacttgtgcactctgccattaataaattaaatttttcccctctagaaagccttaactatggcggaaactttttaaccttttatattttaataaataaaacattgtagtcccatttcttagtgtttgaaaggtgtgtcagtgagtcggccatgtctccatgtgtttcagacctgttcatcttattttatgatggtatatttcataagtaatattcccttacatgcaatggagctgattaaaattaatccatttcaatttctccatattggaacttcctcagctaccagatttctggtttggagaagtgctggaaagatttcaaagcctattcagttgtgtatgtggggatacgacagcaactgtgataccttgtagaatatgagtgatatgcaagctgtgttttttaattgttttaaaatgtaaattatggttatgctaaagtgaaaacctagaggaagctaatgattttatatactttgcacgaccaaatatggtcgtagtatgacgagttttatacattgccagagagttctgcctcctctgaaataacattcgcactgtagattgcatttcggcttttcctcctttcacattcttttttgctttacacttcacgtcttcgcacctgccctacctcccatcctttcaaagaggtttctttcacgttccagaattcagattgttctgtgatttcttttacatcagtctacccatttctgcaggcagccctgaaagcccttgtgttgattcagagtgtttgcagagaaatgcagttgaaccctggtagtggggtgtccctcacacacccgcgcacccctcccaaagttcaggatgaaaggctagaaaacccattcaaagttaggaaagaacacagatctttgaggccgatagcctagacctagaagatgaccttgagtatgtaaacattgtctccgtgacacaaaacactgaaactcttcatgtgcatataacacctgcttctgctcccattgtttcaagctcatcttatctttgtagtagtaatgtttgtctttgatacctacaaactaaaaaggtacttttatcaaggtttctcaaaacatttacaaaaccagctttgagtgtgatgttggtctgtgtgagcaaccagtgtagtgactctttggttcattattcgtgttgtttttatttttagtctctgtgtgacccaacagtggcaggggttacaaccccctctcctttcttttttgtatttatctatttgtaggattgtcagatcaagtacaagatgcccagttaagtttgaatttcagagaaacaatttcacgttaagaatgtttcatgcaatatttggcatatatttacagtaaaagcattcattatttgtctgaaattcaaatttaactgagcatgctggtttttctcattgtttggtttttctaaatctggcaatcctacagctgtggtcatgggaaatcacctacagcatgttaaagtcctctagtcatcatctcgtcacctgaaatggaagtcctttttccctcaccctccacttctttccaaaggagggcatcaaggaacttaacctgcctgcctggtgggtttctatttaagacatctttgtgattatatttaacctgcaattgtgctttggcttaatgtctagctcactgtacttgtaaatgattaatattcaataaaaccatttttaaagta

SEQ ID NO: 26916 - DNA, 8841 bp, Homo sapiens
cacttactacagatgggtgctaatgtccacgctcgtgatgatggaggtctcatcccgcttcataatgcctgttcttttggccatgctgaggttgtgagtctgttattgtgccaaggagctgatccaaatgccagggataactggaactatacacctctgcatgaagctgctattaaagggaagatcgatgtgtgcattgtgctgctgcagcacggagctgacccaaacattcggaacactgatgggaaatcagccctggacctggcagatccttcagcaaaagctgtccttacaggtgaatacaagaaagacgaactcctagaagctgctaggagtggtaatgaagaaaaactaatggctttactgactcctctaaatgtgaattgccatgcaagtgatgggcgaaagtcgactcctttacatctagcagcgggctacaacagagttcgaatagttcagcttcttcttcagcatggtgctgatgttcatgcaaaagacaaaggtggacttgtgcctcttcataatgcatgttcatatggacattatgaagtcacagaactgctactaaagcatggagcttgtgttaatgccatggatctctggcagtttactccactgcacgaggctgcttccaagaaccgtgtagaagtctgctctttgttacttagccatggcgctgatcctacgttagtcaactgccatggcaaaagtgctgtggatatggctccaactccggagcttagggagagattgacttatgaatttaaaggtcattctttactacaagcagccagagaagcagacttagctaaagttaaaaaaacactcgctctggaaatcattaatttcaaacaaccgcagtctcatgaaacagcactgcactgtgctgtggcctctctgcatcccaaacgtaaacaagtgacagaattgttacttagaaaaggagcaaatgttaatgaaaaaaataaagatttcatgactcccctgcatgttgcagccgaaagagcccataatgatgtcatggaagttctgcataagcatggcgccaagatgaatgcactggacacccttggtcagactgctttgcatagagccgccctagcaggccacctgcagacctgccgcctcctgctgagttacggctctgacccctccatcatctccttacaaggcttcacagcagcacagatgggcaatgaagcagtgcagcagattctgagtgagagtacacctatacgtacttctgatgttgattatcgactcttagaggcatctaaagctggagacttggaaactgtgaagcaactttgcagctctcaaaatgtgaattgtagagacttagagggccggcattccacgcccttacacttcgcagcaggctacaaccgcgtgtctgttgtagagtacctgctacaccacggtgccgatgtccatgccaaagacaagggtggcttggtgccccttcataatgcctgttcatatggacactatgaggtggctgagcttttagtaaggcatggggcttctgtcaatgtggcggacttatggaaatttacccctctccatgaagcagcagctaaaggaaagtatgaaatctgcaagctccttttaaaacatggagcagatccaactaaaaagaacagagatggaaatacacctttggatttggtaaaggaaggagacacagatattcaggacttactgaaaggggatgctgctttgttggatgctgccaagaagggctgcctggcaagagtgcagaagctctgtaccccagagaatatcaactgcagagacacccagggcagaaattcaacccctctgcacctggcagcaggctataataacctggaagtagctgaatatcttctagagcatggagctgatgttaatgcccaggacaagggtggtttaattcctcttcataatgcggcatcttatgggcatgttgacatagcggctttattgataaaatacaacacgtgtgtaaatgcaacagataagtgggcgtttactcccctccatgaagcagcccagaaaggaaggacgcagctgtgcgccctcctcctagcgcatggtgcagaccccaccatgaagaaccaggaaggccagacgcctctggatctggcaacagctgacgatatcagagctttgctgatagatgccatgcccccagaggccttacctacctgttttaaacctcaggctactgtagtgagtgcctctctgatctcaccagcatccaccccctcctgcctctcggctgccagcagcatagacaacctcactggccctttagcagagttggccgtaggaggagcctccaatgcaggggatggcgccgcgggaacagaaaggaaggaaggagaagttgctggtcttgacatgaatatcagccaatttctaaaaagccttggccttgaacaccttcgggatatctttgaaacagaacagattacactagatgtgttggctgatatgggtcatgaagagttgaaagaaataggcatcaatgcatatgggcaccgccacaaattaatcaaaggagtagaaagactcttaggtggacaacaaggcaccaatccttatttgacttttcactgtgttaatcagggaacgattttgctggatcttgctccagaagataaagaatatcagtcagtggaagaagagatgcaaagtactattcgagaacacagagatggtggtaatgctggcggcatcttcaacagatacaatgtcattcgaattcaaaaagttgtcaacaagaagttgagggagcggttctgccaccgacagaaggaagtgtctgaggagaatcacaaccatcacaatgagcgcatgttgtttcatggttctcctttcattaatgccattattcataaagggtttgatgagcgacatgcatacataggaggaatgtttggggccgggatttattttgctgaaaactcctcaaaaagcaaccaatatgtttatggaattggaggaggaacaggctgccctacacacaaggacaggtcatgctatatatgtcacagacaaatgctcttctgtagagtgacccttgggaaatcctttctgcagtttagcaccatgaaaatggcccacgcgcctccagggcaccactcagtcattggtagaccgagcgtcaatgggctggcatatgctgaatatgtcatctacagaggagaacaggcatacccagagtatcttatcacttaccagatcatgaagccagaagccccttcccagaccgcaacagccgcagagcagaagacctagtgaatgcctgctggtgaaggccagatcagatttcaacctgggactggattacagaggattgtttctaataacaacatcaatattctagaagtccctgacagcctagaaataagctgtttgtcttctataaagcattgctatagtgatgaatagtatgagtaactgatacatactcaactgctactgttccctttgaggaaatgtttacaggggcggccttttaacatatctcaggctcattttcattgcaattatccatttctaaaacaagattgcttcgatctagacttggaaatggaaaataagaaaaccaatgctttttcaaatgttcacaattcacacactacatttgttttgttatgcatgacgtgtctataacaaatatacacatacgacaggcaacaagcttgtttttgatttgccagacatgcatcattggctattgtttgtttgttttttgtttttttgtgttttttgggttactttgaaaatgagccagagccttcttgaggatattttgcacaaagtcacgctgacaaaatcattagcagtgcaacccaagcttctggctgagcaagattcagtttccactttttaaaatttttttattttgctctgtagctgcacttctcgttatcataaattgagatgaaaaggaaaaaacatcaagttttagtacctttttatgaattggcctatcttacaagagaagggcacaaacaccaacctgacttaggaacgcctaaattcagagaagtcaaagccggtgaaggccacttgctctttccaacacaagcctgccacagaggtcttcgggacagtactggagatgcaggttgacacgggcttgagttccaaggtgaaaaaactggggaggctgtgaaggaagagctgcattaaggagggtgaggagcgtgtggttctgtatcatggcagccccaatggatccaggggatgcctccaaaaaatacatgcttcccttcccttaatctgtactgttgggattgttacccctccaaattagctgccttatttcaaaagtcagtgaaattactgcacttgatgagggtcacaaaaataccacttgattgtttctttagttgagaatgctgggattcagactcgaatagtggatagatacacacaaatgcaaggacttttttgtttactccagatttggggtttattttgagtggcatgcttcaaatagttcataaagatccttgcattaaatttctgaaccatttcttcaaacttcttagtgtgtttagacaaggagaacaaaaattgaaaccaaagccctttctgttattttttcaatgaaggtgagaaagaaataccatacaattttctttgtgaaattactgtttattttcatcaacatttaccaagtgccattgacatttataaaaaaaatgatcctttatagttcttacacttgcccttttcaccttaactgaatatgaattgagtgcactaacttatttacttgatatactgtgcatctactctgctttgaagcgaaagaaatataaacacgaggaggaataggaaagacagtgtgacacaaacttgccattgcaattcaaagccctgaaaacgatgggtttaatgcaaggtgattaagctgtgacctcctttaatctcctgaagcaaaataaaatggttacatgcaaaacttctagaaatagactcttaaaatatatacattttgctttgattttggcttcaacccagtgctggaactaggcatccagactagtttgaatgtttgtagctgaatttttatgggtcctcaaaattaaatcgagaattagcctcagttgttgcttcttttgaagtttcagtgacccaagctgggtgtttgtgtcttggctacttgtttaatagcactagaattccaggtgaagctttgagagttgatattcattaagagggctttttttccccttctttccttctcttttgctgtaacaaagggttgaagaaattgccatctgtgtagttttcagtagctgtcaagtgtgtcttacttaccttcccccagacgtagtttaaaatggtaaacacagctgtgatttttagttaagtaaaagagttaatatgatatagatatggaaagctttatggcttcattaaaaagataaaccactacctaactgtggttgtatgttgtttccatcatactaactagatgaatggatgcgccagttttcatcttggtccttacacttgagaagttaaactgtggttcagtatttaaactgccagtgttatacgtctcatgctctgtgtgccaggtgaaggtactgtgtaaggaagacatttgcggtgcttcttgtcctataatgattcaagtatatagtagttcttgaaagagtgtgcatatattactcatctgcttaagagagtgggttaatggatatatcagaggagccaaatacatttttttcagaacttgaaaaccaaaggtcatcatgagtgcactcaaaagttaggacaagtttattacatttgggattttcatctgtagccgtatgaagaaccctttccaatataaaagcatggcattaaattaggctgaagtcttttattttttgtatatgtactatatagaaatactagcaagttaggatcatccaatatggcctaccccgaaatggcccctctgtttccctaaccacatggaagaaagaatctgaacgtctccaccggctctacccgagttccaaaactaaagggcttctccagacctgatggttccagtttacctgctgttggcctgctggatacttgactcaggcataaattaagtgccctggtcccgaactttctccctgtatttgacctccttccctctttcctaaattactagtctggaattaaaattagctccagcaatgacctttgactccattcattttctcctcatcttgggtcttaaaaaaggagaccagatacctcctagcttttgtatcacaaccaggaatgggtattaggcctcatgcgctttgctcagaacactgccgctttgttaacaaatgacagcatggaacccagagttttgattcgatgcaaaataacagcagtgcaaccaggattcttgttttccttttccttcttggagtttggaatttctagcttttcaagcagcataagtagaatcaacattaggatgttttcatgaaatagcatccttatacttctttgagcttgatgttagtggctagactgatttccctttgctctcaaaatacaaagtgcattgaagtatacagagaaatgcctgaatatggcaagcaaataatgtagattaacattctattattgtatccgttttacaaaaaataaaattttgatatatgccggagaacggcattagaatgcaataagttgtctaggtttttctgtttcagtgtctctcccaatggcacgaagggttattgggcattgtccccacccccgcctttttaacatgtgcactatctggattcctgtaaatggccttgcaaacagaagtggtgtgtattttcaagcacctttcccccattgtatccgaatccctcttgtgtgatatctgtgacaaatagccttcttcttgtgttttctgttggactaattgtctcacgtaaagctatagaccttactaatttggcaggtattcaaaactgccattaagataggatttcatgtcagatacgtatttaaagagtaaagtcaaatttgtttaatgtcagatcagtgacagaagtgaaaagaaagtaattgtgaaagtgatgtttgagctattgtacacatctagcatatggaaagcaaatgcactcgaaaactactattctagaacatgaggcttcttcagcaacttgtgcactctgccattaataaattaaatttttcccctctagaaagccttaactatggcggaaactttttaaccttttatattttaataaataaaacattgtagtcccatttcttagtgtttgaaaggtgtgtcagtgagtcggccatgtctccatgtgtttcagacctgttcatcttattttatgatggtatatttcataagtaatattcccttacatgcaatggagctgattaaaattaatccatttcaatttctccatattggaacttcctcagctaccagatttctggtttggagaagtgctggaaagatttcaaagcctattcagttgtgtatgtggggatacgacagcaactgtgataccttgtagaatatgagtgatatgcaagctgtgttttttaattgttttaaaatgtaaattatggttatgctaaagtcgtagtatgacgagttttatacattgccagagagttctgcctcctctgaaataacattcgcactgtagattgcatttcggcttttcctcctttcacattcttttttgctttacacttcacgtcttcgcacctgccctacctcccatcctttcaaagaggtttctttcacgttccagaattcagattgttctgtgatttcttttacatcagtctacccatttctgcaggcagccctgaaagcccttgtgttgattcagagtgtttgcagagaaatgcagttgaaccctggtagtggggtgtccctcacacacccgcgcacccctcccaaagttcaggatgaaaggctagaaaacccattcaaagttaggaaagaacacagatctttgaggccgatagcctagacctagaagatgaccttgagtatgtaaacattgtctccgtgacacaaaacactgaaactcttcatgtgcatataacacctgcttctgctcccattgtttcaagctcatcttatctttgtagtagtaatgtttgtctttgatacctacaaactaaaaaggtacttttatcaaggtttctcaaaacatttacaaaaccagctttgagaaaatgttatgttgcctggcaacagcactcggagtagtaattgtgttttctcattgtgatgttggtctgtgtgagcaaccagtgtagtgactctttggttcattattcgtgttgtttttatttttagtctctgtgtgacccaacagtggcaggggttacaaccccctctcctttcttttttgtatttatctatttgtaggattgtcagatcaagtacaagatgcccagttaagtttgaatttcagagaaacaatttcacgttaagaatgtttcatgcaatatttggcatatatttacagtaaaagcattcattatttgtctgaaattcaaatttaactgagcatgctggtttttctcattgtttggtttttctaaatctggcaatcctacagctgtggtcatgggaaatcacctacagcatgttaaagtcctctagtcatcatctcgtcacctgaaatggaagtcctttttccctcaccctccacttctttccaaaggagggcatcaaggaacttaacctgcctgcctggtgggtttctatttaagacatctttgtgattatatttaacctgcaattgtgctttggcttaatgtctagctcactgtacttgtaaatgattaatattcaataaaaccatttttaaagta

SEQ ID NO: 26917 - DNA, 9121 bp, Homo sapiens
cacttactacagatgggtgctaatgtccacgctcgtgatgatggaggtctcatcccgcttcataatgcctgttcttttggccatgctgaggttgtgagtctgttattgtgccaaggagctgatccaaatgccagggataactggaactatacacctctgcatgaagctgctattaaagggaagatcgatgtgtgcattgtgctgctgcagcacggagctgacccaaacattcggaacactgatgggaaatcagccctggacctggcagatccttcagcaaaagctgtccttacaggtgaatacaagaaagacgaactcctagaagctgctaggagtggtaatgaagaaaaactaatggctttactgactcctctaaatgtgaattgccatgcaagtgatgggcgaaagtcgactcctttacatctagcagcgggctacaacagagttcgaatagttcagcttcttcttcagcatggtgctgatgttcatgcaaaagacaaaggtggacttgtgcctcttcataatgcatgttcatatggacattatgaagtcacagaactgctactaaagcatggagcttgtgttaatgccatggatctctggcagtttactccactgcacgaggctgcttccaagaaccgtgtagaagtctgctctttgttacttagccatggcgctgatcctacgttagtcaactgccatggcaaaagtgctgtggatatggctccaactccggagcttagggagagattgacttatgaatttaaaggtcattctttactacaagcagccagagaagcagacttagctaaagttaaaaaaacactcgctctggaaatcattaatttcaaacaaccgcagtctcatgaaacagcactgcactgtgctgtggcctctctgcatcccaaacgtaaacaagtgacagaattgttacttagaaaaggagcaaatgttaatgaaaaaaataaagatttcatgactcccctgcatgttgcagccgaaagagcccataatgatgtcatggaagttctgcataagcatggcgccaagatgaatgcactggacacccttggtcagactgctttgcatagagccgccctagcaggccacctgcagacctgccgcctcctgctgagttacggctctgacccctccatcatctccttacaaggcttcacagcagcacagatgggcaatgaagcagtgcagcagattctgagtgagagtacacctatacgtacttctgatgttgattatcgactcttagaggcatctaaagctggagacttggaaactgtgaagcaactttgcagctctcaaaatgtgaattgtagagacttagagggccggcattccacgcccttacacttcgcagcaggctacaaccgcgtgtctgttgtagagtacctgctacaccacggtgccgatgtccatgccaaagacaagggtggcttggtgccccttcataatgcctgttcatatggacactatgaggtggctgagcttttagtaaggcatggggcttctgtcaatgtggcggacttatggaaatttacccctctccatgaagcagcagctaaaggaaagtatgaaatctgcaagctccttttaaaacatggagcagatccaactaaaaagaacagagatggaaatacacctttggatttggtaaaggaaggagacacagatattcaggacttactgaaaggggatgctgctttgttggatgctgccaagaagggctgcctggcaagagtgcagaagctctgtaccccagagaatatcaactgcagagacacccagggcagaaattcaacccctctgcacctggcagcaggctataataacctggaagtagctgaatatcttctagagcatggagctgatgttaatgcccaggacaagggtggtttaattcctcttcataatgcggcatcttatgggcatgttgacatagcggctttattgataaaatacaacacgtgtgtaaatgcaacagataagtgggcgtttactcccctccatgaagcagcccagaaaggaaggacgcagctgtgcgccctcctcctagcgcatggtgcagaccccaccatgaagaaccaggaaggccagacgcctctggatctggcaacagctgacgatatcagagctttgctgatagatgccatgcccccagaggccttacctacctgttttaaacctcaggctactgtagtgagtgcctctctgatctcaccagcatccaccccctcctgcctctcggctgccagcagcatagacaacctcactggccctttagcagagttggccgtaggaggagcctccaatgcaggggatggcgccgcgggaacagaaaggaaggaaggagaagttgctggtcttgacatgaatatcagccaatttctaaaaagccttggccttgaacaccttcgggatatctttgaaacagaacagattacactagatgtgttggctgatatgggtcatgaagagttgaaagaaataggcatcaatgcatatgggcaccgccacaaattaatcaaaggagtagaaagactcttaggtggacaacaaggcaccaatccttatttgacttttcactgtgttaatcagggaacgattttgctggatcttgctccagaagataaagaatatcagtcagtggaagaagagatgcaaagtactattcgagaacacagagatggtggtaatgctggcggcatcttcaacagatacaatgtcattcgaattcaaaaagttgtcaacaagaagttgagggagcggttctgccaccgacagaaggaagtgtctgaggagaatcacaaccatcacaatgagcgcatgttgtttcatggttctcctttcattaatgccattattcataaagggtttgatgagcgacatgcatacataggaggaatgtttggggccgggatttattttgctgaaaactcctcaaaaagcaaccaatatgtttatggaattggaggaggaacaggctgccctacacacaaggacaggtcatgctatatatgtcacagacaaatgctcttctgtagagtgacccttgggaaatcctttctgcagtttagcaccatgaaaatggcccacgcgcctccagggcaccactcagtcattggtagaccgagcgtcaatgggctggcatatgctgaatatgtcatctacagaggagaacaggcatacccagagtatcttatcacttaccagatcatgaagccagaagccccttcccagaccgcaacagccgcagagcagaagacctagtgaatgcctgctggtgaaggccagatcagatttcaacctgggactggattacagaggattgtttctaataacaacatcaatattctagaagtccctgacagcctagaaataagctgtttgtcttctataaagcattgctatagtgatgaatagtatgagtaactgatacatactcaactgctactgttccctttgaggaaatgtttacaggggcggccttttaacatatctcaggctcattttcattgcaattatccatttctaaaacaagattgcttcgatctagacttggaaatggaaaataagaaaaccaatgctttttcaaatgttcacaattcacacactacatttgttttgttatgcatgacgtgtctataacaaatatacacatacgacaggcaacaagcttgtttttgatttgccagacatgcatcattggctattgtttgtttgttttttgtttttttgtgttttttgggttactttgaaaatgagccagagccttcttgaggatattttgcacaaagtcacgctgacaaaatcattagcagtgcaacccaagcttctggctgagcaagattcagtttccactttttaaaatttttttattttgctctgtagctgcacttctcgttatcataaattgagatgaaaaggaaaaaacatcaagttttagtacctttttatgaattggcctatcttacaagagaagggcacaaacaccaacctgacttaggaacgcctaaattcagagaagtcaaagccggtgaaggccacttgctctttccaacacaagcctgccacagaggtcttcgggacagtactggagatgcaggttgacacgggcttgagttccaaggtgaaaaaactggggaggctgtgaaggaagagctgcattaaggagggtgaggagcgtgtggttctgtatcatggcagccccaatggatccaggggatgcctccaaaaaatacatgcttcccttcccttaatctgtactgttgggattgttacccctccaaattagctgccttatttcaaaagtcagtgaaattactgcacttgatgagggtcacaaaaataccacttgattgtttctttagttgagaatgctgggattcagactcgaatagtggatagatacacacaaatgcaaggacttttttgtttactccagatttggggtttattttgagtggcatgcttcaaatagttcataaagatccttgcattaaatttctgaaccatttcttcaaacttcttagtgtgtttagacaaggagaacaaaaattgaaaccaaagccctttctgttattttttcaatgaaggtgagaaagaaataccatacaattttctttgtgaaattactgtttattttcatcaacatttaccaagtgccattgacatttataaaaaaaatgatcctttatagttcttacacttgcccttttcaccttaactgaatatgaattgagtgcactaacttatttacttgatatactgtgcatctactctgctttgaagcgaaagaaatataaacacgaggaggaataggaaagacagtgtgacacaaacttgccattgcaattcaaagccctgaaaacgatgggtttaatgcaaggtgattaagctgtgacctcctttaatctcctgaagcaaaataaaatggttacatgcaaaacttctagaaatagactcttaaaatatatacattttgctttgattttggcttcaacccagtgctggaactaggcatccagactagtttgaatgtttgtagctgaatttttatgggtcctcaaaattaaatcgagaattagcctcagttgttgcttcttttgaagtttcagtgacccaagctgggtgtttgtgtcttggctacttgtttaatagcactagaattccaggtgaagctttgagagttgatattcattaagagggctttttttccccttctttccttctcttttgctgtaacaaagggttgaagaaattgccatctgtgtagttttcagtagctgtcaagtgtgtcttacttaccttcccccagacgtagtttaaaatggtaaacacagctgtgatttttagttaagtaaaagagttaatatgatatagatatggaaagctttatggcttcattaaaaagataaaccactacctaactgtggttgtatgttgtttccatcatactaactagatgaatggatgcgccagttttcatcttggtccttacacttgagaagttaaactgtggttcagtatttaaactgccagtgttatacgtctcatgctctgtgtgccaggtgaaggtactgtgtaaggaagacatttgcggtgcttcttgtcctataatgattcaagtatatagtagttcttgaaagagtgtgcatatattactcatctgcttaagagagtgggttaatggatatatcagaggagccaaatacatttttttcagaacttgaaaaccaaaggtcatcatgagtgcactcaaaagttaggacaagtttattacatttgggattttcatctgtagccgtatgaagaaccctttccaatataaaagcatggcattaaattaggctgaagtcttttattttttgtatatgtactatatagaaatactagcaagttaggatcatccaatatggcctaccccgaaatggcccctctgtttccctaaccacatggaagaaagaatctgaacgtctccaccggctctacccgagttccaaaactaaagggcttctccagacctgatggttccagtttacctgctgttggcctgctggatacttgactcaggcataaattaagtgccctggtcccgaactttctccctgtatttgacctccttccctctttcctaaattactagtctggaattaaaattagctccagcaatgacctttgactccattcattttctcctcatcttgggtcttaaaaaaggagaccagatacctcctagcttttgtatcacaaccaggaatgggtattaggcctcatgcgctttgctcagaacactgccgctttgttaacaaatgacagcatggaacccagagttttgattcgatgcaaaataacagcagtgcaaccaggattcttgttttccttttccttcttggagtttggaatttctagcttttcaagcagcataagtagaatcaacattaggatgttttcatgaaatagcatccttatacttctttgagcttgatgttagtggctagactgatttccctttgctctcaaaatacaaagtgcattgaagtatacagagaaatgcctgaatatggcaagcaaataatgtagattaacattctattattgtatccgttttacaaaaaataaaattttgatatatgccggagaacggcattagaatgcaataagttgtctaggtttttctgtttcagtgtctctcccaatggcacgaagggttattgggcattgtccccacccccgcctttttaacatgtgcactatctggattcctgtaaatggccttgcaaacagaagtggtgtgtattttcaagcacctttcccccattgtatccgaatccctcttgtgtgatatctgtgacaaatagccttcttcttgtgttttctgttggactaattgtctcacgtaaagctatagaccttactaatttggcaggtattcaaaactgccattaagataggatttcatgtcagatacgtatttaaagagtaaagtcaaatttgtttaatgtcagatcagtgacagaagtgaaaagaaagtaattgtgaaagtgatgtttgagctattgtacacatctagcatatggaaagcaaatgcactcgaaaactactattctagaacatgaggcttcttcagcaacttgtgcactctgccattaataaattaaatttttcccctctagaaagccttaactatggcggaaactttttaaccttttatattttaataaataaaacattgtagtcccatttcttagtgtttgaaaggtgtgtcagtgagtcggccatgtctccatgtgtttcagacctgttcatcttattttatgatggtatatttcataagtaatattcccttacatgcaatggagctgattaaaattaatccatttcaatttctccatattggaacttcctcagctaccagatttctggtttggagaagtgctggaaagatttcaaagcctattcagttgtgtatgtggggatacgacagcaactgtgataccttgtagaatatgagtgatatgcaagctgtgttttttaattgttttaaaatgtaaattatggttatgctaaagtgaaaacctagaggaagctaatgattttatatactttgcacgaccaaatatggtcgtagtatgacgagttttatacattgccagagagttctgcctcctctgaaataacattcgcactgtagattgcatttcggcttttcctcctttcacattcttttttgctttacacttcacgtcttcgcacctgccctacctcccatcctttcaaagaggtttctttcacgttccagaattcagattgttctgtgatttcttttacatcagtctacccatttctgcaggcagccctgaaagcccttgtgttgattcagagtgtttgcagagaaatgcagttgaaccctggtagtggggtgtccctcacacacccgcgcacccctcccaaagttcaggatgaaaggctagaaaacccattcaaagttaggaaagaacacagatctttgaggccgatagcctagacctagaagatgaccttgagtatgtaaacattgtctccgtgacacaaaacactgaaactcttcatgtgcatataacacctgcttctgctcccattgtttcaagctcatcttatctttgtagtagtaatgtttgtctttgatacctacaaactaaaaaggtacttttatcaaggtttctcaaaacatttacaaaaccagctttgagaaaatgttatgttgcctggcaacagcactcggagtagtaattgtgttttctcattgtgatgttggtctgtgtgagcaaccagtgtagtgactctttggttcattattcgtgttgtttttatttttagtctctgtgtgacccaacagtggcaggggttacaaccccctctcctttcttttttgtatttatctatttgtaggattgtcagatcaagtacaagatgcccagttaagtttgaatttcagagaaacaatttcacgttaagaatgtttcatgcaatatttggcatatatttacagtaaaagcattcattatttgtctgaaattcaaatttaactgagcatgctggtttttctcattgtttggtttttctaaatctggcaatcctacagctgtggtcatgggaaatcacctacagcatgttaaagtcctctagtcatcatctcgtcacctgaaatggaagtcctttttccctcaccctccacttctttccaaaggagggcatcaaggaacttaacctgcctgcctggtgggtttctatttaagacatctttgtgattatatttaacctgcaattgtgctttggcttaatgtctagctcactgtacttgtaaatgattaatattcaataaaaccatttttaaagtaacaaaaaaaattaacataaaaacaaccaaaaactttgttgcgcggccctggcccatgaaaaagcttttaaacaccatctcggtgggccgcggcccagacgttaaggaacggccactagggtcccagaaacccggccggaatagtggtggtgtccccaataaaaagcggggcacggcggtctgaacatcaagggctgaggcaaggctctaaggggcaggacgataatg

SEQ ID NO: 26918 - DNA, 9143 bp, Homo sapiens
cacttactacagatgggtgctaatgtccacgctcgtgatgatggaggtctcatcccgcttcataatgcctgttcttttggccatgctgaggttgtgagtctgttattgtgccaaggagctgatccaaatgccagggataactggaactatacacctctgcatgaagctgctattaaagggaagatcgatgtgtgcattgtgctgctgcagcacggagctgacccaaacattcggaacactgatgggaaatcagccctggacctggcagatccttcagcaaaagctgtccttacaggtgaatacaagaaagacgaactcctagaagctgctaggagtggtaatgaagaaaaactaatggctttactgactcctctaaatgtgaattgccatgcaagtgatgggcgaaagtcgactcctttacatctagcagcgggctacaacagagttcgaatagttcagcttcttcttcagcatggtgctgatgttcatgcaaaagacaaaggtggacttgtgcctcttcataatgcatgttcatatggacattatgaagtcacagaactgctactaaagcatggagcttgtgttaatgccatggatctctggcagtttactccactgcacgaggctgcttccaagaaccgtgtagaagtctgctctttgttacttagccatggcgctgatcctacgttagtcaactgccatggcaaaagtgctgtggatatggctccaactccggagcttagggagagattgacttatgaatttaaaggtcattctttactacaagcagccagagaagcagacttagctaaagttaaaaaaacactcgctctggaaatcattaatttcaaacaaccgcagtctcatgaaacagcactgcactgtgctgtggcctctctgcatcccaaacgtaaacaagtgacagaattgttacttagaaaaggagcaaatgttaatgaaaaaaataaagatttcatgactcccctgcatgttgcagccgaaagagcccataatgatgtcatggaagttctgcataagcatggcgccaagatgaatgcactggacacccttggtcagactgctttgcatagagccgccctagcaggccacctgcagacctgccgcctcctgctgagttacggctctgacccctccatcatctccttacaaggcttcacagcagcacagatgggcaatgaagcagtgcagcagattctgagtgagagtacacctatacgtacttctgatgttgattatcgactcttagaggcatctaaagctggagacttggaaactgtgaagcaactttgcagctctcaaaatgtgaattgtagagacttagagggccggcattccacgcccttacacttcgcagcaggctacaaccgcgtgtctgttgtagagtacctgctacaccacggtgccgatgtccatgccaaagacaagggtggcttggtgccccttcataatgcctgttcatatggacactatgaggtggctgagcttttagtaaggcatggggcttctgtcaatgtggcggacttatggaaatttacccctctccatgaagcagcagctaaaggaaagtatgaaatctgcaagctccttttaaaacatggagcagatccaactaaaaagaacagagatggaaatacacctttggatttggtaaaggaaggagacacagatattcaggacttactgaaaggggatgctgctttgttggatgctgccaagaagggctgcctggcaagagtgcagaagctctgtaccccagagaatatcaactgcagagacacccagggcagaaattcaacccctctgcacctggcagcaggctataataacctggaagtagctgaatatcttctagagcatggagctgatgttaatgcccaggacaagggtggtttaattcctcttcataatgcggcatcttatgggcatgttgacatagcggctttattgataaaatacaacacgtgtgtaaatgcaacagataagtgggcgtttactcccctccatgaagcagcccagaaaggaaggacgcagctgtgcgccctcctcctagcgcatggtgcagaccccaccatgaagaaccaggaaggccagacgcctctggatctggcaacagctgacgatatcagagctttgctgatagatgccatgcccccagaggccttacctacctgttttaaacctcaggctactgtagtgagtgcctctctgatctcaccagcatccaccccctcctgcctctcggctgccagcagcatagacaacctcactggccctttagcagagttggccgtaggaggagcctccaatgcaggggatggcgccgcgggaacagaaaggaaggaaggagaagttgctggtcttgacatgaatatcagccaatttctaaaaagccttggccttgaacaccttcgggatatctttgaaacagaacagattacactagatgtgttggctgatatgggtcatgaagagttgaaagaaataggcatcaatgcatatgggcaccgccacaaattaatcaaaggagtagaaagactcttaggtggacaacaaggcaccaatccttatttgacttttcactgtgttaatcagggaacgattttgctggatcttgctccagaagataaagaatatcagtcagtggaagaagagatgcaaagtactattcgagaacacagagatggtggtaatgctggcggcatcttcaacagatacaatgtcattcgaattcaaaaagttgtcaacaagaagttgagggagcggttctgccaccgacagaaggaagtgtctgaggagaatcacaaccatcacaatgagcgcatgttgtttcatggttctcctttcattaatgccattattcataaagggtttgatgagcgacatgcatacataggaggaatgtttggggccgggatttattttgctgaaaactcctcaaaaagcaaccaatatgtttatggaattggaggaggaacaggctgccctacacacaaggacaggtcatgctatatatgtcacagacaaatgctcttctgtagagtgacccttgggaaatcctttctgcagtttagcaccatgaaaatggcccacgcgcctccagggcaccactcagtcattggtagaccgagcgtcaatgggctggcatatgctgaatatgtcatctacagaggagaacaggcatacccagagtatcttatcacttaccagatcatgaagccagaagccccttcccagaccgcaacagccgcagagcagaagacctagtgaatgcctgctggtgaaggccagatcagatttcaacctgggactggattacagaggattgtttctaataacaacatcaatattctagaagtccctgacagcctagaaataagctgtttgtcttctataaagcattgctatagtgatgaatagtatgagtaactgatacatactcaactgctactgttccctttgaggaaatgtttacaggggcggccttttaacatatctcaggctcattttcattgcaattatccatttctaaaacaagattgcttcgatctagacttggaaatggaaaataagaaaaccaatgctttttcaaatgttcacaattcacacactacatttgttttgttatgcatgacgtgtctataacaaatatacacatacgacaggcaacaagcttgtttttgatttgccagacatgcatcattggctattgtttgtttgttttttgtttttttgtgttttttgggttactttgaaaatgagccagagccttcttgaggatattttgcacaaagtcacgctgacaaaatcattagcagtgcaacccaagcttctggctgagcaagattcagtttccactttttaaaatttttttattttgctctgtagctgcacttctcgttatcataaattgagatgaaaaggaaaaaacatcaagttttagtacctttttatgaattggcctatcttacaagagaagggcacaaacaccaacctgacttaggaacgcctaaattcagagaagtcaaagccggtgaaggccacttgctctttccaacacaagcctgccacagaggtcttcgggacagtactggagatgcaggttgacacgggcttgagttccaaggtgaaaaaactggggaggctgtgaaggaagagctgcattaaggagggtgaggagcgtgtggttctgtatcatggcagccccaatggatccaggggatgcctccaaaaaatacatgcttcccttcccttaatctgtactgttgggattgttacccctccaaattagctgccttatttcaaaagtcagtgaaattactgcacttgatgagggtcacaaaaataccacttgattgtttctttagttgagaatgctgggattcagactcgaatagtggatagatacacacaaatgcaaggacttttttgtttactccagatttggggtttattttgagtggcatgcttcaaatagttcataaagatccttgcattaaatttctgaaccatttcttcaaacttcttagtgtgtttagacaaggagaacaaaaattgaaaccaaagccctttctgttattttttcaatgaaggtgagaaagaaataccatacaattttctttgtgaaattactgtttattttcatcaacatttaccaagtgccattgacatttataaaaaaaatgatcctttatagttcttacacttgcccttttcaccttaactgaatatgaattgagtgcactaacttatttacttgatatactgtgcatctactctgctttgaagcgaaagaaatataaacacgaggaggaataggaaagacagtgtgacacaaacttgccattgcaattcaaagccctgaaaacgatgggtttaatgcaaggtgattaagctgtgacctcctttaatctcctgaagcaaaataaaatggttacatgcaaaacttctagaaatagactcttaaaatatatacattttgctttgattttggcttcaacccagtgctggaactaggcatccagactagtttgaatgtttgtagctgaatttttatgggtcctcaaaattaaatcgagaattagcctcagttgttgcttcttttgaagtttcagtgacccaagctgggtgtttgtgtcttggctacttgtttaatagcactagaattccaggtgaagctttgagagttgatattcattaagagggctttttttccccttctttccttctcttttgctgtaacaaagggttgaagaaattgccatctgtgtagttttcagtagctgtcaagtgtgtcttacttaccttcccccagacgtagtttaaaatggtaaacacagctgtgatttttagttaagtaaaagagttaatatgatatagatatggaaagctttatggcttcattaaaaagataaaccactacctaactgtggttgtatgttgtttccatcatactaactagatgaatggatgcgccagttttcatcttggtccttacacttgagaagttaaactgtggttcagtatttaaactgccagtgttatacgtctcatgctctgtgtgccaggtgaaggtactgtgtaaggaagacatttgcggtgcttcttgtcctataatgattcaagtatatagtagttcttgaaagagtgtgcatatattactcatctgcttaagagagtgggttaatggatatatcagaggagccaaatacatttttttcagaacttgaaaaccaaaggtcatcatgagtgcactcaaaagttaggacaagtttattacatttgggattttcatctgtagccgtatgaagaaccctttccaatataaaagcatggcattaaattaggctgaagtcttttattttttgtatatgtactatatagaaatactagcaagttaggatcatccaatatggcctaccccgaaatggcccctctgtttccctaaccacatggaagaaagaatctgaacgtctccaccggctctacccgagttccaaaactaaagggcttctccagacctgatggttccagtttacctgctgttggcctgctggatacttgactcaggcataaattaagtgccctggtcccgaactttctccctgtatttgacctccttccctctttcctaaattactagtctggaattaaaattagctccagcaatgacctttgactccattcattttctcctcatcttgggtcttaaaaaaggagaccagatacctcctagcttttgtatcacaaccaggaatgggtattaggcctcatgcgctttgctcagaacactgccgctttgttaacaaatgacagcatggaacccagagttttgattcgatgcaaaataacagcagtgcaaccaggattcttgttttccttttccttcttggagtttggaatttctagcttttcaagcagcataagtagaatcaacattaggatgttttcatgaaatagcatccttatacttctttgagcttgatgttagtggctagactgatttccctttgctctcaaaatacaaagtgcattgaagtatacagagaaatgcctgaatatggcaagcaaataatgtagattaacattctattattgtatccgttttacaaaaaataaaattttgatatatgccggagaacggcattagaatgcaataagttgtctaggtttttctgtttcagtgtctctcccaatggcacgaagggttattgggcattgtccccacccccgcctttttaacatgtgcactatctggattcctgtaaatggccttgcaaacagaagtggtgtgtattttcaagcacctttcccccattgtatccgaatccctcttgtgtgatatctgtgacaaatagccttcttcttgtgttttctgttggactaattgtctcacgtaaagctatagaccttactaatttggcaggtattcaaaactgccattaagataggatttcatgtcagatacgtatttaaagagtaaagtcaaatttgtttaatgtcagatcagtgacagaagtgaaaagaaagtaattgtgaaagtgatgtttgagctattgtacacatctagcatatggaaagcaaatgcactcgaaaactactattctagaacatgaggcttcttcagcaacttgtgcactctgccattaataaattaaatttttcccctctagaaagccttaactatggcggaaactttttaaccttttatattttaataaataaaacattgtagtcccatttcttagtgtttgaaaggtgtgtcagtgagtcggccatgtctccatgtgtttcagacctgttcatcttattttatgatggtatatttcataagtaatattcccttacatgcaatggagctgattaaaattaatccatttcaatttctccatattggaacttcctcagctaccagatttctggtttggagaagtgctggaaagatttcaaagcctattcagttgtgtatgtggggatacgacagcaactgtgataccttgtagaatatgagtgatatgcaagctgtgttttttaattgttttaaaatgtaaattatggttatgctaaagtgaaaacctagaggaagctaatgattttatatactttgcacgaccaaatatggtcgtagtatgacgagttttatacattgccagagagttctgcctcctctgaaataacattcgcactgtagattgcatttcggcttttcctcctttcacattcttttttgctttacacttcacgtcttcgcacctgccctacctcccatcctttcaaagaggtttctttcacgttccagaattcagattgttctgtgatttcttttacatcagtctacccatttctgcaggcagccctgaaagcccttgtgttgattcagagtgtttgcagagaaatgcagttgaaccctggtagtggggtgtccctcacacacccgcgcacccctcccaaagttcaggatgaaaggctagaaaacccattcaaagttaggaaagaacacagatctttgaggccgatagcctagacctagaagatgaccttgagtatgtaaacattgtctccgtgacacaaaacactgaaactcttcatgtgcatataacacctgcttctgctcccattgtttcaagctcatcttatctttgtagtagtaatgtttgtctttgatacctacaaactaaaaaggtacttttatcaaggtttctcaaaacatttacaaaaccagctttgagaaaatgttatgttgcctggcaacagcactcggagtagtaattgtgttttctcattgtgatgttggtctgtgtgagcaaccagtgtagtgactctttggttcattattcgtgttgtttttatttttagtctctgtgtgacccaacagtggcaggggttacaaccccctctcctttcttttttgtatttatctatttgtaggattgtcagatcaagtacaagatgcccagttaagtttgaatttcagagaaacaatttcacgttaagaatgtttcatgcaatatttggcatatatttacagtaaaagcattcattatttgtctgaaattcaaatttaactgagcatgctggtttttctcattgtttggtttttctaaatctggcaatcctacagctgtggtcatgggaaatcacctacagcatcaccctccacttctttccaaaggagggcatcaaggaacttaacctgcctgcctggtgggtttctatttaagacatctttgtgattatatttaacctgcaattgtgctttggcttaatgtctagctcactgtacttgtaaatgattaatattcaataaaaccatttttaaagtaaaaagaaaaagataaagaaaaagaaaaacaagagaagaaaaagaaaaaaaagagagggagcccctaaaaagaagcctccgagacgacaagggggaaccactaaagatagaaacagaggaccaaacaaaggcggcaacaaaaaacgacacgagcgacaaacacggcggcgggcaaacaagcagaggaacacacgtgagagagaacaccatgtaggggacccacagggggagcacccagaacaacaccaacgagacaaacagcggacaggagacaaagtatgcgggcaagtgcggaacgaacata

SEQ ID NO: 26919 - DNA, 7838 bp, Homo sapiens
cacttactacagatgggtgctaatgtccacgctcgtgatgatggaggtctcatcccgcttcataatgcctgttcttttggccatgctgaggttgtgagtctgttattgtgccaaggagctgatccaaatgccagggataactggaactatacacctctgcatgaagctgctattaaagggaagatcgatgtgtgcattgtgctgctgcagcacggagctgacccaaacattcggaacactgatgggaaatcagccctggacctggcagatccttcagcaaaagctgtccttacaggtgaatacaagaaagacgaactcctagaagctgctaggagtggtaatgaagaaaaactaatggctttactgactcctctaaatgtgaattgccatgcaagtgatgggcgaaagtcgactcctttacatctagcagcgggctacaacagagttcgaatagttcagcttcttcttcagcatggtgctgatgttcatgcaaaagacaaaggtggacttgtgcctcttcataatgcatgttcatatggacattatgaagtcacagaactgctactaaagcatggagcttgtgttaatgccatggatctctggcagtttactccactgcacgaggctgcttccaagaaccgtgtagaagtctgctctttgttacttagccatggcgctgatcctacgttagtcaactgccatggcaaaagtgctgtggatatggctccaactccggagcttagggagagattgacttatgaatttaaaggtcattctttactacaagcagccagagaagcagacttagctaaagttaaaaaaacactcgctctggaaatcattaatttcaaacaaccgcagtctcatgaaacagcactgcactgtgctgtggcctctctgcatcccaaacgtaaacaagtgacagaattgttacttagaaaaggagcaaatgttaatgaaaaaaataaagatttcatgactcccctgcatgttgcagccgaaagagcccataatgatgtcatggaagttctgcataagcatggcgccaagatgaatgcactggacacccttggtcagactgctttgcatagagccgccctagcaggccacctgcagacctgccgcctcctgctgagttacggctctgacccctccatcatctccttacaaggcttcacagcagcacagatgggcaatgaagcagtgcagcagattctgagtgagagtacacctatacgtacttctgatgttgattatcgactcttagaggcatctaaagctggagacttggaaactgtgaagcaactttgcagctctcaaaatgtgaattgtagagacttagagggccggcattccacgcccttacacttcgcagcaggctacaaccgcgtgtctgttgtagagtacctgctacaccacggtgccgatgtccatgccaaagacaagggtggcttggtgccccttcataatgcctgttcatatggacactatgaggtggctgagcttttagtaaggcatggggcttctgtcaatgtggcggacttatggaaatttacccctctccatgaagcagcagctaaaggaaagtatgaaatctgcaagctccttttaaaacatggagcagatccaactaaaaagaacagagatggaaatacacctttggatttggtaaaggaaggagacacagatattcaggacttactgaaaggggatgctgctttgttggatgctgccaagaagggctgcctggcaagagtgcagaagctctgtaccccagagaatatcaactgcagagacacccagggcagaaattcaacccctctgcacctggcagcaggctataataacctggaagtagctgaatatcttctagagcatggagctgatgttaatgcccaggacaagggtggtttaattcctcttcataatgcggcatcttatgggcatgttgacatagcggctttattgataaaatacaacacgtgtgtaaatgcaacagataagtgggcgtttactcccctccatgaagcagcccagaaaggaaggacgcagctgtgcgccctcctcctagcgcatggtgcagaccccaccatgaagaaccaggaaggccagacgcctctggatctggcaacagctgacgatatcagagctttgctgatagatgccatgcccccagaggccttacctacctgttttaaacctcaggctactgtagtgagtgcctctctgatctcaccagcatccaccccctcctgcctctcggctgccagcagcatagacaacctcactggccctttagcagagttggccgtaggaggagcctccaatgcaggggatggcgccgcgggaacagaaaggaaggaaggagaagttgctggtcttgacatgaatatcagccaatttctaaaaagccttggccttgaacaccttcgggatatctttgaaacagaacagattacactagatgtgttggctgatatgggtcatgaagagttgaaagaaataggcatcaatgcatatgggcaccgccacaaattaatcaaaggagtagaaagactcttaggtggacaacaaggcaccaatccttatttgacttttcactgtgttaatcagggaacgattttgctggatcttgctccagaagataaagaatatcagtcagtggaagaagagatgcaaagtactattcgagaacacagagatggtggtaatgctggcggcatcttcaacagatacaatgtcattcgaattcaaaaagttgtcaacaagaagttgagggagcggttctgccaccgacagaaggaagtgtctgaggagaatcacaaccatcacaatgagcgcatgttgtttcatggttctcctttcattaatgccattattcataaagggtttgatgagcgacatgcatacataggaggaatgtttggggccgggatttattttgctgaaaactcctcaaaaagcaaccaatatgtttatggaattggaggaggaacaggctgccctacacacaaggacaggtcatgctatatatgtcacagacaaatgctcttctgtagagtgacccttgggaaatcctttctgcagtttagcaccatgaaaatggcccacgcgcctccagggcaccactcagtcattggtagaccgagcgtcaatgggctggcatatgctgaatatgtcatctacagaggagaacaggcatacccagagtatcttatcacttaccagatcatgaagccagaagccccttcccagaccgcaacagccgcagagcagaagacctagtgaatgcctgctggtgaaggccagatcagatttcaacctgggactggattacagaggattgtttctaataacaacatcaatattctagaagtccctgacagcctagaaataagctgtttgtcttctataaagcattgctatagtgatgaatagtatgagtaactgatacatactcaactgctactgttccctttgaggaaatgtttacaggggcggccttttaacatatctcaggctcattttcattgcaattatccatttctaaaacaagattgcttcgatctagacttggaaatggaaaataagaaaaccaatgctttttcaaatgttcacaattcacacactacatttgttttgttatgcatgacgtgtctataacaaatatacacatacgacaggcaacaagcttgtttttgatttgccagacatgcatcattggctattgtttgtttgttttttgtttttttgtgttttttgggttactttgaaaatgagccagagccttcttgaggatattttgcacaaagtcacgctgacaaaatcattagcagtgcaacccaagcttctggctgagcaagattcagtttccactttttaaaatttttttattttgctctgtagctgcacttctcgttatcataaattgagatgaaaaggaaaaaacatcaagttttagtacctttttatgaattggcctatcttacaagagaagggcacaaacaccaacctgacttaggaacgcctaaattcagagaagtcaaagccggtgaaggccacttgctctttccaacacaagcctgccacagaggtcttcgggacagtactggagatgcaggttgacacgggcttgagttccaaggtgaaaaaactggggaggctgtgaaggaagagctgcattaaggagggtgaggagcgtgtggttctgtatcatggcagccccaatggatccaggggatgcctccaaaaaatacatgcttcccttcccttaatctgtactgttgggattgttacccctccaaattagctgccttatttcaaaagtcagtgaaattactgcacttgatgagggtcacaaaaataccacttgattgtttctttagttgagaatgctgggattcagactcgaatagtggatagatacacacaaatgcaaggacttttttgtttactccagatttggggtttattttgagtggcatgcttcaaatagttcataaagatccttgcattaaatttctgaaccatttcttcaaacttcttagtgtgtttagacaaggagaacaaaaattgaaaccaaagccctttctgttattttttcaatgaaggtgagaaagaaataccatacaattttctttgtgaaattactgtttattttcatcaacatttaccaagtgccattgacatttataaaaaaaatgatcctttatagttcttacacttgcccttttcaccttaactgaatatgaattgagtgcactaacttatttacttgatatactgtgcatctactctgctttgaagcgaaagaaatataaacacgaggaggaataggaaagacagtgtgacacaaacttgccattgcaattcaaagccctgaaaacgatgggtttaatgcaaggtgattaagctgtgacctcctttaatctcctgaagcaaaataaaatggttacatgcaaaacttctagaaatagactcttaaaatatatacattttgctttgattttggcttcaacccagtgctggaactaggcatccagactagtttgaatgtttgtagctgaatttttatgggtcctcaaaattaaatcgagaattagcctcagttgttgcttcttttgaagtttcagtgacccaagctgggtgtttgtgtcttggctacttgtttaatagcactagaattccaggtgaagctttgagagttgatattcattaagagggctttttttccccttctttccttctcttttgctgtaacaaagggttgaagaaattgccatctgtgtagttttcagtagctgtcaagtgtgtcttacttaccttcccccagacgtagtttaaaatggtaaacacagctgtgatttttagttaagtaaaagagttaatatgatatagatatggaaagctttatggcttcattaaaaagataaaccactacctaactgtggttgtatgttgtttccatcatactaactagatgaatggatgcgccagttttcatcttggtccttacacttgagaagttaaactgtggttcagtatttaaactgccagtgttatacgtctcatgctctgtgtgccaggtgaaggtactgtgtaaggaagacatttgcggtgcttcttgtcctataatgattcaagtatatagtagttcttgaaagagtgtgcatatattactcatctgcttaagagagtgggttaatggatatatcagaggagccaaatacatttttttcagaacttgaaaaccaaaggtcatcatgagtgcactcaaaagttaggacaagtttattacatttgggattttcatctgtagccgtatgaagaaccctttccaatataaaagcatggcattaaattaggctgaagtcttttattttttgtatatgtactatatagaaatactagcaagttaggatcatccaatatggcctaccccgaaatggcccctctgtttccctaaccacatggaagaaagaatctgaacgtctccaccggctctacccgagttccaaaactaaagggcttctccagacctgatggttccagtttacctgctgttggcctgctggatacttgactcaggcataaattaagtgccctggtcccgaactttctccctgtatttgacctccttccctctttcctaaattactagtctggaattaaaattagctccagcaatgacctttgactccattcattttctcctcatcttgggtcttaaaaaaggagaccagatacctcctagcttttgtatcacaaccaggaatgggtattaggcctcatgcgctttgctcagaacactgccgctttgttaacaaatgacagcatggaacccagagttttgattcgatgcaaaataacagcagtgcaaccaggattcttgttttccttttccttcttggagtttggaatttctagcttttcaagcagcataagtagaatcaacattaggatgttttcatgaaatagcatccttatacttctttgagcttgatgttagtggctagactgatttccctttgctctcaaaatacaaagtgcattgaagtatacagagaaatgcctgaatatggcaagcaaataatgtagattaacattctattattgtatccgttttacaaaaaataaaattttgatatatgccggagaacggcattagaatgcaataagttgtctaggtttttctgtttcagtgtctctcccaatggcacgaagggttattgggcattgtccccacccccgcctttttaacatgtgcactatctggattcctgtaaatggccttgcaaacagaagtggtgtgtattttcaagcacctttcccccattgtatccgaatccctcttgtgtgatatctgtgacaaatagccttcttcttgtgttttctgttggactaattgtctcacgtaaagctatagaccttactaatttggcaggtattcaaaactgccattaagataggatttcatgtcagatacgtatttaaagagtaaagtcaaatttgtttaatgtcagatcagtgacagaagtgaaaagaaagtaattgtgaaagtgatgtttgagctattgtacacatctagcatatggaaagcaaatgcactcgaaaactactattctagaacatgaggcttcttcagcaacttgtgcactctgccattaataaattaaatttttcccctctagaaagccttaactatggcggaaactttttaaccttttatattttaataaataaaacattgtagtcccatttcttagtgtttgaaaggtgtgtcagtgagtcggccatgtctccatgtgtttcagacctgttcatcttattttatgatggtatatttcataagtaatattcccttacatgcaatggagctgattaaaattaatccatttcaatttctccatattggaacttcctcagctaccagatttctggtttggagaagtgctggaaagatttcaaagcctattcagttgtgtatgtggggatacgacagcaactgtgataccttgtagaatatgagtgatatgcaagctgtgttttttaattgttttaaaatgtaaattatggttatgctaaagtgaaaacctagaggaagctaatgattttatatactttgcacgaccaaatatggtcgtagtatgacgagttttatacattgccagagagttctgcctcctctgaaataacattcgcactgtagattgcatttcggcttttcctcctttcacattcttttttgctttacacttcacgtcttcgcacctatcacacccatccttaaaaaagaaataatagtagaaaaaaactcaaggggggccccggtcccaatc

SEQ ID NO: 26920 - DNA, 6649 bp, Homo sapiens
cacttactacagatgggtgctaatgtccacgctcgtgatgatggaggtctcatcccgcttcataatgcctgttcttttggccatgctgaggttgtgagtctgttattgtgccaaggagctgatccaaatgccagggataactggaactatacacctctgcatgaagctgctattaaagggaagatcgatgtgtgcattgtgctgctgcagcacggagctgacccaaacattcggaacactgatgggaaatcagccctggacctggcagatccttcagcaaaagctgtccttacaggtgaatacaagaaagacgaactcctagaagctgctaggagtggtaatgaagaaaaactaatggctttactgactcctctaaatgtgaattgccatgcaagtgatgggcgaaagtcgactcctttacatctagcagcgggctacaacagagttcgaatagttcagcttcttcttcagcatggtgctgatgttcatgcaaaagacaaaggtggacttgtgcctcttcataatgcatgttcatatggacattatgaagtcacagaactgctactaaagcatggagcttgtgttaatgccatggatctctggcagtttactccactgcacgaggctgcttccaagaaccgtgtagaagtctgctctttgttacttagccatggcgctgatcctacgttagtcaactgccatggcaaaagtgctgtggatatggctccaactccggagcttagggagagattgacttatgaatttaaaggtcattctttactacaagcagccagagaagcagacttagctaaagttaaaaaaacactcgctctggaaatcattaatttcaaacaaccgcagtctcatgaaacagcactgcactgtgctgtggcctctctgcatcccaaacgtaaacaagtgacagaattgttacttagaaaaggagcaaatgttaatgaaaaaaataaagatttcatgactcccctgcatgttgcagccgaaagagcccataatgatgtcatggaagttctgcataagcatggcgccaagatgaatgcactggacacccttggtcagactgctttgcatagagccgccctagcaggccacctgcagacctgccgcctcctgctgagttacggctctgacccctccatcatctccttacaaggcttcacagcagcacagatgggcaatgaagcagtgcagcagattctgagtgagagtacacctatacgtacttctgatgttgattatcgactcttagaggcatctaaagctggagacttggaaactgtgaagcaactttgcagctctcaaaatgtgaattgtagagacttagagggccggcattccacgcccttacacttcgcagcaggctacaaccgcgtgtctgttgtagagtacctgctacaccacggtgccgatgtccatgccaaagacaagggtggcttggtgccccttcataatgcctgttcatatggacactatgaggtggctgagcttttagtaaggcatggggcttctgtcaatgtggcggacttatggaaatttacccctctccatgaagcagcagctaaaggaaagtatgaaatctgcaagctccttttaaaacatggagcagatccaactaaaaagaacagagatggaaatacacctttggatttggtaaaggaaggagacacagatattcaggacttactgaaaggggatgctgctttgttggatgctgccaagaagggctgcctggcaagagtgcagaagctctgtaccccagagaatatcaactgcagagacacccagggcagaaattcaacccctctgcacctggcagcaggctataataacctggaagtagctgaatatcttctagagcatggagctgatgttaatgcccaggacaagggtggtttaattcctcttcataatgcggcatcttatgggcatgttgacatagcggctttattgataaaatacaacacgtgtgtaaatgcaacagataagtgggcgtttactcccctccatgaagcagcccagaaaggaaggacgcagctgtgcgccctcctcctagcgcatggtgcagaccccaccatgaagaaccaggaaggccagacgcctctggatctggcaacagctgacgatatcagagctttgctgatagatgccatgcccccagaggccttacctacctgttttaaacctcaggctactgtagtgagtgcctctctgatctcaccagcatccaccccctcctgcctctcggctgccagcagcatagacaacctcactggccctttagcagagttggccgtaggaggagcctccaatgcaggggatggcgccgcgggaacagaaaggaaggaaggagaagttgctggtcttgacatgaatatcagccaatttctaaaaagccttggccttgaacaccttcgggatatctttgaaacagaacagattacactagatgtgttggctgatatgggtcatgaagagttgaaagaaataggcatcaatgcatatgggcaccgccacaaattaatcaaaggagtagaaagactcttaggtggacaacaaggcaccaatccttatttgacttttcactgtgttaatcagggaacgattttgctggatcttgctccagaagataaagaatatcagtcagtggaagaagagatgcaaagtactattcgagaacacagagatggtggtaatgctggcggcatcttcaacagatacaatgtcattcgaattcaaaaagttgtcaacaagaagttgagggagcggttctgccaccgacagaaggaagtgtctgaggagaatcacaaccatcacaatgagcgcatgttgtttcatggttctcctttcattaatgccattattcataaagggtttgatgagcgacatgcatacataggaggaatgtttggggccgggatttattttgctgaaaactcctcaaaaagcaaccaatatgtttatggaattggaggaggaacaggctgccctacacacaaggacaggtcatgctatatatgtcacagacaaatgctcttctgtagagtgacccttgggaaatcctttctgcagtttagcaccatgaaaatggcccacgcgcctccagggcaccactcagtcattggtagaccgagcgtcaatgggctggcatatgctgaatatgtcatctacagaggagaacaggcatacccagagtatcttatcacttaccagatcatgaagccagaagccccttcccagaccgcaacagccgcagagcagaagacctagtgaatgcctgctggtgaaggccagatcagatttcaacctgggactggattacagaggattgtttctaataacaacatcaatattctagaagtccctgacagcctagaaataagctgtttgtcttctataaagcattgctatagtgatgaatagtatgagtaactgatacatactcaactgctactgttccctttgaggaaatgtttacaggggcggccttttaacatatctcaggctcattttcattgcaattatccatttctaaaacaagattgcttcgatctagacttggaaatggaaaataagaaaaccaatgctttttcaaatgttcacaattcacacactacatttgttttgttatgcatgacgtgtctataacaaatatacacatacgacaggcaacaagcttgtttttgatttgccagacatgcatcattggctattgtttgtttgttttttgtttttttgtgttttttgggttactttgaaaatgagccagagccttcttgaggatattttgcacaaagtcacgctgacaaaatcattagcagtgcaacccaagcttctggctgagcaagattcagtttccactttttaaaatttttttattttgctctgtagctgcacttctcgttatcataaattgagatgaaaaggaaaaaacatcaagttttagtacctttttatgaattggcctatcttacaagagaagggcacaaacaccaacctgacttaggaacgcctaaattcagagaagtcaaagccggtgaaggccacttgctctttccaacacaagcctgccacagaggtcttcgggacagtactggagatgcaggttgacacgggcttgagttccaaggtgaaaaaactggggaggctgtgaaggaagagctgcattaaggagggtgaggagcgtgtggttctgtatcatggcagccccaatggatccaggggatgcctccaaaaaatacatgcttcccttcccttaatctgtactgttgggattgttacccctccaaattagctgccttatttcaaaagtcagtgaaattactgcacttgatgagggtcacaaaaataccacttgattgtttctttagttgagaatgctgggattcagactcgaatagtggatagatacacacaaatgcaaggacttttttgtttactccagatttggggtttattttgagtggcatgcttcaaatagttcataaagatccttgcattaaatttctgaaccatttcttcaaacttcttagtgtgtttagacaaggagaacaaaaattgaaaccaaagccctttctgttattttttcaatgaaggtgagaaagaaataccatacaattttctttgtgaaattactgtttattttcatcaacatttaccaagtgccattgacatttataaaaaaaatgatcctttatagttcttacacttgcccttttcaccttaactgaatatgaattgagtgcactaacttatttacttgatatactgtgcatctactctgctttgaagcgaaagaaatataaacacgaggaggaataggaaagacagtgtgacacaaacttgccattgcaattcaaagccctgaaaacgatgggtttaatgcaaggtgattaagctgtgacctcctttaatctcctgaagcaaaataaaatggttacatgcaaaacttctagaaatagactcttaaaatatatacattttgctttgattttggcttcaacccagtgctggaactaggcatccagactagtttgaatgtttgtagctgaatttttatgggtcctcaaaattaaatcgagaattagcctcagttgttgcttcttttgaagtttcagtgacccaagctgggtgtttgtgtcttggctacttgtttaatagcactagaattccaggtgaagctttgagagttgatattcattaagagggctttttttccccttctttccttctcttttgctgtaacaaagggttgaagaaattgccatctgtgtagttttcagtagctgtcaagtgtgtcttacttaccttcccccagacgtagtttaaaatggtaaacacagctgtgatttttagttaagtaaaagagttaatatgatatagatatggaaagctttatggcttcattaaaaagataaaccactacctaactgtggttgtatgttgtttccatcatactaactagatgaatggatgcgccagttttcatcttggtccttacacttgagaagttaaactgtggttcagtatttaaactgccagtgttatacgtctcatgctctgtgtgccaggtgaaggtactgtgtaaggaagacatttgcggtgcttcttgtcctataatgattcaagtatatagtagttcttgaaagagtgtgcatatattactcatctgcttaagagagtgggttaatggatatatcagaggagccaaatacatttttttcagaacttgaaaaccaaaggtcatcatgagtgcactcaaaagttaggacaagtttattacatttgggattttcatctgtagccgtatgaagaaccctttccaatataaaagcatggcattaaattaggctgaagtcttttattttttgtatatgtactatatagaaatactagcaagttaggatcatccaatatggcctaccccgaaatggcccctctgtttccctaaccacatggaagaaagaatctgaacgtctccaccggctctacccgagttccaaaactaaagggcttctccagacctgatggttccagtttacctgctgttggcctgctggatacttgactcaggcataaattaagtgccctggtcccgaactttctccctgtatttgacctccttccctctttcctaaattactagtctggaattaaaattagctccagcaatgacctttgactccattcattttctcctcatcttgggtcttaaaaaaggagaccagatacctcctagcttttgtatcacaaccaggaatgggtattaggcctcatgcgctttgctcagaacactgccgctttgttaacaaatgacagcatggaacccagagttttgattcgatgcaaaataacagcagtgcaaccaggattcttgttttccttttccttcttggagtttggaatttctagcttttcaagcagcataagtagaatcaacattaggatgttttcatgaaatagcatccttatacttctttgagcttgatgttagtggctagactgatttccctttgctctcaaaatacaaagtgcattgaagtatacagagaaatgcctgaatatggcaagcaaataatgtagattaacattctatggcgtgtcgtttatcctctagagtcagctatgacgatgg

SEQ ID NO: 26921 - DNA, 5770 bp, Homo sapiens
  misc_feature (5736)..(5736): n is a, c, g, or t
cacttactacagatgggtgctaatgtccacgctcgtgatgatggaggtctcatcccgcttcataatgcctgttcttttggccatgctgaggttgtgagtctgttattgtgccaaggagctgatccaaatgccagggataactggaactatacacctctgcatgaagctgctattaaagggaagatcgatgtgtgcattgtgctgctgcagcacggagctgacccaaacattcggaacactgatgggaaatcagccctggacctggcagatccttcagcaaaagctgtccttacaggtgaatacaagaaagacgaactcctagaagctgctaggagtggtaatgaagaaaaactaatggctttactgactcctctaaatgtgaattgccatgcaagtgatgggcgaaagtcgactcctttacatctagcagcgggctacaacagagttcgaatagttcagcttcttcttcagcatggtgctgatgttcatgcaaaagacaaaggtggacttgtgcctcttcataatgcatgttcatatggacattatgaagtcacagaactgctactaaagcatggagcttgtgttaatgccatggatctctggcagtttactccactgcacgaggctgcttccaagaaccgtgtagaagtctgctctttgttacttagccatggcgctgatcctacgttagtcaactgccatggcaaaagtgctgtggatatggctccaactccggagcttagggagagattgacttatgaatttaaaggtcattctttactacaagcagccagagaagcagacttagctaaagttaaaaaaacactcgctctggaaatcattaatttcaaacaaccgcagtctcatgaaacagcactgcactgtgctgtggcctctctgcatcccaaacgtaaacaagtgacagaattgttacttagaaaaggagcaaatgttaatgaaaaaaataaagatttcatgactcccctgcatgttgcagccgaaagagcccataatgatgtcatggaagttctgcataagcatggcgccaagatgaatgcactggacacccttggtcagactgctttgcatagagccgccctagcaggccacctgcagacctgccgcctcctgctgagttacggctctgacccctccatcatctccttacaaggcttcacagcagcacagatgggcaatgaagcagtgcagcagattctgagtgagagtacacctatacgtacttctgatgttgattatcgactcttagaggcatctaaagctggagacttggaaactgtgaagcaactttgcagctctcaaaatgtgaattgtagagacttagagggccggcattccacgcccttacacttcgcagcaggctacaaccgcgtgtctgttgtagagtacctgctacaccacggtgccgatgtccatgccaaagacaagggtggcttggtgccccttcataatgcctgttcatatggacactatgaggtggctgagcttttagtaaggcatggggcttctgtcaatgtggcggacttatggaaatttacccctctccatgaagcagcagctaaaggaaagtatgaaatctgcaagctccttttaaaacatggagcagatccaactaaaaagaacagagatggaaatacacctttggatttggtaaaggaaggagacacagatattcaggacttactgaaaggggatgctgctttgttggatgctgccaagaagggctgcctggcaagagtgcagaagctctgtaccccagagaatatcaactgcagagacacccagggcagaaattcaacccctctgcacctggcagcaggctataataacctggaagtagctgaatatcttctagagcatggagctgatgttaatgcccaggacaagggtggtttaattcctcttcataatgcggcatcttatgggcatgttgacatagcggctttattgataaaatacaacacgtgtgtaaatgcaacagataagtgggcgtttactcccctccatgaagcagcccagaaaggaaggacgcagctgtgcgccctcctcctagcgcatggtgcagaccccaccatgaagaaccaggaaggccagacgcctctggatctggcaacagctgacgatatcagagctttgctgatagatgccatgcccccagaggccttacctacctgttttaaacctcaggctactgtagtgagtgcctctctgatctcaccagcatccaccccctcctgcctctcggctgccagcagcatagacaacctcactggccctttagcagagttggccgtaggaggagcctccaatgcaggggatggcgccgcgggaacagaaaggaaggaaggagaagttgctggtcttgacatgaatatcagccaatttctaaaaagccttggccttgaacaccttcgggatatctttgaaacagaacagattacactagatgtgttggctgatatgggtcatgaagagttgaaagaaataggcatcaatgcatatgggcaccgccacaaattaatcaaaggagtagaaagactcttaggtggacaacaaggcaccaatccttatttgacttttcactgtgttaatcagggaacgattttgctggatcttgctccagaagataaagaatatcagtcagtggaagaagagatgcaaagtactattcgagaacacagagatggtggtaatgctggcggcatcttcaacagatacaatgtcattcgaattcaaaaagttgtcaacaagaagttgagggagcggttctgccaccgacagaaggaagtgtctgaggagaatcacaaccatcacaatgagcgcatgttgtttcatggttctcctttcattaatgccattattcataaagggtttgatgagcgacatgcatacataggaggaatgtttggggccgggatttattttgctgaaaactcctcaaaaagcaaccaatatgtttatggaattggaggaggaacaggctgccctacacacaaggacaggtcatgctatatatgtcacagacaaatgctcttctgtagagtgacccttgggaaatcctttctgcagtttagcaccatgaaaatggcccacgcgcctccagggcaccactcagtcattggtagaccgagcgtcaatgggctggcatatgctgaatatgtcatctacagaggagaacaggcatacccagagtatcttatcacttaccagatcatgaagccagaagccccttcccagaccgcaacagccgcagagcagaagacctagtgaatgcctgctggtgaaggccagatcagatttcaacctgggactggattacagaggattgtttctaataacaacatcaatattctagaagtccctgacagcctagaaataagctgtttgtcttctataaagcattgctatagtgatgaatagtatgagtaactgatacatactcaactgctactgttccctttgaggaaatgtttacaggggcggccttttaacatatctcaggctcattttcattgcaattatccatttctaaaacaagattgcttcgatctagacttggaaatggaaaataagaaaaccaatgctttttcaaatgttcacaattcacacactacatttgttttgttatgcatgacgtgtctataacaaatatacacatacgacaggcaacaagcttgtttttgatttgccagacatgcatcattggctattgtttgtttgttttttgtttttttgtgttttttgggttactttgaaaatgagccagagccttcttgaggatattttgcacaaagtcacgctgacaaaatcattagcagtgcaacccaagcttctggctgagcaagattcagtttccactttttaaaatttttttattttgctctgtagctgcacttctcgttatcataaattgagatgaaaaggaaaaaacatcaagttttagtacctttttatgaattggcctatcttacaagagaagggcacaaacaccaacctgacttaggaacgcctaaattcagagaagtcaaagccggtgaaggccacttgctctttccaacacaagcctgccacagaggtcttcgggacagtactggagatgcaggttgacacgggcttgagttccaaggtgaaaaaactggggaggctgtgaaggaagagctgcattaaggagggtgaggagcgtgtggttctgtatcatggcagccccaatggatccaggggatgcctccaaaaaatacatgcttcccttcccttaatctgtactgttgggattgttacccctccaaattagctgccttatttcaaaagtcagtgaaattactgcacttgatgagggtcacaaaaataccacttgattgtttctttagttgagaatgctgggattcagactcgaatagtggatagatacacacaaatgcaaggacttttttgtttactccagatttggggtttattttgagtggcatgcttcaaatagttcataaagatccttgcattaaatttctgaaccatttcttcaaacttcttagtgtgtttagacaaggagaacaaaaattgaaaccaaagccctttctgttattttttcaatgaaggtgagaaagaaataccatacaattttctttgtgaaattactgtttattttcatcaacatttaccaagtgccattgacatttataaaaaaaatgatcctttatagttcttacacttgcccttttcaccttaactgaatatgaattgagtgcactaacttatttacttgatatactgtgcatctactctgctttgaagcgaaagaaatataaacacgaggaggaataggaaagacagtgtgacacaaacttgccattgcaattcaaagccctgaaaacgatgggtttaatgcaaggtgattaagctgtgacctcctttaatctcctgaagcaaaataaaatggttacatgcaaaacttctagaaatagactcttaaaatatatacattttgctttgattttggcttcaacccagtgctggaactaggcatccagactagtttgaatgtttgtagctgaatttttatgggtcctcaaaattaaatcgagaattagcctcagttgttgcttcttttgaagtttcagtgacccaagctgggtgtttgtgtcttggctacttgtttaatagcactagaattccaggtgaagctttgagagttgatattcattaagagggctttttttccccttctttccttctcttttgctgtaacaaagggttgaagaaattgccatctgtgtagttttcagtagctgtcaagtgtgtcttacttaccttcccccagacgtagtttaaaatggtaaacacagctgtgatttttagttaagtaaaagagttaatatgatatagatatggaaagctttatggcttcattaaaaagataaaccactacctaactgtggttgtatgttgtttccatcatactaactagatgaatggatgcgccagttttcatcttggtccttacacttgagaagttaaactgtggttcagtatttaaactgccagtgttatacgtctcatgctctgtgtgccaggtgaaggtactgtgtaaggaagacatttgcggtgcttcttgtcctataatgattcaagtatatagtagttcttgaaagagtgtgcatatattactcatctgatatatccattaacccactctcttaagcagatgagggcgacgcggccgcnaatttattaatagtaggccgccgctccttaggat

SEQ ID NO: 26922 - DNA, 6199 bp, Homo sapiens
cacttactacagatgggtgctaatgtccacgctcgtgatgatggaggtctcatcccgcttcataatgcctgttcttttggccatgctgaggttgtgagtctgttattgtgccaaggagctgatccaaatgccagggataactggaactatacacctctgcatgaagctgctattaaagggaagatcgatgtgtgcattgtgctgctgcagcacggagctgacccaaacattcggaacactgatgggaaatcagccctggacctggcagatccttcagcaaaagctgtccttacaggtgaatacaagaaagacgaactcctagaagctgctaggagtggtaatgaagaaaaactaatggctttactgactcctctaaatgtgaattgccatgcaagtgatgggcgaaagtcgactcctttacatctagcagcgggctacaacagagttcgaatagttcagcttcttcttcagcatggtgctgatgttcatgcaaaagacaaaggtggacttgtgcctcttcataatgcatgttcatatggacattatgaagtcacagaactgctactaaagcatggagcttgtgttaatgccatggatctctggcagtttactccactgcacgaggctgcttccaagaaccgtgtagaagtctgctctttgttacttagccatggcgctgatcctacgttagtcaactgccatggcaaaagtgctgtggatatggctccaactccggagcttagggagagattgacttatgaatttaaaggtcattctttactacaagcagccagagaagcagacttagctaaagttaaaaaaacactcgctctggaaatcattaatttcaaacaaccgcagtctcatgaaacagcactgcactgtgctgtggcctctctgcatcccaaacgtaaacaagtgacagaattgttacttagaaaaggagcaaatgttaatgaaaaaaataaagatttcatgactcccctgcatgttgcagccgaaagagcccataatgatgtcatggaagttctgcataagcatggcgccaagatgaatgcactggacacccttggtcagactgctttgcatagagccgccctagcaggccacctgcagacctgccgcctcctgctgagttacggctctgacccctccatcatctccttacaaggcttcacagcagcacagatgggcaatgaagcagtgcagcagattctgagtgagagtacacctatacgtacttctgatgttgattatcgactcttagaggcatctaaagctggagacttggaaactgtgaagcaactttgcagctctcaaaatgtgaattgtagagacttagagggccggcattccacgcccttacacttcgcagcaggctacaaccgcgtgtctgttgtagagtacctgctacaccacggtgccgatgtccatgccaaagacaagggtggcttggtgccccttcataatgcctgttcatatggacactatgaggtggctgagcttttagtaaggcatggggcttctgtcaatgtggcggacttatggaaatttacccctctccatgaagcagcagctaaaggaaagtatgaaatctgcaagctccttttaaaacatggagcagatccaactaaaaagaacagagatggaaatacacctttggatttggtaaaggaaggagacacagatattcaggacttactgaaaggggatgctgctttgttggatgctgccaagaagggctgcctggcaagagtgcagaagctctgtaccccagagaatatcaactgcagagacacccagggcagaaattcaacccctctgcacctggcagcaggctataataacctggaagtagctgaatatcttctagagcatggagctgatgttaatgcccaggacaagggtggtttaattcctcttcataatgcggcatcttatgggcatgttgacatagcggctttattgataaaatacaacacgtgtgtaaatgcaacagataagtgggcgtttactcccctccatgaagcagcccagaaaggaaggacgcagctgtgcgccctcctcctagcgcatggtgcagaccccaccatgaagaaccaggaaggccagacgcctctggatctggcaacagctgacgatatcagagctttgctgatagatgccatgcccccagaggccttacctacctgttttaaacctcaggctactgtagtgagtgcctctctgatctcaccagcatccaccccctcctgcctctcggctgccagcagcatagacaacctcactggccctttagcagagttggccgtaggaggagcctccaatgcaggggatggcgccgcgggaacagaaaggaaggaaggagaagttgctggtcttgacatgaatatcagccaatttctaaaaagccttggccttgaacaccttcgggatatctttgaaacagaacagattacactagatgtgttggctgatatgggtcatgaagagttgaaagaaataggcatcaatgcatatgggcaccgccacaaattaatcaaaggagtagaaagactcttaggtggacaacaaggcaccaatccttatttgacttttcactgtgttaatcagggaacgattttgctggatcttgctccagaagataaagaatatcagtcagtggaagaagagatgcaaagtactattcgagaacacagagatggtggtaatgctggcggcatcttcaacagatacaatgtcattcgaattcaaaaagttgtcaacaagaagttgagggagcggttctgccaccgacagaaggaagtgtctgaggagaatcacaaccatcacaatgagcgcatgttgtttcatggttctcctttcattaatgccattattcataaagggtttgatgagcgacatgcatacataggaggaatgtttggggccgggatttattttgctgaaaactcctcaaaaagcaaccaatatgtttatggaattggaggaggaacaggctgccctacacacaaggacaggtcatgctatatatgtcacagacaaatgctcttctgtagagtgacccttgggaaatcctttctgcagtttagcaccatgaaaatggcccacgcgcctccagggcaccactcagtcattggtagaccgagcgtcaatgggctggcatatgctgaatatgtcatctacagaggagaacaggcatacccagagtatcttatcacttaccagatcatgaagccagaagccccttcccagaccgcaacagccgcagagcagaagacctagtgaatgcctgctggtgaaggccagatcagatttcaacctgggactggattacagaggattgtttctaataacaacatcaatattctagaagtccctgacagcctagaaataagctgtttgtcttctataaagcattgctatagtgatgaatagtatgagtaactgatacatactcaactgctactgttccctttgaggaaatgtttacaggggcggccttttaacatatctcaggctcattttcattgcaattatccatttctaaaacaagattgcttcgatctagacttggaaatggaaaataagaaaaccaatgctttttcaaatgttcacaattcacacactacatttgttttgttatgcatgacgtgtctataacaaatatacacatacgacaggcaacaagcttgtttttgatttgccagacatgcatcattggctattgtttgtttgttttttgtttttttgtgttttttgggttactttgaaaatgagccagagccttcttgaggatattttgcacaaagtcacgctgacaaaatcattagcagtgcaacccaagcttctggctgagcaagattcagtttccactttttaaaatttttttattttgctctgtagctgcacttctcgttatcataaattgagatgaaaaggaaaaaacatcaagttttagtacctttttatgaattggcctatcttacaagagaagggcacaaacaccaacctgacttaggaacgcctaaattcagagaagtcaaagccggtgaaggccacttgctctttccaacacaagcctgccacagaggtcttcgggacagtactggagatgcaggttgacacgggcttgagttccaaggtgaaaaaactggggaggctgtgaaggaagagctgcattaaggagggtgaggagcgtgtggttctgtatcatggcagccccaatggatccaggggatgcctccaaaaaatacatgcttcccttcccttaatctgtactgttgggattgttacccctccaaattagctgccttatttcaaaagtcagtgaaattactgcacttgatgagggtcacaaaaataccacttgattgtttctttagttgagaatgctgggattcagactcgaatagtggatagatacacacaaatgcaaggacttttttgtttactccagatttggggtttattttgagtggcatgcttcaaatagttcataaagatccttgcattaaatttctgaaccatttcttcaaacttcttagtgtgtttagacaaggagaacaaaaattgaaaccaaagccctttctgttattttttcaatgaaggtgagaaagaaataccatacaattttctttgtgaaattactgtttattttcatcaacatttaccaagtgccattgacatttataaaaaaaatgatcctttatagttcttacacttgcccttttcaccttaactgaatatgaattgagtgcactaacttatttacttgatatactgtgcatctactctgctttgaagcgaaagaaatataaacacgaggaggaataggaaagacagtgtgacacaaacttgccattgcaattcaaagccctgaaaacgatgggtttaatgcaaggtgattaagctgtgacctcctttaatctcctgaagcaaaataaaatggttacatgcaaaacttctagaaatagactcttaaaatatatacattttgctttgattttggcttcaacccagtgctggaactaggcatccagactagtttgaatgtttgtagctgaatttttatgggtcctcaaaattaaatcgagaattagcctcagttgttgcttcttttgaagtttcagtgacccaagctgggtgtttgtgtcttggctacttgtttaatagcactagaattccaggtgaagctttgagagttgatattcattaagagggctttttttccccttctttccttctcttttgctgtaacaaagggttgaagaaattgccatctgtgtagttttcagtagctgtcaagtgtgtcttacttaccttcccccagacgtagtttaaaatggtaaacacagctgtgatttttagttaagtaaaagagttaatatgatatagatatggaaagctttatggcttcattaaaaagataaaccactacctaactgtggttgtatgttgtttccatcatactaactagatgaatggatgcgccagttttcatcttggtccttacacttgagaagttaaactgtggttcagtatttaaactgccagtgttatacgtctcatgctctgtgtgccaggtgaaggtactgtgtaaggaagacatttgcggtgcttcttgtcctataatgattcaagtatatagtagttcttgaaagagtgtgcatatattactcatctgcttaagagagtgggttaatggatatatcagaggagccaaatacatttttttcagaacttgaaaaccaaaggtcatcatgagtgcactcaaaagttaggacaagtttattacatttgggattttcatctgtagccgtatgaagaaccctttccaatataaaagcatggcattaaattaggctgaagtcttttattttttgtatatgtactatatagaaatactagcaagttaggatcatccaatatggcctaccccgaaatggcccctctgtttccctaaccacatggaagaaagaatctgaacgtctccaccggctctacccgagttccaaaactaaagggcttctccagacctgatggttccagtttacctgctgttggcctgctggatacttgactcaggcataaattaagtgccctggtcccgaactttctccctgtatttgacctccttccctttctatcgttctctctttgcatggatttttttgaaaaaaaataaattgctcaaata

SEQ ID NO: 26923 - DNA, 585 bp, Homo sapiens
cgatatttgtggttctggcaatcctcccatttcagcctcccgagcagcgggggactacagacatgtacaaccatgttgagtttatttttttttcttagtttatagagatgggtttcaccatgttggcccaggctggtcttgaactcctgacctcaagtgatctgcccgcctccacctcccaaagtgttgagattacagacgtgagccaatgtgcctggcctattcccttctctctttatgctaccacaaataattaccttctgtttattgtaagtgatgcatgtctaacaatttgtacaatacattttgaatatatttttccttccattattgtcttttcccaagaccatagggttgccttctctacatttgttctcttagaattcagctcccttttccctataatcttctaatgtagaatatttaatagaatgccagaacgtcactcagtgggtactactacctcttatttttcaacttttcagtttcttaagtttagcgttttttgaatatgtaaagtgaatgtatgcgatacattaattcgttttataaatttaaaattctgtcatgtctacttaaaaggaa

SEQ ID NO: 26924 - DNA, 4413 bp, Homo sapiens
agaacggcgtcttccagttccccaccggatgaagcggaagtgcgtcatgtcgaggcgccaaggcgctcgtttggcgcgcggccctaggcggcggatctaagctaacttcttggatcttttcttgtttctccttggtttttgactttttctggaccctggtgtctacgatttccgagatgccgtcttctttgttgggcgcggcgatgccggcctctacatctgccgcagccctgcaggaagctctggaaaatgctggacggctcatcgaccgtcagttgcaagaggaccgcatgtacccggacctttccgagctgcttatggtgtctgccccaaataatcccaccgtttctggcatgtcagatatggattatcctttacaaggacctggtttgctgtccgtacccaaccttccagagatcagttccatccgaagagttcctctcccacctgaacttgttgagcagtttggacatatgcagtgtaattgcatgatgggtgtgttccctcctatcagcagagcttggctcacaattgacagtgatatattcatgtggaactatgaggatggaggagaccttgcctattttgatggacttagtgagactattcttgctgtggggcttgtgaagccaaaagcaggcatctttcaacctcatgtgcgacacctcctggttttggcgacccctgtagacatagtaattcttggactcagctatgctaatttgcaaacaggttctggagttcttaatgatagtttgtctggtggaatgcagttgcttccagatcctttatattctcttcctactgataatacttaccttttaacaataacttccactgataatggcagaattttcttggctggaaaggatggctgtttatatgaagtagcctaccaggctgaagcagggtggtttagccaaagatgtaggaaaataaaccactcaaagagctcactttctttccttgttccttccttgctacaattcacgttctcagaagatgatcctattcttcaaattgcaattgataattctagaaatattttatatacacgatctgagaaaggagtaatacaggtgtatgatttgggacaagatggacaaggaatgagcagagttgcctctgtgtcacagaatgccattgtctctgctgctggtaacattgctaggaccatcgatcgttctgtttttaaaccaattgtccaaatagcagtgattgaaaattctgaatcactggactgtcagttattggctgtcacacatgcaggtgttaggttatattttagcacttgtccattcagacagccattagcacggcctaatacactgacgctggttcatgtccgcttacctcctggattctcagcatcttcaaccgtggaaaagccttcaaaagtacatagagctctttatagtaaaggtattctattgatggcagcctcagaaaatgaggataatgatattttatggtgtgtcaaccatgatacttttcctttccaaaagccaatgatggaaacccagatgacagctggtgttgatggtcattcctgggctctttctgcgatagatgaattgaaagtagataaaataattacacctttaaacaaggatcatattccaataactgattcaccagttgttgtacagcagcacatgttacctccgaagaaatttgttctcctctcagcacaggggagccttatgtttcataaacttagacctgtagatcaactgaggcatctacttgtgagtaatgtgggaggagatggagaagagattgaaagattctttaaattacatcaggaagaccaggcttgtgcaacttgccttattcttgcttgctccactgctgcctgtgatagagaagtatctgcctgggctactcgggctttctttaggtatggtggtgaagcacagatgagatttccaaccactcttccgcctccaagtaatgttggtcccatcttggggtctcctgtctattctagttctcctgttcctagtggtagtccctatccaaatccatcctttttgggaacaccgtctcatggtatacagcctcctgccatgtcaactccagtgtgtgctctgggaaacccagcaactcaggccacaaatatgagttgtgtgactggaccagagattgtgtactctggaaaacacaatggtatttgcatttacttttctcggatcatgggaaacatttgggatgcaagcttagttgtggagagaatattcaagagtggcaacagagagatcactgcaattgaaagtagtgttccctgccaactgctagagtcagtgctacaagaactaaagggtttgcaggaatttctagacagaaactcccagtttgcaggaggaccattaggaaatccaaatactactgctaaagtgcagcagaggctgataggattcatgcgtcctgaaaacggaaatccccagcaaatgcaacaggaactgcagaggaagtttcatgaggctcaactaagtgaaaagatttcacttcaggcaattcagcagttggttcgaaaatcatatcaggctctggctttatggaaacttctttgtgaacatcaattcactatcattgtggcagaacttcagaaggaacttcaagagcagctgaagatcaccacctttaaagatcttgtaatcagggacaaagaactcacaggggcattaattgcttctcttatcaactgctacatcagagataatgccgctgttgatggcattagtttacatttacaggatatctgcccacttctatatagcactgatgatgcaatttgttctaaggcaaatgagcttctccagcgttcccgacaagttcaaaataagactgaaaaagaaagaatgttaagggaatcattaaaggaatatcaaaaaattagcaatcaagtggacctttccaatgtttgtgctcagtatagacaagtgagattttatgagggtgtggtggaactttctcttacggctgcagagaaaaaagatcctcaaggtcttgggcttcatttctataaacatggagaaccagaagaagacatagttggacttcaggccttccaagaaagattaaacagttacaaatgcattacagacacacttcaagaactggtaaatcaaagtaaggccgctcctcagtctcccagtgtacccaaaaaacctggtcctccagtgttgtcatctgatccaaatatgctgagtaatgaagaagcaggacatcattttgaacaaatgcttaaattgtcacagcgatccaaggatgagctctttagtattgccctttataattggctaatacaagtcgaccttgcagataagctgctacaggttgcttctccatttctggagccacatctagtccgaatggccaaagttgatcaaaacagagttcgttatatggatttactctggcggtattacgagaagaacagaagtttcagtaatgctgctcgtgtactgtccagactggctgacatgcatagcacagaaatttcacttcagcagcgactagagtacattgctcgagccattcttagtgccaaaagttccactgccatttcatcaatagctgccgatggtgaatttcttcatgaattagaagaaaaaatggaggttgctaggatccaacttcagatacaggagacactacaaaggcagtattcccatcattcttctgtacaggatgcagtttctcagctggattctgagctgatggacataactaagctttatggggaatttgctgacccatttaaacttgcagagtgcaaacttgcaataattcattgtgccggttattcagaccctatattggtgcagacactttggcaagatatcatagagaaagaattgagtgacagtgtgacattgagctcctcggatagaatgcatgctcttagtctcaagattgttctccttggcaaaatttatgctggcacaccacgcttctttcctttagattttattgtacagtttttagaacagcaggtttgtactttgaactgggatgtgggcttcgtaatacagacaatgaatgaaattggagtaccattacctagactactagaagtttatgatcagttgttcaaatcacgggatccattctggaacagaatgaagaagccactgcaccttttggattgtatacatgtattattgataagatatgttgagaatcccagccaagttttaaattgtgaaaggagaagatttacaaatctctgcctggatgctgtttgtggttaccttgttgagctccagtctatgagctcgtcagtagcagtacaagccatcactgggaattttaaatctcttcaagctaaattagaacggcttcattaattactgtgatatactttcatccgttttatgatctgtaaaataaaaactcagctgggtccag

SEQ ID NO: 26925 - DNA, 5174 bp, Homo sapiens
agaacggcgtcttccagttccccaccggatgaagcggaagtgcgtcatgtcgaggcgccaaggcgctcgtttggcgcgcggccctaggcggcggatctaagctaacttcttggatcttttcttgtttctccttggtttttgactttttctggaccctggtgtctacgatttccgagatgccgtcttctttgttgggcgcggcgatgccggcctctacatctgccgcagccctgcaggaagctctggaaaatgctggacggctcatcgaccgtcagttgcaagaggaccgcatgtacccggacctttccgagctgcttatggtgtctgccccaaataatcccaccgtttctggcatgtcagatatggattatcctttacaaggacctggtttgctgtccgtacccaaccttccagagatcagttccatccgaagagttcctctcccacctgaacttgttgagcagtttggacatatgcagtgtaattgcatgatgggtgtgttccctcctatcagcagagcttggctcacaattgacagtgatatattcatgtggaactatgaggatggaggagaccttgcctattttgatggacttagtgagactattcttgctgtggggcttgtgaagccaaaagcaggcatctttcaacctcatgtgcgacacctcctggttttggcgacccctgtagacatagtaattcttggactcagctatgctaatttgcaaacaggttctggagttcttaatgatagtttgtctggtggaatgcagttgcttccagatcctttatattctcttcctactgataatacttaccttttaacaataacttccactgataatggcagaattttcttggctggaaaggatggctgtttatatgaagtagcctaccaggctgaagcagggtggtttagccaaagatgtaggaaaataaaccactcaaagagctcactttctttccttgttccttccttgctacaattcacgttctcagaagatgatcctattcttcaaattgcaattgataattctagaaatattttatatacacgatctgagaaaggagtaatacaggtgtatgatttgggacaagatggacaaggaatgagcagagttgcctctgtgtcacagaatgccattgtctctgctgctggtaacattgctaggaccatcgatcgttctgtttttaaaccaattgtccaaatagcagtgattgaaaattctgaatcactggactgtcagttattggctgtcacacatgcaggtgttaggttatattttagcacttgtccattcagacagccattagcacggcctaatacactgacgctggttcatgtccgcttacctcctggattctcagcatcttcaaccgtggaaaagccttcaaaagtacatagagctctttatagtaaaggtattctattgatggcagcctcagaaaatgaggataatgatattttatggtgtgtcaaccatgatacttttcctttccaaaagccaatgatggaaacccagatgacagctggtgttgatggtcattcctgggctctttctgcgatagatgaattgaaagtagataaaataattacacctttaaacaaggatcatattccaataactgattcaccagttgttgtacagcagcacatgttacctccgaagaaatttgttctcctctcagcacaggggagccttatgtttcataaacttagacctgtagatcaactgaggcatctacttgtgagtaatgtgggaggagatggagaagagattgaaagattctttaaattacatcaggaagaccaggcttgtgcaacttgccttattcttgcttgctccactgctgcctgtgatagagaagtatctgcctgggctactcgggctttctttaggtatggtggtgaagcacagatgagatttccaaccactcttccgcctccaagtaatgttggtcccatcttggggtctcctgtctattctagttctcctgttcctagtggtagtccctatccaaatccatcctttttgggaacaccgtctcatggtatacagcctcctgccatgtcaactccagtgtgtgctctgggaaacccagcaactcaggccacaaatatgagttgtgtgactggaccagagattgtgtactctggaaaacacaatggtatttgcatttacttttctcggatcatgggaaacatttgggatgcaagcttagttgtggagagaatattcaagagtggcaacagagagatcactgcaattgaaagtagtgttccctgccaactgctagagtcagtgctacaagaactaaagggtttgcaggaatttctagacagaaactcccagtttgcaggaggaccattaggaaatccaaatactactgctaaagtgcagcagaggctgataggattcatgcgtcctgaaaacggaaatccccagcaaatgcaacaggaactgcagaggaagtttcatgaggctcaactaagtgaaaagatttcacttcaggcaattcagcagttggttcgaaaatcatatcaggctctggctttatggaaacttctttgtgaacatcaattcactatcattgtggcagaacttcagaaggaacttcaagagcagctgaagatcaccacctttaaagatcttgtaatcagggacaaagaactcacaggggcattaattgcttctcttatcaactgctacatcagagataatgccgctgttgatggcattagtttacatttacaggatatctgcccacttctatatagcactgatgatgcaatttgttctaaggcaaatgagcttctccagcgttcccgacaagttcaaaataagactgaaaaagaaagaatgttaagggaatcattaaaggaatatcaaaaaattagcaatcaagtggacctttccaatgtttgtgctcagtatagacaagtgagattttatgagggtgtggtggaactttctcttacggctgcagagaaaaaagatcctcaaggtcttgggcttcatttctataaacatggagaaccagaagaagacatagttggacttcaggccttccaagaaagattaaacagttacaaatgcattacagacacacttcaagaactggtaaatcaaagtaaggccgctcctcagtctcccagtgtacccaaaaaacctggtcctccagtgttgtcatctgatccaaatatgctgagtaatgaagaagcaggacatcattttgaacaaatgcttaaattgtcacagcgatccaaggatgagctctttagtattgccctttataattggctaatacaagtcgaccttgcagataagctgctacaggttgcttctccatttctggagccacatctagtccgaatggccaaagttgatcaaaacagagttcgttatatggatttactctggcggtattacgagaagaacagaagtttcagtaatgctgctcgtgtactgtccagactggctgacatgcatagcacagaaatttcacttcagcagcgactagagtacattgctcgagccattcttagtgccaaaagttccactgccatttcatcaatagctgccgatggtgaatttcttcatgaattagaagaaaaaatggaggttgctaggatccaacttcagatacaggagacactacaaaggcagtattcccatcattcttctgtacaggatgcagtttctcagctggattctgagctgatggacataactaagctttatggggaatttgctgacccatttaaacttgcagagtgcaaacttgcaataattcattgtgccggttattcagaccctatattggtgcagacactttggcaagatatcatagagaaagaattgagtgacagtgtgacattgagctcctcggatagaatgcatgctcttagtctcaagattgttctccttggcaaaatttatgctggcacaccacgcttctttcctttagattttattgtacagtttttagaacagcaggtttgtactttgaactgggatgtgggcttcgtaatacagacaatgaatgaaattggagtaccattacctagactactagaagtttatgatcagttgttcaaatcacgggatccattctggaacagaatgaagaagccactgcaccttttggattgtatacatgtattattgataagatatgttgagaatcccagccaagttttaaattgtgaaaggagaagatttacaaatctctgcctggatgctgtttgtggttaccttgttgagctccagtctatgagctcgtcagtagcagtacaagccatcactgggaattttaaatctcttcaagctaaattagaacggcttcattaattactgtgatatactttcatccgttttatgatctgtaaaataaaaactcagctgggtccagatatcaggtgttctaaatctaagaatgtaagaacaatcttaatagaaatatgtttttaataagtggctaatatctacaaatagtacctttgctaaatgaattcttttttatgactattttgttttttagtaattgggtgaaaaaacaactgaaattgtactgcaggcagaaatttcgaatttatattattcattttcaagttagtccaaggatattggcattaaaactccactaggcggccaggcacagtgacttacacctgtaatcccagcactttgggaggccaaggtgggcgaatcacgagcaggctggtcttgaactcctgacctcaagtgatctgcccgcctccacctcccaaagtgttgagattacagacgtgagccaatgtgcctggcctattcccttctctctttatgctaccacaaataattaccttctgtttattgtaagtgatgcatgtctaacaatttgtacaatacattttgaatatatttttccttccattattgtcttttcccaagaccatagggttgccttctctacatttgttctcttagaattcagctcccttttccctataatcttctaatgtagaatatttaatagaatgccagaacgtcactcagtgggtactactacctcttatttttcaacttttcagtttcttaagtttagcgttttttgaatatgtaaagtgaatgtatgcgatacattaattcgttttataaatttaaaattctgtcatgtctacttaaaaggaa

SEQ ID NO: 26926 - DNA, 4892 bp, Homo sapiens
agaacggcgtcttccagttccccaccggatgaagcggaagtgcgtcatgtcgaggcgccaaggcgctcgtttggcgcgcggccctaggcggcggatctaagctaacttcttggatcttttcttgtttctccttggtttttgactttttctggaccctggtgtctacgatttccgagatgccgtcttctttgttgggcgcggcgatgccggcctctacatctgccgcagccctgcaggaagctctggaaaatgctggacggctcatcgaccgtcagttgcaagaggaccgcatgtacccggacctttccgagctgcttatggtgtctgccccaaataatcccaccgtttctggcatgtcagatatggattatcctttacaaggacctggtttgctgtccgtacccaaccttccagagatcagttccatccgaagagttcctctcccacctgaacttgttgagcagtttggacatatgcagtgtaattgcatgatgggtgtgttccctcctatcagcagagcttggctcacaattgacagtgatatattcatgtggaactatgaggatggaggagaccttgcctattttgatggacttagtgagactattcttgctgtggggcttgtgaagccaaaagcaggcatctttcaacctcatgtgcgacacctcctggttttggcgacccctgtagacatagtaattcttggactcagctatgctaatttgcaaacaggttctggagttcttaatgatagtttgtctggtggaatgcagttgcttccagatcctttatattctcttcctactgataatacttaccttttaacaataacttccactgataatggcagaattttcttggctggaaaggatggctgtttatatgaagtagcctaccaggctgaagcagggtggtttagccaaagatgtaggaaaataaaccactcaaagagctcactttctttccttgttccttccttgctacaattcacgttctcagaagatgatcctattcttcaaattgcaattgataattctagaaatattttatatacacgatctgagaaaggagtaatacaggtgtatgatttgggacaagatggacaaggaatgagcagagttgcctctgtgtcacagaatgccattgtctctgctgctggtaacattgctaggaccatcgatcgttctgtttttaaaccaattgtccaaatagcagtgattgaaaattctgaatcactggactgtcagttattggctgtcacacatgcaggtgttaggttatattttagcacttgtccattcagacagccattagcacggcctaatacactgacgctggttcatgtccgcttacctcctggattctcagcatcttcaaccgtggaaaagccttcaaaagtacatagagctctttatagtaaaggtattctattgatggcagcctcagaaaatgaggataatgatattttatggtgtgtcaaccatgatacttttcctttccaaaagccaatgatggaaacccagatgacagctggtgttgatggtcattcctgggctctttctgcgatagatgaattgaaagtagataaaataattacacctttaaacaaggatcatattccaataactgattcaccagttgttgtacagcagcacatgttacctccgaagaaatttgttctcctctcagcacaggggagccttatgtttcataaacttagacctgtagatcaactgaggcatctacttgtgagtaatgtgggaggagatggagaagagattgaaagattctttaaattacatcaggaagaccaggcttgtgcaacttgccttattcttgcttgctccactgctgcctgtgatagagaagtatctgcctgggctactcgggctttctttaggtatggtggtgaagcacagatgagatttccaaccactcttccgcctccaagtaatgttggtcccatcttggggtctcctgtctattctagttctcctgttcctagtggtagtccctatccaaatccatcctttttgggaacaccgtctcatggtatacagcctcctgccatgtcaactccagtgtgtgctctgggaaacccagcaactcaggccacaaatatgagttgtgtgactggaccagagattgtgtactctggaaaacacaatggtatttgcatttacttttctcggatcatgggaaacatttgggatgcaagcttagttgtggagagaatattcaagagtggcaacagagagatcactgcaattgaaagtagtgttccctgccaactgctagagtcagtgctacaagaactaaagggtttgcaggaatttctagacagaaactcccagtttgcaggaggaccattaggaaatccaaatactactgctaaagtgcagcagaggctgataggattcatgcgtcctgaaaacggaaatccccagcaaatgcaacaggaactgcagaggaagtttcatgaggctcaactaagtgaaaagatttcacttcaggcaattcagcagttggttcgaaaatcatatcaggctctggctttatggaaacttctttgtgaacatcaattcactatcattgtggcagaacttcagaaggaacttcaagagcagctgaagatcaccacctttaaagatcttgtaatcagggacaaagaactcacaggggcattaattgcttctcttatcaactgctacatcagagataatgccgctgttgatggcattagtttacatttacaggatatctgcccacttctatatagcactgatgatgcaatttgttctaaggcaaatgagcttctccagcgttcccgacaagttcaaaataagactgaaaaagaaagaatgttaagggaatcattaaaggaatatcaaaaaattagcaatcaagtggacctttccaatgtttgtgctcagtatagacaagtgagattttatgagggtgtggtggaactttctcttacggctgcagagaaaaaagatcctcaaggtcttgggcttcatttctataaacatggagaaccagaagaagacatagttggacttcaggccttccaagaaagattaaacagttacaaatgcattacagacacacttcaagaactggtaaatcaaagtaaggccgctcctcagtctcccagtgtacccaaaaaacctggtcctccagtgttgtcatctgatccaaatatgctgagtaatgaagaagcaggacatcattttgaacaaatgcttaaattgtcacagcgatccaaggatgagctctttagtattgccctttataattggctaatacaagtcgaccttgcagataagctgctacaggttgcttctccatttctggagccacatctagtccgaatggccaaagttgatcaaaacagagttcgttatatggatttactctggcggtattacgagaagaacagaagtttcagtaatgctgctcgtgtactgtccagactggctgacatgcatagcacagaaatttcacttcagcagcgactagagtacattgctcgagccattcttagtgccaaaagttccactgccatttcatcaatagctgccgatggtgaatttcttcatgaattagaagaaaaaatggaggttgctaggatccaacttcagatacaggagacactacaaaggcagtattcccatcattcttctgtacaggatgcagtttctcagctggattctgagctgatggacataactaagctttatggggaatttgctgacccatttaaacttgcagagtgcaaacttgcaataattcattgtgccggttattcagaccctatattggtgcagacactttggcaagatatcatagagaaagaattgagtgacagtgtgacattgagctcctcggatagaatgcatgctcttagtctcaagattgttctccttggcaaaatttatgctggcacaccacgcttctttcctttagattttattgtacagtttttagaacagcaggtttgtactttgaactgggatgtgggcttcgtaatacagacaatgaatgaaattggagtaccattacctagactactagaagtttatgatcagttgttcaaatcacgggatccattctggaacagaatgaagaagccactgcaccttttggattgtatacatgtattattgataagatatgttgagaatcccagccaagttttaaattgtgaaaggagaagatttacaaatctctgcctggatgctgtttgtggttaccttgttgagctccagtctatgagctcgtcagtagcagtacaagccatcactgggaattttaaatctcttcaagctaaattagaacggcttcattaattactgtgatatactttcatccgttttatgatctgtaaaataaaaactcagctgggtccagatatcaggtgttctaaatctaagaatgtaagaacaatcttaatagaaatatgtttttaataagtggctaatatctacaaatagtacctttgctaaatgaaaaaacagacaaaacaaaaagacacaaaaaaaaaaaaaaaaaaaaaaaaaaaacagcaaaaaacagaacataccaaaaaaacccaggggggggggggggcaagatccgatcctggtgggcgacacagtgccacgcgaaccgctataaggcaaaaagagggcacacatcgagggcgctagaacaaccacgcacagcggaaaacgaagagaagcgaagagaaaaacaaaggcaacccgagaggaaagggaaaagaacgtatccagaaggaagcactcacaagcaagagagagaggacaacaacaactagcacaacaatacacaacacaagacaagacacagcccgctgagcaacgaagaagaagatacgcaggagaagaagt

SEQ ID NO: 26927 - DNA, 3063 bp, Homo sapiens
agaacggcgtcttccagttccccaccggatgaagcggaagtgcgtcatgtcgaggcgccaaggcgctcgtttggcgcgcggccctaggcggcggatctaagctaacttcttggatcttttcttgtttctccttggtttttgactttttctggaccctggtgtctacgatttccgagatgccgtcttctttgttgggcgcggcgatgccggcctctacatctgccgcagccctgcaggaagctctggaaaatgctggacggctcatcgaccgtcagttgcaagaggaccgcatgtacccggacctttccgagctgcttatggtgtctgccccaaataatcccaccgtttctggcatgtcagatatggattatcctttacaaggacctggtttgctgtccgtacccaaccttccagagatcagttccatccgaagagttcctctcccacctgaacttgttgagcagtttggacatatgcagtgtaattgcatgatgggtgtgttccctcctatcagcagagcttggctcacaattgacagtgatatattcatgtggaactatgaggatggaggagaccttgcctattttgatggacttagtgagactattcttgctgtggggcttgtgaagccaaaagcaggcatctttcaacctcatgtgcgacacctcctggttttggcgacccctgtagacatagtaattcttggactcagctatgctaatttgcaaacaggttctggagttcttaatgatagtttgtctggtggaatgcagttgcttccagatcctttatattctcttcctactgataatacttaccttttaacaataacttccactgataatggcagaattttcttggctggaaaggatggctgtttatatgaagtagcctaccaggctgaagcagggtggtttagccaaagatgtaggaaaataaaccactcaaagagctcactttctttccttgttccttccttgctacaattcacgttctcagaagatgatcctattcttcaaattgcaattgataattctagaaatattttatatacacgatctgagaaaggagtaatacaggtgtatgatttgggacaagatggacaaggaatgagcagagttgcctctgtgtcacagaatgccattgtctctgctgctggtaacattgctaggaccatcgatcgttctgtttttaaaccaattgtccaaatagcagtgattgaaaattctgaatcactggactgtcagttattggctgtcacacatgcaggtgttaggttatattttagcacttgtccattcagacagccattagcacggcctaatacactgacgctggttcatgtccgcttacctcctggattctcagcatcttcaaccgtggaaaagccttcaaaagtacatagagctctttatagtaaaggtattctattgatggcagcctcagaaaatgaggataatgatattttatggtgtgtcaaccatgatacttttcctttccaaaagccaatgatggaaacccagatgacagctggtgttgatggtcattcctgggctctttctgcgatagatgaattgaaagtagataaaataattacacctttaaacaaggatcatattccaataactgattcaccagttgttgtacagcagcacatgttacctccgaagaaatttgttctcctctcagcacaggggagccttatgtttcataaacttagacctgtagatcaactgaggcatctacttgtgagtaatgtgggaggagatggagaagagattgaaagattctttaaattacatcaggaagaccaggcttgtgcaacttgccttattcttgcttgctccactgctgcctgtgatagagaagtatctgcctgggctactcgggctttctttaggtatggtggtgaagcacagatgagatttccaaccactcttccgcctccaagtaatgttggtcccatcttggggtctcctgtctattctagttctcctgttcctagtggtagtccctatccaaatccatcctttttgggaacaccgtctcatggtatacagcctcctgccatgtcaactccagtgtgtgctctgggaaacccagcaactcaggccacaaatatgagttgtgtgactggaccagagattgtgtactctggaaaacacaatggtatttgcatttacttttctcggatcatgggaaacatttgggatgcaagcttagttgtggagagaatattcaagagtggcaacagagagatcactgcaattgaaagtagtgttccctgccaactgctagagtcagtgctacaagaactaaagggtttgcaggaatttctagacagaaactcccagtttgcaggaggaccattaggaaatccaaatactactgctaaagtgcagcagaggctgataggattcatgcgtcctgaaaacggaaatccccagcaaatgcaacaggaactgcagaggaagtttcatgaggctcaactaagtgaaaagatttcacttcaggcaattcagcagttggttcgaaaatcatatcaggctctggctttatggaaacttctttgtgaacatcaattcactatcattgtggcagaacttcagaaggaacttcaagagcagctgaagatcaccacctttaaagatcttgtaatcagggacaaagaactcacaggggcattaattgcttctcttatcaactgctacatcagagataatgccgctgttgatggcattagtttacatttacaggatatctgcccacttctatatagcactgatgatgcaatttgttctaaggcaaatgagcttctccagcgttcccgacaagttcaaaataagactgaaaaagaaagaatgttaagggaatcattaaaggaatatcaaaaaattagcaatcaagtggaccttccatggtcgggcccggataaccagtgaaatcataagggtcggggacctacctaacggtggcaaaaagaacccgggcagggcacaactaaagcgggaccaacatggagacaccctcaacagacacaaccggtcaacaccacacggcgcc

SEQ ID NO: 26928 - DNA, 788 bp, Homo sapiens
gtatgtatttaaggctggtttgctttaagggtgattggaatttatataaactttactgtagctagtgttctcattagaagctgcttggtttatctttcattcatctagcctttgggtcagtgcttctcagtatcagtcatctggagatgttcaaatgtgcattctgtcttagtagtcctgagtgaggctcaagagtctgcatttctaacaagctgccaactgctgctgctggtttaggtgccattcttgagtggcaggagcccgggtcccaagctgttagcccgtagtaaaaatagatgttggcaattcattgagagatgattggacatttttaaagacttctgttttccttgcatttctatggagtaggcatgtgatatttatttattttgttgtcattttgtgaatttgacccgtgtgtaaattatatgtatagaaatgattctgagtgaaagcctaaggtacttttgcttaaatacagcatgttggtctggtgatctccctgttgactttttagagatagattttgttttacttccagttgtccattacattatccttagatgaggtgtgggataaacataggaaagcccatataattaagatgttactcttgttcctgagtaattaatgatctttttaggaacacacgtgcattaaaaagacactgtatcggccgagcacgctgactcaaacgcctataatcccagcactttgggaggctgaggtgggtggatcacctgaggtcaggagtccgagaccagcctggccaacatggagaaaccctg

SEQ ID NO: 26929 - DNA, 500 bp, Homo sapiens
agtggctgaatcttagctcactgcaacctccatcccctgggtttaagcagttctcctgcctcagcctcccaatagctgggattacaggtgtgcaccaccacatccagctaatttttgtgtttttattagaggcagagtttcatcatgttggctaggctggtctcgaactcctgacctcaaatgatccacctgccttggcctcccaaagtgctaggatttacaggtgcgagccactgtgcccagcccataactggcttttcatctaacagtatgtcttgaaattctttccttgtcagtatttggttgatattttaaattatgggctaaactcagtagttaattttgaataatatgtctcgttttgttgattataactggtattagtgattataactggtatttcatgaagatttgaaggtttttataaatatggatatacaatagttattgtaagggagttacatacttttataagtcttctttctacttttttctttaag

SEQ ID NO: 26930 - DNA, 517 bp, Homo sapiens
tgcttcactattaatctctgaatgttgatctctagttggatgttaattttgggattttctctcacagctttatggggaatttgctgacccatttaaacttgcagagtgcaaacttgcaataattcattgtgccggttattcagaccctatattggtgcagacactttggcaagatatcatagagaaaggtaagtgttcagttataggtatgttagcatacgttatgtagtgacttggtggaggaatgcaagctgctagtaactaatataatgcaagctgctagtggctcatgaaaattgtgtatacctaagaagagagtaagtggaagtcacctgggtatggtggaggatgatcatacacagaatgacccaagtgaatattcgggagaatactcagtgaaaaggttatttaatttatattatttgtgctgccttataaaagatactgagacactcacctcagaatctaataaccagtataacctggtaagacatgagagtatctcagacaataacag

SEQ ID NO: 26931 - DNA, 4200 bp, Homo sapiens
gactctcgcctgacttcctaatttgctacttatccccagcgttggtcccggcgaggatatgctgagatttatggcactgttggctgcatttttggagaacagcaagcagcttcttttcagataatcccaccgtttctggcatgtcagatatggattatcctttacaaggacctggtttgctgtccgtacccaaccttccagagatcagttccatccgaagagttcctctcccacctgaacttgttgagcagtttggacatatgcagtgtaattgcatgatgggtgtgttccctcctatcagcagagcttggctcacaattgacagtgatatattcatgtggaactatgaggatggaggagaccttgcctattttgatggacttagtgagactattcttgctgtggggcttgtgaagccaaaagcaggcatctttcaacctcatgtgcgacacctcctggttttggcgacccctgtagacatagtaattcttggactcagctatgctaatttgcaaacaggttctggagttcttaatgatagtttgtctggtggaatgcagttgcttccagatcctttatattctcttcctactgataatacttaccttttaacaataacttccactgataatggcagaattttcttggctggaaaggatggctgtttatatgaagtagcctaccaggctgaagcagggtggtttagccaaagatgtaggaaaataaaccactcaaagagctcactttctttccttgttccttccttgctacaattcacgttctcagaagatgatcctattcttcaaattgcaattgataattctagaaatattttatatacacgatctgagaaaggagtaatacaggtgtatgatttgggacaagatggacaaggaatgagcagagttgcctctgtgtcacagaatgccattgtctctgctgctggtaacattgctaggaccatcgatcgttctgtttttaaaccaattgtccaaatagcagtgattgaaaattctgaatcactggactgtcagttattggctgtcacacatgcaggtgttaggttatattttagcacttgtccattcagacagccattagcacggcctaatacactgacgctggttcatgtccgcttacctcctggattctcagcatcttcaaccgtggaaaagccttcaaaagtacatagagctctttatagtaaaggtattctattgatggcagcctcagaaaatgaggataatgatattttatggtgtgtcaaccatgatacttttcctttccaaaagccaatgatggaaacccagatgacagctggtgttgatggtcattcctgggctctttctgcgatagatgaattgaaagtagataaaataattacacctttaaacaaggatcatattccaataactgattcaccagttgttgtacagcagcacatgttacctccgaagaaatttgttctcctctcagcacaggggagccttatgtttcataaacttagacctgtagatcaactgaggcatctacttgtgagtaatgtgggaggagatggagaagagattgaaagattctttaaattacatcaggaagaccaggcttgtgcaacttgccttattcttgcttgctccactgctgcctgtgatagagaagtatctgcctgggctactcgggctttctttaggtatggtggtgaagcacagatgagatttccaaccactcttccgcctccaagtaatgttggtcccatcttggggtctcctgtctattctagttctcctgttcctagtggtagtccctatccaaatccatcctttttgggaacaccgtctcatggtatacagcctcctgccatgtcaactccagtgtgtgctctgggaaacccagcaactcaggccacaaatatgagttgtgtgactggaccagagattgtgtactctggaaaacacaatggtatttgcatttacttttctcggatcatgggaaacatttgggatgcaagcttagttgtggagagaatattcaagagtggcaacagagagatcactgcaattgaaagtagtgttccctgccaactgctagagtcagtgctacaagaactaaagggtttgcaggaatttctagacagaaactcccagtttgcaggaggaccattaggaaatccaaatactactgctaaagtgcagcagaggctgataggattcatgcgtcctgaaaacggaaatccccagcaaatgcaacaggaactgcagaggaagtttcatgaggctcaactaagtgaaaagatttcacttcaggcaattcagcagttggttcgaaaatcatatcaggctctggctttatggaaacttctttgtgaacatcaattcactatcattgtggcagaacttcagaaggaacttcaagagcagctgaagatcaccacctttaaagatcttgtaatcagggacaaagaactcacaggggcattaattgcttctcttatcaactgctacatcagagataatgccgctgttgatggcattagtttacatttacaggatatctgcccacttctatatagcactgatgatgcaatttgttctaaggcaaatgagcttctccagcgttcccgacaagttcaaaataagactgaaaaagaaagaatgttaagggaatcattaaaggaatatcaaaaaattagcaatcaagtggacctttccaatgtttgtgctcagtatagacaagtgagattttatgagggtgtggtggaactttctcttacggctgcagagaaaaaagatcctcaaggtcttgggcttcatttctataaacatggagaaccagaagaagacatagttggacttcaggccttccaagaaagattaaacagttacaaatgcattacagacacacttcaagaactggtaaatcaaagtaaggccgctcctcagtctcccagtgtacccaaaaaacctggtcctccagtgttgtcatctgatccaaatatgctgagtaatgaagaagcaggacatcattttgaacaaatgcttaaattgtcacagcgatccaaggatgagctctttagtattgccctttataattggctaatacaagtcgaccttgcagataagctgctacaggttgcttctccatttctggagccacatctagtccgaatggccaaagttgatcaaaacagagttcgttatatggatttactctggcggtattacgagaagaacagaagtttcagtaatgctgctcgtgtactgtccagactggctgacatgcatagcacagaaatttcacttcagcagcgactagagtacattgctcgagccattcttagtgccaaaagttccactgccatttcatcaatagctgccgatggtgaatttcttcatgaattagaagaaaaaatggaggttgctaggatccaacttcagatacaggagacactacaaaggcagtattcccatcattcttctgtacaggatgcagtttctcagctggattctgagctgatggacataactaagctttatggggaatttgctgacccatttaaacttgcagagtgcaaacttgcaataattcattgtgccggttattcagaccctatattggtgcagacactttggcaagatatcatagagaaagaattgagtgacagtgtgacattgagctcctcggatagaatgcatgctcttagtctcaagattgttctccttggcaaaatttatgctggcacaccacgcttctttcctttagattttattgtacagtttttagaacagcaggtttgtactttgaactgggatgtgggcttcgtaatacagacaatgaatgaaattggagtaccattacctagactactagaagtttatgatcagttgttcaaatcacgggatccattctggaacagaatgaagaagccactgcaccttttggattgtatacatgtattattgataagatatgttgagaatcccagccaagttttaaattgtgaaaggagaagatttacaaatctctgcctggatgctgtttgtggttaccttgttgagctccagtctatgagctcgtcagtagcagtacaagccatcactgggaattttaaatctcttcaagctaaattagaacggcttcattaattactgtgatatactttcatccgttttatgatctgtaaaataaaaactcagctgggtccag

SEQ ID NO: 26932 - DNA, 5160 bp, Homo sapiens
agaacggcgtcttccagttccccaccggatgaagcggaagtgcgtcatgtcgaggcgccaaggcgctcgtttggcgcgcggccctaggcggcggatctaagctaacttcttggatcttttcttgtttctccttggtttttgactttttctggaccctggtgtctacgatttccgagatgccgtcttctttgttgggcgcggcgatgccggcctctacatctgccgcagccctgcaggaagctctggaaaatgctggacggctcatcgaccgtcagttgcaagaggaccgcatgtacccggacctttccgagctgcttatggtgtctgccccaaataatcccaccgtttctggcatgtcagatatggattatcctttacaaggacctggtttgctgtccgtacccaaccttccagagatcagttccatccgaagagttcctctcccacctgaacttgttgagcagtttggacatatgcagtgtaattgcatgatgggtgtgttccctcctatcagcagagcttggctcacaattgacagtgatatattcatgtggaactatgaggatggaggagaccttgcctattttgatggacttagtgagactattcttgctgtggggcttgtgaagccaaaagcaggcatctttcaacctcatgtgcgacacctcctggttttggcgacccctgtagacatagtaattcttggactcagctatgctaatttgcaaacaggttctggagttcttaatgatagtttgtctggtggaatgcagttgcttccagatcctttatattctcttcctactgataatacttaccttttaacaataacttccactgataatggcagaattttcttggctggaaaggatggctgtttatatgaagtagcctaccaggctgaagcagggtggtttagccaaagatgtaggaaaataaaccactcaaagagctcactttctttccttgttccttccttgctacaattcacgttctcagaagatgatcctattcttcaaattgcaattgataattctagaaatattttatatacacgatctgagaaaggagtaatacaggtgtatgatttgggacaagatggacaaggaatgagcagagttgcctctgtgtcacagaatgccattgtctctgctgctggtaacattgctaggaccatcgatcgttctgtttttaaaccaattgtccaaatagcagtgattgaaaattctgaatcactggactgtcagttattggctgtcacacatgcaggtgttaggttatattttagcacttgtccattcagacagccattagcacggcctaatacactgacgctggttcatgtccgcttacctcctggattctcagcatcttcaaccgtggaaaagccttcaaaagtacatagagctctttatagtaaaggtattctattgatggcagcctcagaaaatgaggataatgatattttatggtgtgtcaaccatgatacttttcctttccaaaagccaatgatggaaacccagatgacagctggtgttgatggtcattcctgggctctttctgcgatagatgaattgaaagtagataaaataattacacctttaaacaaggatcatattccaataactgattcaccagttgttgtacagcagcacatgttacctccgaagaaatttgttctcctctcagcacaggggagccttatgtttcataaacttagacctgtagatcaactgaggcatctacttgtgagtaatgtgggaggagatggagaagagattgaaagattctttaaattacatcaggaagaccaggcttgtgcaacttgccttattcttgcttgctccactgctgcctgtgatagagaagtatctgcctgggctactcgggctttctttaggtatggtggtgaagcacagatgagatttccaaccactcttccgcctccaagtaatgttggtcccatcttggggtctcctgtctattctagttctcctgttcctagtggtagtccctatccaaatccatcctttttgggaacaccgtctcatggtatacagcctcctgccatgtcaactccagtgtgtgctctgggaaacccagcaactcaggccacaaatatgagttgtgtgactggaccagagattgtgtactctggaaaacacaatggtatttgcatttacttttctcggatcatgggaaacatttgggatgcaagcttagttgtggagagaatattcaagagtggcaacagagagatcactgcaattgaaagtagtgttccctgccaactgctagagtcagtgctacaagaactaaagggtttgcaggaatttctagacagaaactcccagtttgcaggaggaccattaggaaatccaaatactactgctaaagtgcagcagaggctgataggattcatgcgtcctgaaaacggaaatccccagcaaatgcaacaggaactgcagaggaagtttcatgaggctcaactaagtgaaaagatttcacttcaggcaattcagcagttggttcgaaaatcatatcaggctctggctttatggaaacttctttgtgaacatcaattcactatcattgtggcagaacttcagaaggaacttcaagagcagctgaagatcaccacctttaaagatcttgtaatcagggacaaagaactcacaggggcattaattgcttctcttatcaactgctacatcagagataatgccgctgttgatggcattagtttacatttacaggatatctgcccacttctatatagcactgatgatgcaatttgttctaaggcaaatgagcttctccagcgttcccgacaagttcaaaataagactgaaaaagaaagaatgttaagggaatcattaaaggaatatcaaaaaattagcaatcaagtggacctttccaatgtttgtgctcagtatagacaagtgagattttatgagggtgtggtggaactttctcttacggctgcagagaaaaaagatcctcaaggtcttgggcttcatttctataaacatggagaaccagaagaagacatagttggacttcaggccttccaagaaagattaaacagttacaaatgcattacagacacacttcaagaactggtaaatcaaagtaaggccgctcctcagtctcccagtgtacccaaaaaacctggtcctccagtgttgtcatctgatccaaatatgctgagtaatgaagaagcaggacatcattttgaacaaatgcttaaattgtcacagcgatccaaggatgagctctttagtattgccctttataattggctaatacaagtcgaccttgcagataagctgctacaggttgcttctccatttctggagccacatctagtccgaatggccaaagttgatcaaaacagagttcgttatatggatttactctggcggtattacgagaagaacagaagtttcagtaatgctgctcgtgtactgtccagactggctgacatgcatagcacagaaatttcacttcagcagcgactagagtacattgctcgagccattcttagtgccaaaagttccactgccatttcatcaatagctgccgatggtgaatttcttcatgaattagaagaaaaaatggaggttgctaggatccaacttcagatacaggagacactacaaaggcagtattcccatcattcttctgtacaggatgcagtttctcagctggattctgagctgatggacataactaagctttatggggaatttgctgacccatttaaacttgcagagtgcaaacttgcaataattcattgtgccggttattcagaccctatattggtgcagacactttggcaagatatcatagagaaagaattgagtgacagtgtgacattgagctcctcggatagaatgcatgctcttagtctcaagattgttctccttggcaaaatttatgctggcacaccacgcttctttcctttagattttattgtacagtttttagaacagcaggtttgtactttgaactgggatgtgggcttcgtaatacagacaatgaatgaaattggagtaccattacctagactactagaagtttatgatcagttgttcaaatcacgggatccattctggaacagaatgaagaagccactgcaccttttggattgtatacatgtattattgataagatatgttgagaatcccagccaagttttaaattgtgaaaggagaagatttacaaatctctgcctggatgctgtttgtggttaccttgttgagctccagtctatgagctcgtcagtagcagtacaagccatcactgggaattttaaatctcttcaagctaaattagaacggcttcattaattactgtgatatactttcatccgttttatgatctgtaaaataaaaactcagctgggtccagatatcaggtgttctaaatctaagaatgtaagaacaatcttaatagaaatatgtttttaataagtggctaatatctacaaatagtacctttgctaaatgaattcttttttatgactattttgttttttagtaattgggtgaaaaaacaactgaaatgagattatttattattttaacataaggattaaaaaaatttagaaactcttattttgaattgtactgcaggcagaaatttcgaatttatattattcattttcaagttagtccaaggatattggcattaaaactccacaggctggtcttgaactcctgacctcaagtgatctgcccgcctccacctcccaaagtgttgagattacagacgtgagccaatgtgcctggcctattcccttctctctttatgctaccacaaataattaccttctgtttattgtaagtgatgcatgtctaacaatttgtacaatacattttgaatatatttttccttccattattgtcttttcccaagaccatagggttgccttctctacatttgttctcttagaattcagctcccttttccctataatcttctaatgtagaatatttaatagaatgccagaacgtcactcagtgggtactactacctcttatttttcaacttttcagtttcttaagtttagcgttttttgaatatgtaaagtgaatgtatgcgatacattaattcgttttataaatttaaaattctgtcatgtctacttaaaaggaa

SEQ ID NO: 26933 - DNA, 3900 bp, Homo sapiens
agaacggcgtcttccagttccccaccggatgaagcggaagtgcgtcatgtcgaggcgccaaggcgctcgtttggcgcgcggccctaggcggcggatctaagctaacttcttggatcttttcttgtttctccttggtttttgactttttctggaccctggtgtctacgatttccgagatgccgtcttctttgttgggcgcggcgatgccggcctctacatctgccgcagccctgcaggaagctctggaaaatgctggacggctcatcgaccgtcagttgcaagaggaccgcatgtacccggacctttccgagctgcttatggtgtctgccccaaataatcccaccgtttctggcatgtcagatatggattatcctttacaaggacctggtttgctgtccgtacccaaccttccagagatcagttccatccgaagagttcctctcccacctgaacttgttgagcagtttggacatatgcagtgtaattgcatgatgggtgtgttccctcctatcagcagagcttggctcacaattgacagtgatatattcatgtggaactatgaggatggaggagaccttgcctattttgatggacttagtgagactattcttgctgtggggcttgtgaagccaaaagcaggcatctttcaacctcatgtgcgacacctcctggttttggcgacccctgtagacatagtaattcttggactcagctatgctaatttgcaaacaggttctggagttcttaatgatagtttgtctggtggaatgcagttgcttccagatcctttatattctcttcctactgataatacttaccttttaacaataacttccactgataatggcagaattttcttggctggaaaggatggctgtttatatgaagtagcctaccaggctgaagcagggtggtttagccaaagatgtaggaaaataaaccactcaaagagctcactttctttccttgttccttccttgctacaattcacgttctcagaagatgatcctattcttcaaattgcaattgataattctagaaatattttatatacacgatctgagaaaggagtaatacaggtgtatgatttgggacaagatggacaaggaatgagcagagttgcctctgtgtcacagaatgccattgtctctgctgctggtaacattgctaggaccatcgatcgttctgtttttaaaccaattgtccaaatagcagtgattgaaaattctgaatcactggactgtcagttattggctgtcacacatgcaggtgttaggttatattttagcacttgtccattcagacagccattagcacggcctaatacactgacgctggttcatgtccgcttacctcctggattctcagcatcttcaaccgtggaaaagccttcaaaagtacatagagctctttatagtaaaggtattctattgatggcagcctcagaaaatgaggataatgatattttatggtgtgtcaaccatgatacttttcctttccaaaagccaatgatggaaacccagatgacagctggtgttgatggtcattcctgggctctttctgcgatagatgaattgaaagtagataaaataattacacctttaaacaaggatcatattccaataactgattcaccagttgttgtacagcagcacatgttacctccgaagaaatttgttctcctctcagcacaggggagccttatgtttcataaacttagacctgtagatcaactgaggcatctacttgtgagtaatgtgggaggagatggagaagagattgaaagattctttaaattacatcaggaagaccaggcttgtgcaacttgccttattcttgcttgctccactgctgcctgtgatagagaagtatctgcctgggctactcgggctttctttaggtatggtggtgaagcacagatgagatttccaaccactcttccgcctccaagtaatgttggtcccatcttggggtctcctgtctattctagttctcctgttcctagtggtagtccctatccaaatccatcctttttgggaacaccgtctcatggtatacagcctcctgccatgtcaactccagtgtgtgctctgggaaacccagcaactcaggccacaaatatgagttgtgtgactggaccagagattgtgtactctggaaaacacaatggtatttgcatttacttttctcggatcatgggaaacatttgggatgcaagcttagttgtggagagaatattcaagagtggcaacagagagatcactgcaattgaaagtagtgttccctgccaactgctagagtcagtgctacaagaactaaagggtttgcaggaatttctagacagaaactcccagtttgcaggaggaccattaggaaatccaaatactactgctaaagtgcagcagaggctgataggattcatgcgtcctgaaaacggaaatccccagcaaatgcaacaggaactgcagaggaagtttcatgaggctcaactaagtgaaaagatttcacttcaggcaattcagcagttggttcgaaaatcatatcaggctctggctttatggaaacttctttgtgaacatcaattcactatcattgtggcagaacttcagaaggaacttcaagagcagctgaagatcaccacctttaaagatcttgtaatcagggacaaagaactcacaggggcattaattgcttctcttatcaactgctacatcagagataatgccgctgttgatggcattagtttacatttacaggatatctgcccacttctatatagcactgatgatgcaatttgttctaaggcaaatgagcttctccagcgttcccgacaagttcaaaataagactgaaaaagaaagaatgttaagggaatcattaaaggaatatcaaaaaattagcaatcaagtggacctttccaatgtttgtgctcagtatagacaagtgagattttatgagggtgtggtggaactttctcttacggctgcagagaaaaaagatcctcaaggtcttgggcttcatttctataaacatggagaaccagaagaagacatagttggacttcaggccttccaagaaagattaaacagttacaaatgcattacagacacacttcaagaactggtaaatcaaagtaaggccgctcctcagtctcccagtgtacccaaaaaacctggtcctccagtgttgtcatctgatccaaatatgctgagtaatgaagaagcaggacatcattttgaacaaatgcttaaattgtcacagcgatccaaggatgagctctttagtattgccctttataattggctaatacaagtcgaccttgcagataagctgctacaggttgcttctccatttctggagccacatctagtccgaatggccaaagttgatcaaaacagagttcgttatatggatttactctggcggtattacgagaagaacagaagtttcagtaatgctgctcgtgtactgtccagactggctgacatgcatagcacagaaatttcacttcagcagcgactagagtacattgctcgagccattcttagtgccaaaagttccactgccatttcatcaatagctgccgatggtgaatttcttcatgaattagaagaaaaaatggaggttgctaggatccaacttcagatacaggagacactacaaaggcagtattcccatcattcttctgtacaggatgcagtttctcagctggattctgagctgatggacataactaaggtaataaaaaagcaagtgaaatttttatagtagttacctaataatgagaaatttttgttttttattttgctttttgtttcatggggaaaattaccttatctccacaaataagataaggcatctttggcagcttgtcactgggctgacagatcaccactgcttc

SEQ ID NO: 26934 - DNA, 1406 bp, Homo sapiens
aacaactatgaaaataatcttaaagcattattactcccatatacatgccagcaaacccaattgtggagagaacatgattactttttatctgacattatcctataaggatatggctacatttatttcttttaaaattggagcagttttcaattactttttaacagaattgttttcaacacagcattttgcagtgcccataaaccatagcaactttgtcctgatcgatacatatttttctgcattattattcattagcctctttgcaaactcactaaaatagaatagtattaaagtatgaatatatagagaacaattattaggttctacatatttatttaggtaaaccaatgttattaaaattaaaaacatgtgcctggcatataagtgcttcttcaggaattcttttttggatgcatagttattattttttaaacaaactcagattttcaaacactgattttcttctctgaacgggcattgcattgttttaaacagtagctcctggaataatgccacctttagtattttagactttcaaacaacaattggaattggataaatgctttcagctgggagcactttcctaatacctttgtaggtaatgggattctctatttgtgctgggtgacaaacggacagtgccctggacagactgcctaccctctgcagaatctaccaaaaagtagagttttcccatgagactgcttgtggtccatctaaaaatgaaaaaataatcagagaaaatgcgcaaagccttttctaactacagttatgaaatgatggcttaaagaggtatttagaaaataagagtggagtaatacagaaacaaaatctgaagaagaaagtttgcttaggagctgatgctctttgtctacaaacaagagggtaaggagctggatccaattgaattgaattgtttttgtttgcttgtttgttttcttccattcagtgcctttcaaactgttttttactggatgaagaaactcaaccaagaaaatatatgtcgattcttgtatatgggacaatattagctgctgtgatttttaatactagcataaaatataagaatctttttattactgtgatattgttttttcctaaatgaatgcatagtgtaacaattggtgtcaaaaagcattgaatttttttcagatggattaagctggaataataaagtatatctatgagatgatttctgtaaactctgacttgctgagaaaaaagtgaaaaagctttttctggaagaaacatggcaacttaaccgttattaatctggactaaataaaacaggaaactgcttctttacatttctagtaattttttctgcttttccaaacattgttaagttctatgcaacttgtgctattcaagtaaagatgatgtcagtaataaaattacagaatcta

SEQ ID NO: 26935 - DNA, 1703 bp, Homo sapiens
gcttcactattaaaatattttccccccaagtctcaaatattgaagaatctctaaccagggacaccagtccctacgaagaccttgggcgattttgaagtgcgggcacctcgattccccgaatctgtagtgtggctggtatcggtgttcccctggtttaactagcctgtttgaaggcacagatcattcatggggatgtataaccgaaaccagtcctctccaccgcctggggatcttcactttcgcagtctacgactgcctgtgactccagaaagacaaactgcagattggccaagctgcctgaagacccagcccgacagcgatgcctgtcagcccgcgtcgcccaccagggcagctgctctcccaactcgcatggggggcaccaccccgcctcggtgccctagagctgagcgcagccgcggctccacggggatcgccagggcctcagccctcgcggccggcggcgcgggagtgttgcggggcagggaccagagcgcgatcagagcggccacccccgatttaggtcgccagctttccagtcactgcgatggccactggggcgccccttccatcctggttaaattctcattgtgatccccagccctcttctcggttccccacacccaggaggccggttctccgccgctcaggctgggagaggtcaccgctccgggcagggtggacccccagctccgtctcggaggacctttcgccggaggcgagcaggaaggggttaaccatgagcctcccaccctcacctcccagaccctggtgccgggctaaggcctccgcttccctcctgaggtctcattaggaaaccctcaccgctattttcaacatttcctcaatcaagtgcctttaaatagagctgcacaaacagattggcggcaaaagcgtagatcttgtcacgattgagaccaatccagtatttcagccttgtttgctttgcaattacgggttggcttgtggctacggtgccaccggggcaaatctgcagccgctcgctttctcctctgcgctccgggcgggtggaggaagcgacccgcggagtcactgcagggaggagagggggacgcgcgcggggggaggcggcggagggcggaggagactcgcttgcaccccagggccgcgggcacgcagagctgtgttgaaggacatacttttcaggttcctgacagtcactgagctatacgcaataataaagtgcgtgattcgcgtgtggaaaccagtgtcgtgtccttaccagcttccttttctgtccaccttccctctctcttctacctccgtttcgcttttcttcagtgcatgttagcggtttgctggatttcccttctccctcgctgttcaactgctagcatgatttgttacattttccacagctgtttattcttgtttgactttttgtacaaagtcactttaaatctgctgcagaaagaataaagcacctagccctttggatggactcctgcaggcgtgtggctgtccctggcccacttttaattctttggagatggctcttctgtgtaaatcagctgctgggtgcgttcggtcacctcgtaggccagcctagtttgtatcagcagaacagtagtggactcgactcaggtcgtaagccttatatttcacagacaattaaatcttggctgctgttgaacaaaactgtaatatttactttgttctataccgagaagcacttttaaagtaaa

SEQ ID NO: 26936 - DNA, 2962 bp, Homo sapiens
gcttcactattaaaatattttccccccaagtctcaaatattgaagaatctctaaccaggctcgaaacgccggtctcagtggctattgagttacccaccaagttaccccggttagagctgtttggggtggctcacgttattgcggcaaactttggagatgacggctgagtcctccgggcgaacatgtcaagccgattgtaaatgctgttatttccacatccttcagggacaccagtccctacgaagaccttgggcgattttgaagtgcgggcacctcgattccccgaatctgtagtgtggctggtatcggtgttcccctggtttaactagcctgtttgaaggcacagatcattcatggggatgtataaccgaaaccagtcctctccaccgcctggggatcttcactttcgcagtctacgactgcctgtgactccagaaagacaaactgcagattggccaaggtacatctcagatcagatccctctgggaaaagcgcgggaatgcttggctctagtagttaggagctctggtgagagcgcccctagtgccattttcccatccctgcccttgacagtcccctttggtctaaattcacggttctagacagtcaaagtctacctgctgggtgtccactctcaagccataggttttcaatcctaaaagggattaggaccttggctcaaaatgtggtcaacgcagtgttcaaattaggagggcagctgggagatggcagcaggggatgaaagtatgactcctacttcgtccgcaactgtgggtctggcacctcttgacttgccagtatgctggcaaacaacccatctctcttggagaatccacacttcgtttcttctaggtccagcctaaatgttacctcctccagggagcctttccagatactgcttctcctctctcccccaactccctcccacaaatgaagttttctcttctgaattccttgctggtactgtcacttatattcttttgggtagatctctgggcatgcatatgtcacctcctgtgactgtgggtttcttgacaacctaatcaatgcattgaacaaaggagatgtttagacaacccatataaaatgaataagagaaatagggtgaataccgtctaccccaattgcaatcagattagtttcctttattttgaaaacgattagaactagtagaggagttagatgtggcccactagggaacaaattttcatctccaagccgtcctctggctcgatcgggtctgcactgggtctgcatcaacttgcgctggctcagagggaggctcagccccagcctggccttcctggtgcccactcccaacatcctgagcagggccgactctaggcaccccacgattagctgagtgatctagggcaaggacctaggcgtctctaagtcttagtttccccatctgaacaatgtggataatgacacgtacctggggtgggcaggctagagtaaatgggaaaatcaaagcgccagccagagcgggtcgcactgttagttcctgtattttctcctcctgcctctggtttcttccgttccgttctagctgcctgaagacccagcccgacagcgatgcctgtcagcccgcgtcgcccaccagggcagctgctctcccaactcgcatggggggcaccaccccgcctcggtgccctagagctgagcgcagccgcggctccacggggatcgccagggcctcagccctcgcggccggcggcgcgggagtgttgcggggcagggaccagagcgcgatcagagcggccacccccgatttaggtcgccagctttccagtcactgcgatggccactggggcgccccttccatcctggttaaattctcattgtgatccccagccctcttctcggttccccacacccaggaggccggttctccgccgctcaggctgggagaggtcaccgctccgggcagggtggacccccagctccgtctcggaggacctttcgccggaggcgagcaggaaggggttaaccatgagcctcccaccctcacctcccagaccctggtgccgggctaaggcctccgcttccctcctgaggtctcattaggaaaccctcaccgctattttcaacatttcctcaatcaagtgcctttaaatagagctgcacaaacagattggcggcaaaagcgtagatcttgtcacgattgagaccaatccagtatttcagccttgtttgctttgcaattacgggttggcttgtggctacggtgccaccggggcaaatctgcagccgctcgctttctcctctgcgctccgggcgggtggaggaagcgacccgcggagtcactgcagggaggagagggggacgcgcgcggggggaggcggcggagggcggaggagactcgcttgcaccccagggccgcgggcacgcagagctgtgttgaaggacatacttttcaggttcctgacagtcactgagctatacgcaataataaagtgcgtgattcgcgtgtggaaaccagtgtcgtgtccttaccagcttccttttctgtccaccttccctctctcttctacctccgtttcgcttttcttcagtgcatgttagcggtttgctggatttcccttctccctcgctgttcaactgctagcatgatttgttacattttccacagctgtttattcttgtttgactttttgtacaaagtcactttaaatctgctgcagaaagaataaagcacctagccctttggatggactcctgcaggcgtgtggctgtccctggcccacttttaattctttggagatggctcttctgtgtaaatcagctgctgggtgcgttcggtcacctcgtaggccagcctagtttgtatcagcagaacagtagtggactcgactcaggtcgtaagccttatatttcacagacaattaaatcttggctgctgttgaacaaaactgtaatatttactttgttctataccgagaagcacttttaaagtaaa

SEQ ID NO: 26937 - DNA, 2846 bp, Homo sapiens
gcttcactattaaaatattttccccccaagtctcaaatattgaagaatctctaaccaggctcgaaacgccggtctcagtggctattgagttacccaccaagttaccccgggacaccagtccctacgaagaccttgggcgattttgaagtgcgggcacctcgattccccgaatctgtagtgtggctggtatcggtgttcccctggtttaactagcctgtttgaaggcacagatcattcatggggatgtataaccgaaaccagtcctctccaccgcctggggatcttcactttcgcagtctacgactgcctgtgactccagaaagacaaactgcagattggccaaggtacatctcagatcagatccctctgggaaaagcgcgggaatgcttggctctagtagttaggagctctggtgagagcgcccctagtgccattttcccatccctgcccttgacagtcccctttggtctaaattcacggttctagacagtcaaagtctacctgctgggtgtccactctcaagccataggttttcaatcctaaaagggattaggaccttggctcaaaatgtggtcaacgcagtgttcaaattaggagggcagctgggagatggcagcaggggatgaaagtatgactcctacttcgtccgcaactgtgggtctggcacctcttgacttgccagtatgctggcaaacaacccatctctcttggagaatccacacttcgtttcttctaggtccagcctaaatgttacctcctccagggagcctttccagatactgcttctcctctctcccccaactccctcccacaaatgaagttttctcttctgaattccttgctggtactgtcacttatattcttttgggtagatctctgggcatgcatatgtcacctcctgtgactgtgggtttcttgacaacctaatcaatgcattgaacaaaggagatgtttagacaacccatataaaatgaataagagaaatagggtgaataccgtctaccccaattgcaatcagattagtttcctttattttgaaaacgattagaactagtagaggagttagatgtggcccactagggaacaaattttcatctccaagccgtcctctggctcgatcgggtctgcactgggtctgcatcaacttgcgctggctcagagggaggctcagccccagcctggccttcctggtgcccactcccaacatcctgagcagggccgactctaggcaccccacgattagctgagtgatctagggcaaggacctaggcgtctctaagtcttagtttccccatctgaacaatgtggataatgacacgtacctggggtgggcaggctagagtaaatgggaaaatcaaagcgccagccagagcgggtcgcactgttagttcctgtattttctcctcctgcctctggtttcttccgttccgttctagctgcctgaagacccagcccgacagcgatgcctgtcagcccgcgtcgcccaccagggcagctgctctcccaactcgcatggggggcaccaccccgcctcggtgccctagagctgagcgcagccgcggctccacggggatcgccagggcctcagccctcgcggccggcggcgcgggagtgttgcggggcagggaccagagcgcgatcagagcggccacccccgatttaggtcgccagctttccagtcactgcgatggccactggggcgccccttccatcctggttaaattctcattgtgatccccagccctcttctcggttccccacacccaggaggccggttctccgccgctcaggctgggagaggtcaccgctccgggcagggtggacccccagctccgtctcggaggacctttcgccggaggcgagcaggaaggggttaaccatgagcctcccaccctcacctcccagaccctggtgccgggctaaggcctccgcttccctcctgaggtctcattaggaaaccctcaccgctattttcaacatttcctcaatcaagtgcctttaaatagagctgcacaaacagattggcggcaaaagcgtagatcttgtcacgattgagaccaatccagtatttcagccttgtttgctttgcaattacgggttggcttgtggctacggtgccaccggggcaaatctgcagccgctcgctttctcctctgcgctccgggcgggtggaggaagcgacccgcggagtcactgcagggaggagagggggacgcgcgcggggggaggcggcggagggcggaggagactcgcttgcaccccagggccgcgggcacgcagagctgtgttgaaggacatacttttcaggttcctgacagtcactgagctatacgcaataataaagtgcgtgattcgcgtgtggaaaccagtgtcgtgtccttaccagcttccttttctgtccaccttccctctctcttctacctccgtttcgcttttcttcagtgcatgttagcggtttgctggatttcccttctccctcgctgttcaactgctagcatgatttgttacattttccacagctgtttattcttgtttgactttttgtacaaagtcactttaaatctgctgcagaaagaataaagcacctagccctttggatggactcctgcaggcgtgtggctgtccctggcccacttttaattctttggagatggctcttctgtgtaaatcagctgctgggtgcgttcggtcacctcgtaggccagcctagtttgtatcagcagaacagtagtggactcgactcaggtcgtaagccttatatttcacagacaattaaatcttggctgctgttgaacaaaactgtaatatttactttgttctataccgagaagcacttttaaagtaaa

SEQ ID NO: 26938 - DNA, 2795 bp, Homo sapiens
gcttcactattaaaatattttccccccaagtctcaaatattgaagaatctctaaccagggacaccagtccctacgaagaccttgggcgattttgaagtgcgggcacctcgattccccgaatctgtagtgtggctggtatcggtgttcccctggtttaactagcctgtttgaaggcacagatcattcatggggatgtataaccgaaaccagtcctctccaccgcctggggatcttcactttcgcagtctacgactgcctgtgactccagaaagacaaactgcagattggccaaggtacatctcagatcagatccctctgggaaaagcgcgggaatgcttggctctagtagttaggagctctggtgagagcgcccctagtgccattttcccatccctgcccttgacagtcccctttggtctaaattcacggttctagacagtcaaagtctacctgctgggtgtccactctcaagccataggttttcaatcctaaaagggattaggaccttggctcaaaatgtggtcaacgcagtgttcaaattaggagggcagctgggagatggcagcaggggatgaaagtatgactcctacttcgtccgcaactgtgggtctggcacctcttgacttgccagtatgctggcaaacaacccatctctcttggagaatccacacttcgtttcttctaggtccagcctaaatgttacctcctccagggagcctttccagatactgcttctcctctctcccccaactccctcccacaaatgaagttttctcttctgaattccttgctggtactgtcacttatattcttttgggtagatctctgggcatgcatatgtcacctcctgtgactgtgggtttcttgacaacctaatcaatgcattgaacaaaggagatgtttagacaacccatataaaatgaataagagaaatagggtgaataccgtctaccccaattgcaatcagattagtttcctttattttgaaaacgattagaactagtagaggagttagatgtggcccactagggaacaaattttcatctccaagccgtcctctggctcgatcgggtctgcactgggtctgcatcaacttgcgctggctcagagggaggctcagccccagcctggccttcctggtgcccactcccaacatcctgagcagggccgactctaggcaccccacgattagctgagtgatctagggcaaggacctaggcgtctctaagtcttagtttccccatctgaacaatgtggataatgacacgtacctggggtgggcaggctagagtaaatgggaaaatcaaagcgccagccagagcgggtcgcactgttagttcctgtattttctcctcctgcctctggtttcttccgttccgttctagctgcctgaagacccagcccgacagcgatgcctgtcagcccgcgtcgcccaccagggcagctgctctcccaactcgcatggggggcaccaccccgcctcggtgccctagagctgagcgcagccgcggctccacggggatcgccagggcctcagccctcgcggccggcggcgcgggagtgttgcggggcagggaccagagcgcgatcagagcggccacccccgatttaggtcgccagctttccagtcactgcgatggccactggggcgccccttccatcctggttaaattctcattgtgatccccagccctcttctcggttccccacacccaggaggccggttctccgccgctcaggctgggagaggtcaccgctccgggcagggtggacccccagctccgtctcggaggacctttcgccggaggcgagcaggaaggggttaaccatgagcctcccaccctcacctcccagaccctggtgccgggctaaggcctccgcttccctcctgaggtctcattaggaaaccctcaccgctattttcaacatttcctcaatcaagtgcctttaaatagagctgcacaaacagattggcggcaaaagcgtagatcttgtcacgattgagaccaatccagtatttcagccttgtttgctttgcaattacgggttggcttgtggctacggtgccaccggggcaaatctgcagccgctcgctttctcctctgcgctccgggcgggtggaggaagcgacccgcggagtcactgcagggaggagagggggacgcgcgcggggggaggcggcggagggcggaggagactcgcttgcaccccagggccgcgggcacgcagagctgtgttgaaggacatacttttcaggttcctgacagtcactgagctatacgcaataataaagtgcgtgattcgcgtgtggaaaccagtgtcgtgtccttaccagcttccttttctgtccaccttccctctctcttctacctccgtttcgcttttcttcagtgcatgttagcggtttgctggatttcccttctccctcgctgttcaactgctagcatgatttgttacattttccacagctgtttattcttgtttgactttttgtacaaagtcactttaaatctgctgcagaaagaataaagcacctagccctttggatggactcctgcaggcgtgtggctgtccctggcccacttttaattctttggagatggctcttctgtgtaaatcagctgctgggtgcgttcggtcacctcgtaggccagcctagtttgtatcagcagaacagtagtggactcgactcaggtcgtaagccttatatttcacagacaattaaatcttggctgctgttgaacaaaactgtaatatttactttgttctataccgagaagcacttttaaagtaaa

SEQ ID NO: 26939 - DNA, 868 bp, Homo sapiens
gcttcactattaaaatattttccccccaagtctcaaatattgaagaatctctaaccaggctcgaaacgccggtctcagtggctattgagttacccaccaagttaccccggttagagctgtttggggtggctcacgttattgcggcaaactttggagatgacggctgagtcctccgggcgaacatgtcaagccgattgtaaatgctgttatttccacatccttcagggacaccagtccctacgaagaccttgggcgattttgaagtgcgggcacctcgattccccgaatctgtagtgtggctggtatcggtgttcccctggtttaactagcctgtttgaaggcacagatcattcatggggatgtataaccgaaaccagtcctctccaccgcctggggatcttcactttcgcagtctacgactgcctgtgactccagaaagacaaactgcagattggccaaggtacatctcagatcagatccctctgggaaaagcgcgggaatgcttggctctagtagttaggagctctggtgagagcgcccctagtgccattttcccatccctgcccttgacagtcccctttggtctaaattcacggttctagacagtcaaagtctacctgctgggtgtccactctcaagccataggttttcaatcctaaaagggattaggaccttggctcaaaatgtggtcaacgcagtgttcaaattaggagggcagctgggagatggcagcaggggatgaaagtatgactcctacttcgtccgcaactgtgggtctggcacctcttgacttgccagtatgctggcaaacaacccatctctcttggagaatccacacttcgtttctgggcagccacttcgtgggcag

SEQ ID NO: 26940 - DNA, 375 bp, Homo sapiens
aatgtgttcttgaagatgtcacctcagcccacctgctccaaggacagtgcttcttgcgacactctgatagctctgcattcttttctgtaccagggtagggtggagtcattttacatgctatccacttagtcccaggatgtttaggatgctcagaacaaggcatattgtctgagtggtggcaagggtctccctctaactggggttgtgtagtccttcctgtttgtgtagttcttcttgtatagtcttttcttgttggcctttgagaagtagttgtctacagacataccaagtgaaagtggctccagaagtgtcgtgctgctcaaagtacacatctgcaaagcagaatcaaattttgttggatttgagtgtctattt

SEQ ID NO: 26941 - DNA, 1591 bp, Homo sapiens
gcttcactattaaaatattttccccccaagtctcaaatattgaagaatctctaaccagaaggcacagatcattcatggggatgtataaccgaaaccagtcctctccaccgcctggggatcttcactttcgcagtctacgactgcctgtgactccagaaagacaaactgcagattggccaagctgcctgaagacccagcccgacagcgatgcctgtcagcccgcgtcgcccaccagggcagctgctctcccaactcgcatggggggcaccaccccgcctcggtgccctagagctgagcgcagccgcggctccacggggatcgccagggcctcagccctcgcggccggcggcgcgggagtgttgcggggcagggaccagagcgcgatcagagcggccacccccgatttaggtcgccagctttccagtcactgcgatggccactggggcgccccttccatcctggttaaattctcattgtgatccccagccctcttctcggttccccacacccaggaggccggttctccgccgctcaggctgggagaggtcaccgctccgggcagggtggacccccagctccgtctcggaggacctttcgccggaggcgagcaggaaggggttaaccatgagcctcccaccctcacctcccagaccctggtgccgggctaaggcctccgcttccctcctgaggtctcattaggaaaccctcaccgctattttcaacatttcctcaatcaagtgcctttaaatagagctgcacaaacagattggcggcaaaagcgtagatcttgtcacgattgagaccaatccagtatttcagccttgtttgctttgcaattacgggttggcttgtggctacggtgccaccggggcaaatctgcagccgctcgctttctcctctgcgctccgggcgggtggaggaagcgacccgcggagtcactgcagggaggagagggggacgcgcgcggggggaggcggcggagggcggaggagactcgcttgcaccccagggccgcgggcacgcagagctgtgttgaaggacatacttttcaggttcctgacagtcactgagctatacgcaataataaagtgcgtgattcgcgtgtggaaaccagtgtcgtgtccttaccagcttccttttctgtccaccttccctctctcttctacctccgtttcgcttttcttcagtgcatgttagcggtttgctggatttcccttctccctcgctgttcaactgctagcatgatttgttacattttccacagctgtttattcttgtttgactttttgtacaaagtcactttaaatctgctgcagaaagaataaagcacctagccctttggatggactcctgcaggcgtgtggctgtccctggcccacttttaattctttggagatggctcttctgtgtaaatcagctgctgggtgcgttcggtcacctcgtaggccagcctagtttgtatcagcagaacagtagtggactcgactcaggtcgtaagccttatatttcacagacaattaaatcttggctgctgttgaacaaaactgtaatatttactttgttctataccgagaagcacttttaaagtaaa

SEQ ID NO: 26942 - DNA, 1870 bp, Homo sapiens
gcttcactattaaaatattttccccccaagtctcaaatattgaagaatctctaaccaggctcgaaacgccggtctcagtggctattgagttacccaccaagttaccccggttagagctgtttggggtggctcacgttattgcggcaaactttggagatgacggctgagtcctccgggcgaacatgtcaagccgattgtaaatgctgttatttccacatccttcagggacaccagtccctacgaagaccttgggcgattttgaagtgcgggcacctcgattccccgaatctgtagtgtggctggtatcggtgttcccctggtttaactagcctgtttgaaggcacagatcattcatggggatgtataaccgaaaccagtcctctccaccgcctggggatcttcactttcgcagtctacgactgcctgtgactccagaaagacaaactgcagattggccaagctgcctgaagacccagcccgacagcgatgcctgtcagcccgcgtcgcccaccagggcagctgctctcccaactcgcatggggggcaccaccccgcctcggtgccctagagctgagcgcagccgcggctccacggggatcgccagggcctcagccctcgcggccggcggcgcgggagtgttgcggggcagggaccagagcgcgatcagagcggccacccccgatttaggtcgccagctttccagtcactgcgatggccactggggcgccccttccatcctggttaaattctcattgtgatccccagccctcttctcggttccccacacccaggaggccggttctccgccgctcaggctgggagaggtcaccgctccgggcagggtggacccccagctccgtctcggaggacctttcgccggaggcgagcaggaaggggttaaccatgagcctcccaccctcacctcccagaccctggtgccgggctaaggcctccgcttccctcctgaggtctcattaggaaaccctcaccgctattttcaacatttcctcaatcaagtgcctttaaatagagctgcacaaacagattggcggcaaaagcgtagatcttgtcacgattgagaccaatccagtatttcagccttgtttgctttgcaattacgggttggcttgtggctacggtgccaccggggcaaatctgcagccgctcgctttctcctctgcgctccgggcgggtggaggaagcgacccgcggagtcactgcagggaggagagggggacgcgcgcggggggaggcggcggagggcggaggagactcgcttgcaccccagggccgcgggcacgcagagctgtgttgaaggacatacttttcaggttcctgacagtcactgagctatacgcaataataaagtgcgtgattcgcgtgtggaaaccagtgtcgtgtccttaccagcttccttttctgtccaccttccctctctcttctacctccgtttcgcttttcttcagtgcatgttagcggtttgctggatttcccttctccctcgctgttcaactgctagcatgatttgttacattttccacagctgtttattcttgtttgactttttgtacaaagtcactttaaatctgctgcagaaagaataaagcacctagccctttggatggactcctgcaggcgtgtggctgtccctggcccacttttaattctttggagatggctcttctgtgtaaatcagctgctgggtgcgttcggtcacctcgtaggccagcctagtttgtatcagcagaacagtagtggactcgactcaggtcgtaagccttatatttcacagacaattaaatcttggctgctgttgaacaaaactgtaatatttactttgttctataccgagaagcacttttaaagtaaa

SEQ ID NO: 26943 - DNA, 3005 bp, Homo sapiens
gcttcactattaaaatattttccccccaagtctcaaatattgaagaatctctaaccagggacaccagtccctacgaagaccttgggcgattttgaagtgcgggcacctcgattccccgaatctgtagtgtggctggtatcggtgttcccctggtttaactagcctgtttgtggaagtgactctgaccgttcccttaagaatctttaatgctcttacatgagatgagcctcagaacaagctaagaaccatcgaaagaacatcaagcctggaaggtgacagaaggagcaatgtgttcttgaagatgtcacctcagcccacctgctccaaggacagtgcttcttgcgacactctgatagctctgcattcttttctgtaccaggaaggcacagatcattcatggggatgtataaccgaaaccagtcctctccaccgcctggggatcttcactttcgcagtctacgactgcctgtgactccagaaagacaaactgcagattggccaaggtacatctcagatcagatccctctgggaaaagcgcgggaatgcttggctctagtagttaggagctctggtgagagcgcccctagtgccattttcccatccctgcccttgacagtcccctttggtctaaattcacggttctagacagtcaaagtctacctgctgggtgtccactctcaagccataggttttcaatcctaaaagggattaggaccttggctcaaaatgtggtcaacgcagtgttcaaattaggagggcagctgggagatggcagcaggggatgaaagtatgactcctacttcgtccgcaactgtgggtctggcacctcttgacttgccagtatgctggcaaacaacccatctctcttggagaatccacacttcgtttcttctaggtccagcctaaatgttacctcctccagggagcctttccagatactgcttctcctctctcccccaactccctcccacaaatgaagttttctcttctgaattccttgctggtactgtcacttatattcttttgggtagatctctgggcatgcatatgtcacctcctgtgactgtgggtttcttgacaacctaatcaatgcattgaacaaaggagatgtttagacaacccatataaaatgaataagagaaatagggtgaataccgtctaccccaattgcaatcagattagtttcctttattttgaaaacgattagaactagtagaggagttagatgtggcccactagggaacaaattttcatctccaagccgtcctctggctcgatcgggtctgcactgggtctgcatcaacttgcgctggctcagagggaggctcagccccagcctggccttcctggtgcccactcccaacatcctgagcagggccgactctaggcaccccacgattagctgagtgatctagggcaaggacctaggcgtctctaagtcttagtttccccatctgaacaatgtggataatgacacgtacctggggtgggcaggctagagtaaatgggaaaatcaaagcgccagccagagcgggtcgcactgttagttcctgtattttctcctcctgcctctggtttcttccgttccgttctagctgcctgaagacccagcccgacagcgatgcctgtcagcccgcgtcgcccaccagggcagctgctctcccaactcgcatggggggcaccaccccgcctcggtgccctagagctgagcgcagccgcggctccacggggatcgccagggcctcagccctcgcggccggcggcgcgggagtgttgcggggcagggaccagagcgcgatcagagcggccacccccgatttaggtcgccagctttccagtcactgcgatggccactggggcgccccttccatcctggttaaattctcattgtgatccccagccctcttctcggttccccacacccaggaggccggttctccgccgctcaggctgggagaggtcaccgctccgggcagggtggacccccagctccgtctcggaggacctttcgccggaggcgagcaggaaggggttaaccatgagcctcccaccctcacctcccagaccctggtgccgggctaaggcctccgcttccctcctgaggtctcattaggaaaccctcaccgctattttcaacatttcctcaatcaagtgcctttaaatagagctgcacaaacagattggcggcaaaagcgtagatcttgtcacgattgagaccaatccagtatttcagccttgtttgctttgcaattacgggttggcttgtggctacggtgccaccggggcaaatctgcagccgctcgctttctcctctgcgctccgggcgggtggaggaagcgacccgcggagtcactgcagggaggagagggggacgcgcgcggggggaggcggcggagggcggaggagactcgcttgcaccccagggccgcgggcacgcagagctgtgttgaaggacatacttttcaggttcctgacagtcactgagctatacgcaataataaagtgcgtgattcgcgtgtggaaaccagtgtcgtgtccttaccagcttccttttctgtccaccttccctctctcttctacctccgtttcgcttttcttcagtgcatgttagcggtttgctggatttcccttctccctcgctgttcaactgctagcatgatttgttacattttccacagctgtttattcttgtttgactttttgtacaaagtcactttaaatctgctgcagaaagaataaagcacctagccctttggatggactcctgcaggcgtgtggctgtccctggcccacttttaattctttggagatggctcttctgtgtaaatcagctgctgggtgcgttcggtcacctcgtaggccagcctagtttgtatcagcagaacagtagtggactcgactcaggtcgtaagccttatatttcacagacaattaaatcttggctgctgttgaacaaaactgtaatatttactttgttctataccgagaagcacttttaaagtaaa

SEQ ID NO: 26944 - DNA, 2408 bp, Homo sapiens
gcttcactattaaaatattttccccccaagtctcaaatattgaagaatctctaaccagggacaccagtccctacgaagaccttgggcgattttgaagtgcgggcacctcgattccccgaatctgtagtgtggctggtatcggtgttcccctggtttaactagcctgtttgaaggcacagatcattcatggggatgtataaccgaaaccagtcctctccaccgcctggggatcttcactttcgcagtctacgactgcctgtgactccagaaagacaaactgcagattggccaagtctaggtccagcctaaatgttacctcctccagggagcctttccagatactgcttctcctctctcccccaactccctcccacaaatgaagttttctcttctgaattccttgctggtactgtcacttatattcttttgggtagatctctgggcatgcatatgtcacctcctgtgactgtgggtttcttgacaacctaatcaatgcattgaacaaaggagatgtttagacaacccatataaaatgaataagagaaatagggtgaataccgtctaccccaattgcaatcagattagtttcctttattttgaaaacgattagaactagtagaggagttagatgtggcccactagggaacaaattttcatctccaagccgtcctctggctcgatcgggtctgcactgggtctgcatcaacttgcgctggctcagagggaggctcagccccagcctggccttcctggtgcccactcccaacatcctgagcagggccgactctaggcaccccacgattagctgagtgatctagggcaaggacctaggcgtctctaagtcttagtttccccatctgaacaatgtggataatgacacgtacctggggtgggcaggctagagtaaatgggaaaatcaaagcgccagccagagcgggtcgcactgttagttcctgtattttctcctcctgcctctggtttcttccgttccgttctagctgcctgaagacccagcccgacagcgatgcctgtcagcccgcgtcgcccaccagggcagctgctctcccaactcgcatggggggcaccaccccgcctcggtgccctagagctgagcgcagccgcggctccacggggatcgccagggcctcagccctcgcggccggcggcgcgggagtgttgcggggcagggaccagagcgcgatcagagcggccacccccgatttaggtcgccagctttccagtcactgcgatggccactggggcgccccttccatcctggttaaattctcattgtgatccccagccctcttctcggttccccacacccaggaggccggttctccgccgctcaggctgggagaggtcaccgctccgggcagggtggacccccagctccgtctcggaggacctttcgccggaggcgagcaggaaggggttaaccatgagcctcccaccctcacctcccagaccctggtgccgggctaaggcctccgcttccctcctgaggtctcattaggaaaccctcaccgctattttcaacatttcctcaatcaagtgcctttaaatagagctgcacaaacagattggcggcaaaagcgtagatcttgtcacgattgagaccaatccagtatttcagccttgtttgctttgcaattacgggttggcttgtggctacggtgccaccggggcaaatctgcagccgctcgctttctcctctgcgctccgggcgggtggaggaagcgacccgcggagtcactgcagggaggagagggggacgcgcgcggggggaggcggcggagggcggaggagactcgcttgcaccccagggccgcgggcacgcagagctgtgttgaaggacatacttttcaggttcctgacagtcactgagctatacgcaataataaagtgcgtgattcgcgtgtggaaaccagtgtcgtgtccttaccagcttccttttctgtccaccttccctctctcttctacctccgtttcgcttttcttcagtgcatgttagcggtttgctggatttcccttctccctcgctgttcaactgctagcatgatttgttacattttccacagctgtttattcttgtttgactttttgtacaaagtcactttaaatctgctgcagaaagaataaagcacctagccctttggatggactcctgcaggcgtgtggctgtccctggcccacttttaattctttggagatggctcttctgtgtaaatcagctgctgggtgcgttcggtcacctcgtaggccagcctagtttgtatcagcagaacagtagtggactcgactcaggtcgtaagccttatatttcacagacaattaaatcttggctgctgttgaacaaaactgtaatatttactttgttctataccgagaagcacttttaaagtaaa

SEQ ID NO: 26945 - DNA, 278 bp, Homo sapiens
tggctgaatagtgctccgttgtgtatttgtaccacattcatctgttgatggacgtttagattgcttccagatcttggctattgttgctgaattctttttctcagcatggaacgtccctgagaaagagaatgcacgcctaggggtaggtctctgaactggcccccccggggcgtacctgtctcttatggttgagactgcagggacgaaataaactccagtctcccatagcgctcccaggcttattaggaagaggaaattcccacctaataaattttggt

SEQ ID NO: 26946 - DNA, 378 bp, Homo sapiens
ttaaaaaaccagctttcacgtgaactaatgaagaactcattaccccaaagagggcactaatctgctcatgagggatccctcccatgacccaaacacctcttaccaggccctgcttccaacattgagaatcacatttcaacatgagatttggaagggacagacatccaaactatatcagtttgacagaagtgtgtgcatttccaggtgtaacacaatctaccttattccttctgttatacacatgagtctggcattcaatcaaaaaccaacaaaatccaattcagaaatgaaacagaggttgggactagcagaccttaagacaatcagttaatatattaacatatctggtggaaaaggtgggaaataacaaacagatag

SEQ ID NO: 26947 - DNA, 1398 bp, Homo sapiens
  misc_feature (319)..(319): n is a, c, g, or t
  misc_feature (700)..(700): n is a, c, g, or t
  misc_feature (702)..(702): n is a, c, g, or t
  misc_feature (801)..(801): n is a, c, g, or t
  misc_feature (1148)..(1148): n is a, c, g, or t
  misc_feature (1183)..(1183): n is a, c, g, or t
atgttgcccttcacttgtggaagaaatgcaaatgaaaacagccctagggatgttgacgttggggtggcacctgctgcagagggtaacgtgcagcatgtcgagggcagcactgccaaggctggtttgagctcaaggtcaggtggaggaggtagtctctcccatctcttctgcgagtgcagctctaaaccctgcctgaaacacgtggagaagctatctgagctgcctccaggacacatgcaaatggacactctgatcataaaattatcaggaagattgagaaataagacaaaaatggaggtgccaccaaaccagtggaaanttttcccttttcattcctctggcattccctggccttgactcaaggcagcccacactctaggagcagacaccagggcacaggtggggagctctgggggaccctccaggcttactcagtgaatgggttagcagcagccacaggagccaccatggagcctgcagggacccacaacactgagggcagggatcttgcctctaatcagataagctgtgattccgagagggtggggtaaaggccacgggtctttttctctccacatcttcccacgtcatgaccccagagggtcgaagagggagaaagtgtgagcaccgtgacataatgagccgcagccttctgactagatgccccaaagaagaatcccaggtgaccacacagcatcananaaactgcaggtaatgaggaactttggaaagcaatccatcgtgttgtcagtaaaacctctggctcactcccgagctgggcatgcatggatgtgaccctcnatggaatagactatgagaaccaggtgaggggatctacctccaccgagacgtgagagtgacctgcatacccaaacaccatgaggctttaaagactgagctgatgtggaagccacagcctctgcaggttgctctgcacttgcaacataagcccaaccacatcaattgctgcaaaacaaaactacagcattctccataccacttaaataagacacagagtctcacaacattcaaaacgcccaggacacaatccaaaattacttctacaaaaaatcaggaaaatctcaatgagcaaggaaaatggcaatcagtagctgccagtgctgagatgacatgagggttggaatcancaacatctttaaagtaattatcataagcattctcnagcaagtaatggcaaacactcttgagataaatggaaagataagaaggctcagggagaaagtggaatgtacaaagaatgaccaagtgggaattgcaccactggaaacaaatcaccaggataaagcagtctctggctgggccaacaggagaatggaaatgaaaagggaaagagttgttatggcagttgtccaatttgaacaacacaaaagacactga

SEQ ID NO: 26948 - DNA, 242 bp, Homo sapiens
aaatttggcaaaaacaaaaaacataaagcaacagattcaagaatctgagtgaaattcgaagataataaatgcaaataaattcacaccaaggcacatcatactcaaacatctgaaaacaaaagacaaataaaaaaatctttaaagcatatatctatagggaaaaataaattctaatgatagtggttttctcatcagaaaccatggaggccagaaagaatgggcacaatattttttaagtgcta

SEQ ID NO: 26949 - DNA, 279 bp, Homo sapiens
gcccaggctggagtgcattggcgtgattttggctcgctgcaacctccgtctcccaggttcaaccgattctcctttctcaacctctcaagtagctgggattacaggcgctcgccaccacagctggtaaaattttgtatttttagtagagacggggtttcaccatgttggccatgctggtctcaaactcccagctttcattgatccacctgtctcagcctcccaaaatgctaggattacagatatgagccattgtgcctggccctcgttcatgattttaaa

SEQ ID NO: 26950 - DNA, 170 bp, Homo sapiens
aatttccccccaccaaaagaatgcaggagatgctgtgcagcaaaatctgtagctaatgtcttcggttggagttataagtcaccagggatcagcagtggaggtagttcaggctgctgggggttcaggattgtcttcatatgaaaggaatacttagggtaacatttccataa

SEQ ID NO: 26951 - DNA, 394 bp, Homo sapiens
tactgcttcacacccactacaatgtggctacaataaaaaatacagatagttacaagtgttatcaaagatgtggaaaaaccagaactctcatgggagtgtaaaatggtgtagccactttggaaaacattctggcaattcctcaagaggttagctgaggcaggcagatcacgaggtcaggagatcgagaccatcctggccaacatggtgaaaccccgtctctactaaaaaaatacaaaaattagctgggcgtggtggcatgtgcttgtaatctcagctacttgggaggctgaggcaggagaatcacttgaaccagggagtcggaagttgcagtgagctgagattgagccactgcactccagcctggcgtcagagtgagactccgtctcaaaaaaaa

SEQ ID NO: 26952 - DNA, 329 bp, Homo sapiens
cacaaaaatctactaatactttgcagataagataaagacaggtacaaaattagaaagaaaggatgcaaagttatttattaaagtcatcttgaactactcatttaccctctctggccaccactgcctcgtgactgaattgaaataataatgactgtgaggattataggaaatacacaagatattgtgtatgaaatgatggtaaacagcgttaaggcactgtaaaaacacaagacataatcaatgctttgctgtcatgatgtccaaggataaaaaaggacaaaagcattcatttccattacatgttaacccttaaaagtaaagcttctctc

SEQ ID NO: 26953 - DNA, 669 bp, Homo sapiens
gattctgggatcctttgtttagcagaaacctcatgactgaatcctctatacctaggcagcctcttttagtttctgagtaataaccctgtcatccaggtggaatcacaaccatctttttatatacacgaagtcctcacttcgttttggaattccctgaaaactgactttatggaaacaatgtacaggaggtcctccaacaccattggttgttcaaagttgtgtagttatactgttgataaaaaataagtggtttcactatacatcattttgcttcgaggtgaagtttccaagagactttcaaagatgttaagtgaggacatactgtacatcaaattcatatcctcttccacagttcatctggaatttctttataaactgcttctagagaatctatttaggcaggttatgtgtagagatccatgtcgcccttcctcaatcttggttttgagtcaactcacctggggagcttacaaatgatgaggccctgggtctcaatacctgagattctgatttccttgcacctgtgtgagcatgtggattttttttttttcttttaaagcaccagaggtggttccaatgatgaagtttttggaggcatcaagctccaatgtgtaagaacagaaattaattgtaatatgatttcttcaaatattatcttcaaatgcattg

SEQ ID NO: 26954 - DNA, 286 bp, Homo sapiens
aggagcactgacagagataaactgagatgataagagccaatcctgctttgatttgcaaagctactaattctttaagagacataattttgaaaacgtaggacttgaggaattcctctttatccaaactaagagcagggagaatttaaggtttaaaaatgatccttcttcatctcactctgtgcattaaacatcttgcatgtttgatttccatgacttttctgtaattgagtatctcaagtgaatgctaactttcatctttactttctctgcatatcccccaccttta

SEQ ID NO: 26955 - DNA, 305 bp, Homo sapiens
ttgcccctcatttcctgctgtgcggcctggtttccaacagaccatggaccagcgctggtccatggcctgggagttggggacccctgctttaaagaacacccagatccagggaaagctgaaggtaacagaaaataaaaccccccctttccacagtgctttcacctgtttttttctcatttcatccttactacaatcctgtgtgatgtgtattatgatcattcccattttagagaacttgaatccaaagcaatttttcaacaatgagcaagagaagcaggtgataaacatttattctgctttttata

SEQ ID NO: 26956 - DNA, 480 bp, Homo sapiens
gaaatgctcaaatttgtatattactgtctttgccacaaatgggttagtggtgactgaattatcgtttggtctctttagctgccaaaatataacaggtaattgagtttaacatcaactaatgtttttgttttattttcagtaagccattaaaaaaatctaaataatttttaaatgctgttaacttagaagagctcatgaaaaacacctgttaacttacaactaaaaaaaacaccatcttagtcaagcctggtggcccacacctgtaatcccaatactttgggaagccgaggcgggtggatcacctaaggtcaggagtttgagaccagcctggctaacatggtgaaacgctatctctactaaaaatacaaaaattagctgggcgcggtggtgcatgcctgtagtcccagctcctggggctgaggcaggagaatcgcttgaacccaagaggtggaggttgcagtgagccaagatagcaccact

SEQ ID NO: 26957 - DNA, 556 bp, Homo sapiens
aaacaatgtactgtaacttttatgtaccagagactgttgttttaaactttcagcctaaagctaaaagtacaacttcttttatttggtttatttattatcttttgagtacttcaaatgcaatgagaagtgtggataccgaaggcagcactagtctggtagtcaagagacctgaggttagatatcagctctgctctcaagtaactgtgtgactgtgaacttgaatatccccattttaacacgtgggtattgcgttaaaataatctctaacatttcttttatgtttaaatgtatggttttatggaattacaatgctatatcacaggaaatggatacattatataagaggagaaacagaaaagatcagctcaaataaatgggtgttgtcaataagcttattagagaatcttgagggtttcacagtcttatataaaaacccagagacacagacagtgatcataagtaagatcaatactggggaatataaacagtgaaaccaaaaggaaaaattcatatttattcaaaccagagaatactcgcatatgtgtgttttgtgtgg

SEQ ID NO: 26958 - DNA, 534 bp, Homo sapiens
cataaaaggaatctgttttggctgctttctctgcagcctggcattcttttcggctgctgaacaatgtgcagaaagagccagcttcctgatggtcctataacccgtatccccacattcctctgggagtcacactgagaagtcatcttggattgggacaagtgtcttgcatgctagggttgccttagaaaacacagactttatactttttttgttgtgaactaaaaattaaatttaactacatttcttcttacttgtagaagaaatgtcttctctccttgcactgacaattctaaagaaagtctcaattgtaggctagtgtttcttctctcttaaaaaaatgaaagaattgatgatgtcttcctaaactggaaaggaggaggagttttgttcaattcgataaaaatgtgtatcccacattctttcatgaagatcttaccccattcaaagagaaaatgagaacactttagtgtgtatattaatgtatatattttcgagctggtctttggtagccaggttttgttttgtgaaatgaca

SEQ ID NO: 26959 - DNA, 919 bp, Homo sapiens
aagaaaagaaatctgtttctaccaaacatttccagaaacgtatttatagcatgaagaaacacacatgggtagtgtgacctgtttggatgtgattacttaaaaatggaatgctctgaataggcactctctacattaaaggtatggaaggcgataggggtcagaattttaaaaatttaattttgaaaaaggtgactcacccctcatttccagagtgtaggcaattatgtcctgctttgataaaactgctagaggatggctatgcaaaagcataacgattcaaggaaacaaagtacaggtagtttttgagctgacagcagcaaaggcaccataagtcaaaatattggttttggtggagatgatcgatgtgtgtgtgtgagagagagctatgtttctaaccaagggcctaatgtttgttacagaaatgatcccagagacctacaagatgtgggaatcagcataacagggcaatgcagcaattaaccccacatcgttttctgtagttcctttttgtttcattttcttctgtctcacctcgttagaaaattcctcccagtcaggggtcgtccagtgcaggacgggggacccaagggtctcaagcctgcaagtccagaaggtgacaaacccaggagcactgggagttaagctttccttggggagggaagagccttgatgtccagcacacagcctggctataaagacacgaagcgacctacccactgtacagtccacttcacaggatcagctgaatcatgacctttaaaagttccgagttgaaactgaaggctctcctcagacctggctttttcctcagtccctgttcataccatctctgcacccacaatcacactgatttttcaaattcattttgtttttgctgtttcatttctggcattaataaaagtcttataaggagaaaaaa

SEQ ID NO: 26960 - DNA, 309 bp, Homo sapiens
tacaagagaagagacgagatgtacaagagatgagacgagatgtacaaggaagagccttgatgtccagcacacagcctggctataaagacacgaagcgacctacccactgtacagtccacttcacaggatcagctgaatcatgacctttaaaagttccgagttgaaactgaaggctctcctcagacctggctttttcctcagtccctgttcataccatctctgcacccacaatcacactgatttttcaaattcattttgtttttgctgtttcatttctggcattaataaaagtcttataaggagaaaaaa

SEQ ID NO: 26961 - DNA, 559 bp, Homo sapiens
agttcagggagatcacattaattgcctgagttcccaagttggttaagagactaagctagatctcaacccttcaggctgaatccaaagctactttccttgaatggtttgtaagatttttccatttcttttttaaaaaaatggtatgttcaaatatctttctcatcaataaatatttatcttcatcattcttcctaatgacattcccttgtatgaatgtgccaatgtggaataaccagttccgtcttgttgggctttcagatgttttctttttgtaaatgataaacaatgcagttataactatctttatatataaactttgcaatagtatgagtattttcctagaataaatactggaaagtgaaattgcgtggtcaaaggccagacacatttttaaaagctgcctctttcccaatcacacatttcccacatccatttatttgctgaggatcttcacaaaatttggactgagattaaacacagaatcagagaagccctatgctggaaagatcttagtatatacctcttgaactaaaccagtcttactttagaaaaaaaaaaa

SEQ ID NO: 26962 - DNA, 271 bp, Homo sapiens
tggtaaatattaacatagcaccaaattttgtaattaagtataaatgactatacatttgaatttagtttagggcaagattttatacaaggtcataagattaaatacagagttatttgccccataaaattagtactcagtactataatgaagacatacttttgcaaatcatcattcagcagaagttctttatcccacagctatatctatctacaatttcaattttaggatctcaatgccctttaaaaaattgtatgggccaggcgaggtggcc

SEQ ID NO: 26963 - DNA, 403 bp, Homo sapiens
gccccaaaaaataaataaataaaataaggagaatggtcaaggccatggtataaaaaaaaaccctccagccaagggctactgcacccaggagaaacccaagactccctgcacctgctgtgaaaggcaggacataaagtgtcagaaaaaagctcaaatctgctctaaaagtctccagtatttaagcctttatataagccaagaggaaagatggcttagtagtaaacaaaagcaatctgtttgtgcacttcctactccaaccacctggtgtcaaataagagagttcctaagggcagcaaggttctgctgcatttagatcccaaatttctagcttatggctaagccacaaagagaaggaaagaaagagcccctcctctaggaggctaaccaggagaagacttttaaa

SEQ ID NO: 26964 - DNA, 495 bp, Homo sapiens
aaccacatcaaagttaagtaaaataagaaatgtaccgtctcatccaaggagagagttggattcatacatggaggaatccttggttcaaaggatgtatgccgtcagaactttgtctttctccacctttccactcagatgttccttgtgttgtctcattattaggcaaatggcaagattacctggaccagctccagggtctaaagctaggatttagctccaggcctggctctttcatttttttttttttggaaccacttttttaggtggaaacttccttggaagttgagaaatttgtcctaaggcttactaggaattggcaaaagggcaataggatatgtcattccaggacagtgtgtctgccagccaactggaatgcgaacagggcactctgcctgggaatatgagcagctgcgtagatctatccacttttgctggggatcaccagtgaggaaccatggtcaggctgcctgggtttaaatttagggtccactactc

SEQ ID NO: 26965 - DNA, 1821 bp, Homo sapiens
cgcgtgaactgcttcctgcaggctggccatggcgcttcacgttcccaaggctccgggctttgcccagatgctcaaggagggagcgaaacacttttcaggattagaagaggctgtgtatagaaacatacaagcttgcaaggagcttgcccaaaccactcgtacagcatatggaccaaaaggaatgaacaaaatggttatcaaccacttggagaagttgtttgtgacaaacgatgcagcaactattttaagagaactagaagtacagcatcctgctgcaaaaatgattgtaatggcttctcatatgcaagagcaagaagttggagatggcacaaactttgttctggtatttgctggagctctcctggaattagctgaagaacttctgaggattggcctgtcagtttcagaggtcatagaaggttatgaaatagcctgcagaaaagctcatgagattcttcctaatttggtatgttgttctgcaaaaaaccttcgagatattgatgaagtctcatctctacttcgtacctccataatgagtaaacaatatggtaatgaagtatttctggccaagcttattgctcaggcatgcgtatctatttttcctgattccggccatttcaatgttgataacatcagagtttgtaaaattctgggctctggtatcagttcctcttcagtattgcatggcatggtttttaagaaggaaaccgaaggtgatgtaacatctgtcaaagatgcaaaaatagcagtgtactcttgtccttttgatggcatgataacagaaactaagggaacagtgttgataaagactgctgaagaattgatgaattttagtaagggagaagaaaacctcatggatgcacaagtcaaagctattgctgatactggtgcaaatgtcgtagtaacaggtggcaaagtggcagacatggctcttcattatgcaaataaatataatatcatgttagtgaggctaaactcaaaatgggatctccgaagactttgtaaaactgttggtgctacagctcttcctagattgacacctcctgtccttgaagaaatgggacactgtgacagtgtttacctctcagaagttggagatactcaggtggtggtttttaagcatgaaaaggaagatggcgccatttctaccatagtacttcgaggctctacagacaatctgatggatgacatagaaagggtagtagacgatggtgttaatactttcaaagttcttacaagggataaacgtcttgtacccggaggtggagcaacagaaattgaattagccaaacagatcacatcatatggagagacatgtcctggacttgaacagtatgctattaagaagtttgctgaggcatttgaagctattccccgcgcactggcagaaaactctggagttaaggccaatgaagtaatctctaaactttatgcagtacatcaagaaggaaataaaaacgttggattagatattgaggctgaagtccctgctgtaaaggacatgctggaagctggtattctagatacttacctgggaaaatattgggctatcaaactcgctactaatgctgcagtcactgtacttagagtggatcagatcatcatggcaaaaccagctggtgggcccaagcctccaagtgggaagaaagactgggatgatgaccaaaatgattgaaattggcttaatttttactgtaggtgaaggctgtatttgtagtagtactcaagaatcacctgatgttttcttattctccttaaattaagagttattttgtgtttgtattcttggctggatgttataataaacatattgttactgtc

SEQ ID NO: 26966 - DNA, 298 bp, Homo sapiens
accaaccctatgagatgtgcgctggaagtaacatcaaagaggcacggttggacaatcactaagaaaaagatgggtccaggcgcagtggctcatacctgtaatcccaccactttggaaggccaaggcaggtggatcacttgaggtcaggagttcaagaccagcctggccaatatggcaaaaccctgtctctattaaacatacaaaaatttgaccgggtacggtggcttacgcctgtaatcccagcacttaaagaggctgaggcagatggatcacttgaggtcagaagtttgagaccagc

SEQ ID NO: 26967 - DNA, 425 bp, Homo sapiens
aagcactttaagatttgagatccactgctttaagtgataccatctgacatcagtttatctgcctgtgtgaaataaagtcttttactgcacaggtgtctacaacaggggccaccatcatcgctaccgtcaacgtggttggatgtctgaaagaagaagctgagtatcaatgttgactctcactcatgtcatcttattaaaaaaaaaacagtttacaaaacaattgctactgataaatgcagtgtgaaagactggttttaaggcactggtttaaggcactgctttatgtccacccagataacttgagtttttaactaaaagtttcaaatcactatcttctttatacttactaaagttcgttttgcagaagcagatagtttctaaggaatgatccattcatgggaaggagatataaaataaaataaaac

SEQ ID NO: 26968 - DNA, 383 bp, Homo sapiens
ttcatttattcttaagagtagtaggaaatgaattttttattttctcatcatgcccatgatactctgagcttcttgttcatcttctaaatactttaaagatgatcatatgatttttgcccataagagtatccccataggagcagaaaaagcatttaagaaaattcaacattttttcgtgataaaaattctatgaacaaattaggtatagaagaaatgtttctcaacacaagaaggtctatatatgacaggcccacaactaacattgtacttaatggtgaaaagccgaaagcttttcttttaagatcaggaacaagatcaggatgctcactctcaacacttcttttcagcatagtactgttaagccctagctagagcacttaggc

SEQ ID NO: 26969 - DNA, 474 bp, Homo sapiens
ggacctaggtggtgagctatcccatagttcattctcaacgtctttactgcactgtttagggtcagatacacatatatatacaactttgggtgagctcaggagtttataagctttatgggcttggtgttttgatttataaacaggagtttatagaactttatgggtttgcttcctctttctgccagttccttggtattttccagcccttagaactcctctttcgggtctgtgtcccaaaagctggttctttagttaccctactctgttgaacagtttccacagctgtgtccatgtcctaggccacatggtgggaggacaggggaaggggaaagcaagggggttcgctcatgccctaagaactcgggttcctctgagtcgactcctctgttgtggacatctgtagcctcctgctgctgcattgcctctgacacttcaggattgtctggggtctgaaatctaagtgagaatgaagga

SEQ ID NO: 26970 - DNA, 400 bp, Homo sapiens
cattctccaaaataactgaccttcaaaagtgtgaggtcatgaaagacaaggacagactggattcacagtcagagattggagagacacgtcaactcaaggcaatgtgggatcctgaaacatagacaagtatagtagtgggaaaactgggtgaacacagaaagtctgtagtttagttaatgctatggtagaatagcattaactaaattggctaatattggcttctcattttgatagttgtactgtgattacacaggatgctaacattaggggaagatgagtgaaggttatactttatcatttttgcaacttttttcatatgtctaaaattattaaaattttaaactaaagttataaaagagaagtctttaggttgtttattgttctttatattttgactcta

SEQ ID NO: 26971 - DNA, 215 bp, Homo sapiens
ttgcctatttttaaatatttatttttcaatttaaacttttaaaaattctactgggattttcatcttttccaggaacattattcaagtcttatttaataacatgtccttcattaattcattcaacaaatgtttattgagcacttaatatgagccaggaattattttaggtactgaatataaagaacaaatagaattccttgcccttatggagctta

SEQ ID NO: 26972 - DNA, 641 bp, Homo sapiens
aaaaaaaaaaaaaatcaaaaacaaacacaaaaaaaacaagcaggggtcgactactgctgggggaggagcaagaaactcacccaagaccagtgcaagtgagacaggttttgctgccacagagaagggggaaggattgctaaacatggaaaagaaatcccaccttagagggccagatgtacagagcctgcctaatactgaagctggagcacgacaaaagagaacatgcccattcctgccagcctaacatgttgtaataaggaagagcaggccactgctgggagaagagtaggagcatggagaattacctcatttaaggcccaggcatgcaggatggctggaagttgagggaggtcaagaacactcacacaaaaagcccctggcaccccagctccaactcaaagttcaagataaccgcagtctacctttgtaagaatgtgaaggctgtggtgcactggaagtaacaacaaaactcaaactcaggtcaacccctgagattgactcagccttctcacctccatgctgacaacttcacagaagaagaggcatgttgatttccagccgtaaatactatttacctcagtctctactgctcttctatgcttgatgtctggcactcaactaaaaattatcacacaccaaaa

SEQ ID NO: 26973 - DNA, 430 bp, Homo sapiens
tttgatgcgcatattaagccaaacagatcaagaagagaaaagtgtcttccaagagttcagggttgcaatgcactgagcccaaatgactcattgcaggaacatcactcccttctggaaggagacagtgaggtggaagcaggtgagggcaaagtgtagaggtgcaaggggttcagtgatgctgactgtctggcatttttgctccagatcttctaactccccttctcaaaagtgaataacacatacttagtgacagtgacagtcaaacgtttctgataattgtgtcttctaaagtagcaccagttcaaaggaagtaacagtaattgagcaacttcacttatcaaatgatggtatgtcaattagaggcttaaaagtgtcaaatctgaatcttcagtgttttgctgtaattcacattatgctgtttactatagag

SEQ ID NO: 26974 - DNA, 289 bp, Homo sapiens
gattcaatagatctgggggtgggcccaagaatctgccttttttgtaagtactcaggtgattctgctgctgggactggtgagggaatggagcctggccaacagcactttctgtaggcatcatcactaagtagggattggctaatccttgtggatttgtttcacggaattttccttttctttttttttttttttcttgaggtaactgcttagaaatccatctgttgcctattaaagaagactggaggctgtacgcagtggctcacgcctgtaatcccagcactttgggagg

SEQ ID NO: 26975 - DNA, 505 bp, Homo sapiens
aaagcaataattattcagtttatgaaaatgaagagaataaaatcatcttatttctaaattacatggaaatcaaaaaggctcaactaaaatattttcctctttaaatataggtatgtattaactgggttttactacttagtctcacaatgggaatactgtacaagttgtaaaaaatgaacttagtaaacaagagattatcacaaaatgacacgtaacaaagagttacataaagttttaaaaattactttaaccacatatattaataatataaacacctccaaaaaaagaaacttggaccttttttttcaagtttattaaaatttttttccctgttgtcttcctgcttttccacctttactggggtataactgacaattaaaaattataaggccaggcatgattgattatgcctgtaaccccagcactttgggaggccaagggggacagatcacttgagcccaggagttcgagaccagcaggggcaacacagtgagaccctgcctct

SEQ ID NO: 26976 - DNA, 437 bp, Homo sapiens
atttactaaaattatatgaactgtggactcttagggctgctgtaggattcctgtttacatctgttaagttttttgtctgcttttatctggagtcacttttattggttgcataagatggctaaatctcagccaagaagaacctggttgtgttgttctacgcaaatgtatttttgaaagataatgcataatgagaggtgaaataaaagaatgctcaaagacaataagagggcagtacaattgacccttgagcaacatggggttaagggtgccaaccccttgcacaattgaaaatctgagtataagttttgacttccccaaaatttaactactaatagcctactgtaaagtcagttaacacgttgtttgttatatgcattacatactatattcttacaataagctaaaggaaaataaattcctaaggaagaaaaaataca

SEQ ID NO: 26977 - DNA, 434 bp, Homo sapiens
gcaaaaagaaattaaaattgaggatttaagatatccacaggtcctccttgtgaacaccaaatgacagtaaaaaagcaatttatctgctgccaggattggggttttaagttcattaaattaactttaataggggtaagaatttctaaattgctagatcacttatgtgagatttgaaccaaatttaataccaaagagttattgaatgcctactgtgtgccaattctattgctaagcatagaaagacatgagtgaagagacctgctgctaacattcaaggattctttcagtgtccagcttgaaaaatgaaccgtaatgaatgtctgggagagcattacctcactgctcctccttcctgtggatgattttagtttcaaaccacaaacatatatgaaaaggaatgaccagaattttcgctgtcaaaaaaacctgctgct

SEQ ID NO: 26978 - DNA, 483 bp, Homo sapiens
tacccttcctcccaaaaaagaataaaatatttttctgtgtggtggactggctagtgcaaatttaattcttaagtttaaaaatcacgtagtcagtagtatttctttagaagtgttgctttgatgtagcattgtgctcttatggtttgtagattgtctgcaattgagagatggcttctcatttgaggaagagaggtcacagagggaactctgtcaatgaactttggacacaaggccctttgaacttcagttccttgttacaaacttgcgatacctgctctaattcacatgaatcaatgtgtatcaaaaagctataagtagagtaatctgattaattttatgcagttatgtaagaaagttatgatttggtcttcagaatcaatataattctttgccctctgcccccaccccagcccgttgtggtgggagaatttgtcttctaaaatctcttggattcagtttcccatgcttatataaaagcattta

SEQ ID NO: 26979 - DNA, 383 bp, Homo sapiens
tctcacatgacctaatcctatttagccatttggggccccagatcttactaaaaccctacaggaaaaggcacccatataacaatcttataaatggctcttaatgagtaatgtgtgaaaaaacaaaaggacagtaagagttggtgagcaaaatgagctcagtggttatactctcattcacacagaaaatggagaaataacagtcagaaacagtcattcaaaaagttttaaaccagacatcaatcccaatttgtctgaagaaagatattcaactttctactcttctactgaactttctacattgcatgatggacaaaaatcataaatacaatttcaagaatgacaaaaatatcagcaggacagtgaacctcgcattaaaaagatga

SEQ ID NO: 26980 - DNA, 2001 bp, Homo sapiens
gcgcgcttccttgcgcgagccgggctgtcgggtgtgttttgctctccatcctccgtcgtctctgcagcactccgggttctcctccagagcgctagtcccaggagctcggaatgttcgtggaacttaataacctgcttaacaccacccccgacagggcggagcaggggaaactgactctactctgtgatgccaagacagatgggagtttccttgtacaccactttctctccttctatctcaaagctaattgtaaagtctgctttgtggcactcatccagtccttcagccactacagtatcgtgggacagaagctgggtgtcagcctgaccatggcgcgggagcgtgggcagcttgtgttccttgagggactcaagtctgcagtggacgtcgtcttccaggctcaaaaggagccacaccccctgcagtttctcagggaggctaatgctgggaacttgaaaccattgtttgagtttgtacgggaggccctgaagccagtagacagtggagaggctcggtggacgtacccggtgctgttggtggacgacctcagtgtgctcctgagcctgggcatgggggcggtggctgtgctagacttcattcactactgcagagccaccgtgtgctgggaactaaagggaaacatggtggtccttgtgcacgacagtggagatgcggaggatgaggagaatgacatcctgctgaatggcctcagtcatcagagccatctgatactgcgggctgagggcctggccactggcttctgcagggatgtgcacgggcaggtatgcaggggcctcctgggcaacgggcttcttgcccgtgtacctgtgattcttgactacataggggagagtcaggcctgagggactgtctggttgggacatgacttcaggtggaagggaaacactggaaattgtgagacttcaggtaatagacctgctccagattgcgcttagcctcatggaccagcccacgttttccatgggggtcccatttgtgaccaaagtggggcactcttaaagaggagacagctgtctagagtggaatgcaggggcatgccatcaaataacagcaaaattcctccgcagtactgcagcaggcgtcgtctattcaggtcaacactgcactccagcctgggcgacagagtgagactctgtctcaaaaaaagaaaaaagaaaaacgacttggggaggccgtacccgtggaccagggttgctgccccaactgctgccactcaccagaacaattggagtacttgggcagaaactgagagtcctgccctgggagggaagctggattctacccctctaaatgggctgccatgtggctctgtgccttctcaaacttctcttctggaaccactcccaagcctccaccacagcttcctggttaacttcaagttgagcactcctgacccaataagagtggctaggagtcttggcccagagtccttcagaggcaagtctggtaggtcacacagaggaccaagcccagcagtactatgtgtgtagtgctgcagcagggcctgaggagaaggtgctgctgggcagctgtggcctctcttcagccagacccccagagcattgtagtcagcagtaacaccatcaaaacaggtatctagccttcctgggcctctgtagtgaatgtacaaattctaatgtgattttcaaaattagtctagcccgcaagtacaaaaccatgcttagaagaaagaacaaagggaccgggcacagtggctcacgcctgtaatcccagcactttgggaggccgaggtgggcggatcacctgaggtcagagttccagaccagcctggccaacatagtgaaaccccgcctctactaaaaatacaaaaattgcccaggcatggtgatgcgcacccataatccagctacttgggaggctgaagcaggagaattgcctgaacctgggaggcagaggttgcagtaagccaagattgcgccactgcactccagcctgggcaacagagtgagactctgcttc

SEQ ID NO: 26981 - DNA, 858 bp, Homo sapiens
gcgcgcttccttgcgcgagccgggctgtcgggtgtgttttgctctccatcctccgtcgtctctgcagcactccgggttctcctccagagcgctagtcccaggagctcggaatgttcgtggaacttaataacctgcttaacaccacccccgacagggcggagcaggggaaactgactctactctgtgatgccaagacagatgggagtttccttgtacaccactttctctccttctatctcaaagctaattgtaaagtctgctttgtggcactcatccagtccttcagccactacagtatcgtgggacagaagctgggtgtcagcctgaccatggcgcgggagcgtgggcagcttgtgttccttgagggactcaagtctgcagtggacgtcgtcttccaggctcaaaaggagccacaccccctgcagtttctcagggaggctaatgctgggaacttgaaaccattgtttgagtttgtacgggaggccctgaagccagtagacagtggagaggctcggtggacgtacccggtgctgttggtggacgacctcagtgtgctcctgagcctgggcatgggggcggtggctgtgctagacttcattcactactgcagagccaccgtgtgctgggaactaaaggtactcatggaactgccttctctgcgcccacctgtgacctccaagaactcagacaggtccagacctcacttgcttgctgtgatctttttatttgcttggggttttggctttactctggcaggcccagaaagcttttgcagccaccctgttttcccttacctgccattgctgaaaagtaaagccccccaaaataaagggatgatcaacattgcattcagtgggg

SEQ ID NO: 26982 - DNA, 1340 bp, Homo sapiens
gcgcgcttccttgcgcgagccgggctgtcgggtgtgttttgctctccatcctccgtcgtctctgcagcactccgggttctcctccagagcgctagtcccaggagctcggaatgttcgtggaacttaataacctgcttaacaccacccccgacagggcggagcaggggaaactgactctactctgtgatgccaagacagatgggagtttccttgtacaccactttctctccttctatctcaaagctaattgtaaagtctgctttgtggcactcatccagtccttcagccactacagtatcgtgggacagaagctgggtgtcagcctgaccatggcgcgggagcgtgggcagcttgtgttccttgagggactcaagtctgcagtggacgtcgtcttccaggctcaaaaggagccacaccccctgcagtttctcagggaggctaatgctgggaacttgaaaccattgtttgagtttgtacgggaggccctgaagccagtagacagtggagaggctcggtggacgtacccggtgctgttggtggacgacctcagtgtgctcctgagcctgggcatgggggcggtggctgtgctagacttcattcactactgcagagccaccgtgtgctgggaactaaagggaaacatggtggtccttgtgcacgacagtggagatgcggaggatgaggagaatgacatcctgctgaatggcctcagtcatcagagccatctgatactgcgggctgagggcctggccactggcttctgcagggatgtgcacgggcagctgaggatcctgtggaggagaccatcgcagcccgcagtccaccgggatcagagcttcacttaccagtataagatacaggacaaaagcgtgtccttttttgccaaaggaatgtctcctgctgttctgtgacctgatttcggagcagctgaagctacataggactgtttttggacgtggaagatagagcaacatagcaagaatgggtctttctcctctgtagtaatatttcaggctggaccggcgactccactgtgaccagagggttgagtgctgcagtgatggcatgccttggctgccctgggccctgttcagaaaacacaagggaccacaatcctgcctttgctgagagagaggctggatgctagacccaagtgaaaggggtcctttggagcctttgtttaaatatgccttagccccagctgcccatttttggttgacaagcctttcagagccagagtgggtatagatgtgccagccaggagatggcaccggatggcaggtgtgcaaggtgacaactaggataatcatggctggaataaagtaagtttccacactgga

SEQ ID NO: 26983 - DNA, 1352 bp, Homo sapiens
atcgacccggggattggactggaggcttgggcccgccgaaagtgggcttctgggccatctcgcatattctcaacggctgtgcgtgtccttaaaagtccctgggaagcggccgggcgcggtggctcacccctgtaatcccagcagtttgggaggccgaggcgggtgcatcatctaaggggaaactgactctactctgtgatgccaagacagatgggagtttccttgtacaccactttctctccttctatctcaaagctaattgtaaagtctgctttgtggcactcatccagtccttcagccactacagtatcgtgggacagaagctgggtgtcagcctgaccatggcgcgggagcgtgggcagcttgtgttccttgagggactcaagtctgcagtggacgtcgtcttccaggctcaaaaggagccacaccccctgcagtttctcagggaggctaatgctgggaacttgaaaccattgtttgagtttgtacgggaggccctgaagccagtagacagtggagaggctcggtggacgtacccggtgctgttggtggacgacctcagtgtgctcctgagcctgggcatgggggcggtggctgtgctagacttcattcactactgcagagccaccgtgtgctgggaactaaagggaaacatggtggtccttgtgcacgacagtggagatgcggaggatgaggagaatgacatcctgctgaatggcctcagtcatcagagccatctgatactgcgggctgagggcctggccactggcttctgcagggatgtgcacgggcagctgaggatcctgtggaggagaccatcgcagcccgcagtccaccgggatcagagcttcacttaccagtataagatacaggacaaaagcgtgtccttttttgccaaaggaatgtctcctgctgttctgtgacctgatttcggagcagctgaagctacataggactgtttttggacgtggaagatagagcaacatagcaagaatgggtctttctcctctgtagtaatatttcaggctggaccggcgactccactgtgaccagagggttgagtgctgcagtgatggcatgccttggctgccctgggccctgttcagaaaacacaagggaccacaatcctgcctttgctgagagagaggctggatgctagacccaagtgaaaggggtcctttggagcctttgtttaaatatgccttagccccagctgcccatttttggttgacaagcctttcagagccagagtgggtatagatgtgccagccaggagatggcaccggatggcaggtgtgcaaggtgacaactaggataatcatggctggaataaagtaagtttccacactgga

SEQ ID NO: 26984 - DNA, 1254 bp, Homo sapiens
atcgacccggggattggactggaggcttgggcccgccgaaagtgggcttctgggccatctcgcatattctcaacggctgggaaactgactctactctgtgatgccaagacagatgggagtttccttgtacaccactttctctccttctatctcaaagctaattgtaaagtctgctttgtggcactcatccagtccttcagccactacagtatcgtgggacagaagctgggtgtcagcctgaccatggcgcgggagcgtgggcagcttgtgttccttgagggactcaagtctgcagtggacgtcgtcttccaggctcaaaaggagccacaccccctgcagtttctcagggaggctaatgctgggaacttgaaaccattgtttgagtttgtacgggaggccctgaagccagtagacagtggagaggctcggtggacgtacccggtgctgttggtggacgacctcagtgtgctcctgagcctgggcatgggggcggtggctgtgctagacttcattcactactgcagagccaccgtgtgctgggaactaaagggaaacatggtggtccttgtgcacgacagtggagatgcggaggatgaggagaatgacatcctgctgaatggcctcagtcatcagagccatctgatactgcgggctgagggcctggccactggcttctgcagggatgtgcacgggcagctgaggatcctgtggaggagaccatcgcagcccgcagtccaccgggatcagagcttcacttaccagtataagatacaggacaaaagcgtgtccttttttgccaaaggaatgtctcctgctgttctgtgacctgatttcggagcagctgaagctacataggactgtttttggacgtggaagatagagcaacatagcaagaatgggtctttctcctctgtagtaatatttcaggctggaccggcgactccactgtgaccagagggttgagtgctgcagtgatggcatgccttggctgccctgggccctgttcagaaaacacaagggaccacaatcctgcctttgctgagagagaggctggatgctagacccaagtgaaaggggtcctttggagcctttgtttaaatatgccttagccccagctgcccatttttggttgacaagcctttcagagccagagtgggtatagatgtgccagccaggagatggcaccggatggcaggtgtgcaaggtgacaactaggataatcatggctggaataaagtaagtttccacactgga

SEQ ID NO: 26985 - DNA, 1698 bp, Homo sapiens
atcgacccggggattggactggaggcttgggcccgccgaaagtgggcttctgggccatctcgcatattctcaacggctgtgcgtgtccttaaaagtccctgggaagcggccgggcgcggtggctcacccctgtaatcccagcagtttgggaggccgaggcgggtgcatcatctaaggtcaagagttcgagacaagtctggccaagatggtgaaacccccgtctctacgaaaaatacaaaaattagccgggcgtggtggctcatgcctgtaatctcagctactcgggaggctgagacaggagaattgcttgaacccgggaggcggaggttgcagtgacccgagatctcgccaccgcactccagcctgggcgacagagcgggactccacctcaaaaaaaaaaaaaaaaatgaaaaaacctgaagcccagagaagttaaggcatttgtggaaggtcacacggcaaggaggtggcatgcatgatatcacttgatcctgaccttccctgtcactgacagaaatagaggggaaactgactctactctgtgatgccaagacagatgggagtttccttgtacaccactttctctccttctatctcaaagctaattgtaaagtctgctttgtggcactcatccagtccttcagccactacagtatcgtgggacagaagctgggtgtcagcctgaccatggcgcgggagcgtgggcagcttgtgttccttgagggactcaagtctgcagtggacgtcgtcttccaggctcaaaaggagccacaccccctgcagtttctcagggaggctaatgctgggaacttgaaaccattgtttgagtttgtacgggaggccctgaagccagtagacagtggagaggctcggtggacgtacccggtgctgttggtggacgacctcagtgtgctcctgagcctgggcatgggggcggtggctgtgctagacttcattcactactgcagagccaccgtgtgctgggaactaaagggaaacatggtggtccttgtgcacgacagtggagatgcggaggatgaggagaatgacatcctgctgaatggcctcagtcatcagagccatctgatactgcgggctgagggcctggccactggcttctgcagggatgtgcacgggcagctgaggatcctgtggaggagaccatcgcagcccgcagtccaccgggatcagagcttcacttaccagtataagatacaggacaaaagcgtgtccttttttgccaaaggaatgtctcctgctgttctgtgacctgatttcggagcagctgaagctacataggactgtttttggacgtggaagatagagcaacatagcaagaatgggtctttctcctctgtagtaatatttcaggctggaccggcgactccactgtgaccagagggttgagtgctgcagtgatggcatgccttggctgccctgggccctgttcagaaaacacaagggaccacaatcctgcctttgctgagagagaggctggatgctagacccaagtgaaaggggtcctttggagcctttgtttaaatatgccttagccccagctgcccatttttggttgacaagcctttcagagccagagtgggtatagatgtgccagccaggagatggcaccggatggcaggtgtgcaaggtgacaactaggataatcatggctggaataaagtaagtttccacactgga

SEQ ID NO: 26986 - DNA, 1361 bp, Homo sapiens
gcgcgcttccttgcgcgagccgggctgtcgggtgtgttttgctctccatcctccgtcgtctctgcagcactccgggttctcctccagagcgctagtcccaggagctcggaatgttcgtggaacttaataacctgcttaacaccacccccgacagggcggagcaggggaaactgactctactctgtgatgccaagacagatgggagtttccttgtacaccactttctctccttctatctcaaagctaattgtaaagtctgctttgtggcactcatccagtccttcagccactacagtatcgtgggacagaagctgggtgtcagcctgaccatggcgcgggagcgtgggcagcttgtgttccttgagggactcaagtctgcagtggacgtcgtcttccaggctcaaaaggagccacaccccctgcagtttctcagggaggctaatgctgggaacttgaaaccattgtttgagtttgtacgggaggccctgaagccagtagacagtggagaggctcggtggacgtacccggtgctgttggtggacgacctcagtgtgctcctgagcctgggcatgggggcggtggctgtgctagacttcattcactactgcagagccaccgtgtgctgggaactaaagggaaacatggtggtccttgtgcacgacagtggagatgcggaggatgaggagaatgacatcctgctgaatggcctcagtcatcagagccatctgatactgcgggctgagggcctggccactggcttctgcagggatgtgcacgggcagctgaggatcctgtggaggagaccatcgcagcccgcagtccaccgggatcagagcttcacttaccagtataagatacaggacaaaagcgtgtccttttttgccaaaggaatgtctcctgctgttctgtgacctgatttcggagcagctgaagctacataggactgtttttggacgtggaagatagagcaacatagcaagaatgggtctttctcctctgtagtaatatttcaggctggaccggcgactccactgtgaccagagggttgagtgctgcagtgatggcatgccttggctgccctgggccctgttcagaaaacacaagggaccacaatcctgcctttgctgagagagaggctggatgctagacccaagtgaaaggggtcctttggagcctttgtttaaatatgccttagccccagctgcccatttttggttgacaagcctttcagagccagagtgggtatagatgtgccagccaggagatggcaccggatggcaggtgtgcaaggtgacaactaggataatcatggctggaataaagtaagtttccacactggacaacaaccacaaaacaacaaa

SEQ ID NO: 26987 - DNA, 1269 bp, Homo sapiens
gcgcgcttccttgcgcgagccgggctgtcgggtgtgttttgctctccatcctccgtcgtctctgcagcactccgggttctcctccagagcgctagtcccaggagctcggaatgttcgtggaacttaataacctgcttaacaccacccccgacagggcggagcaggggaaactgactctactctgtgatgccaagacagatgggagtttccttgtacaccactttctctccttctatctcaaagggtgtcagcctgaccatggcgcgggagcgtgggcagcttgtgttccttgagggactcaagtctgcagtggacgtcgtcttccaggctcaaaaggagccacaccccctgcagtttctcagggaggctaatgctgggaacttgaaaccattgtttgagtttgtacgggaggccctgaagccagtagacagtggagaggctcggtggacgtacccggtgctgttggtggacgacctcagtgtgctcctgagcctgggcatgggggcggtggctgtgctagacttcattcactactgcagagccaccgtgtgctgggaactaaagggaaacatggtggtccttgtgcacgacagtggagatgcggaggatgaggagaatgacatcctgctgaatggcctcagtcatcagagccatctgatactgcgggctgagggcctggccactggcttctgcagggatgtgcacgggcagctgaggatcctgtggaggagaccatcgcagcccgcagtccaccgggatcagagcttcacttaccagtataagatacaggacaaaagcgtgtccttttttgccaaaggaatgtctcctgctgttctgtgacctgatttcggagcagctgaagctacataggactgtttttggacgtggaagatagagcaacatagcaagaatgggtctttctcctctgtagtaatatttcaggctggaccggcgactccactgtgaccagagggttgagtgctgcagtgatggcatgccttggctgccctgggccctgttcagaaaacacaagggaccacaatcctgcctttgctgagagagaggctggatgctagacccaagtgaaaggggtcctttggagcctttgtttaaatatgccttagccccagctgcccatttttggttgacaagcctttcagagccagagtgggtatagatgtgccagccaggagatggcaccggatggcaggtgtgcaaggtgacaactaggataatcatggctggaataaagtaagtttccacactgga

SEQ ID NO: 26988 - DNA, 1183 bp, Homo sapiens
atcgacccggggattggactggaggcttgggcccgccgaaagtgggcttctgggccatctcgcatattctcaacggctgggaaactgactctactctgtgatgccaagacagatgggagtttccttgtacaccactttctctccttctatctcaaagggtgtcagcctgaccatggcgcgggagcgtgggcagcttgtgttccttgagggactcaagtctgcagtggacgtcgtcttccaggctcaaaaggagccacaccccctgcagtttctcagggaggctaatgctgggaacttgaaaccattgtttgagtttgtacgggaggccctgaagccagtagacagtggagaggctcggtggacgtacccggtgctgttggtggacgacctcagtgtgctcctgagcctgggcatgggggcggtggctgtgctagacttcattcactactgcagagccaccgtgtgctgggaactaaagggaaacatggtggtccttgtgcacgacagtggagatgcggaggatgaggagaatgacatcctgctgaatggcctcagtcatcagagccatctgatactgcgggctgagggcctggccactggcttctgcagggatgtgcacgggcagctgaggatcctgtggaggagaccatcgcagcccgcagtccaccgggatcagagcttcacttaccagtataagatacaggacaaaagcgtgtccttttttgccaaaggaatgtctcctgctgttctgtgacctgatttcggagcagctgaagctacataggactgtttttggacgtggaagatagagcaacatagcaagaatgggtctttctcctctgtagtaatatttcaggctggaccggcgactccactgtgaccagagggttgagtgctgcagtgatggcatgccttggctgccctgggccctgttcagaaaacacaagggaccacaatcctgcctttgctgagagagaggctggatgctagacccaagtgaaaggggtcctttggagcctttgtttaaatatgccttagccccagctgcccatttttggttgacaagcctttcagagccagagtgggtatagatgtgccagccaggagatggcaccggatggcaggtgtgcaaggtgacaactaggataatcatggctggaataaagtaagtttccacactgga

SEQ ID NO: 26989 - DNA, 1364 bp, Homo sapiens
gcgcgcttccttgcgcgagccgggctgtcgggtgtgttttgctctccatcctccgtcgtctctgcagcactccgggttctcctccagagcgctagtcccaggagctcggaatgttcgtggaacttaataacctgcttaacaccacccccgacagggcggagcaggggaaactgactctactctgtgatgccaagacagatgggagtttccttgtacaccactttctctccttctatctcaaagctaattgtaaagtctgctttgtggcactcatccagtccttcagccactacagtatcgtgggacagaagctgggtgtcagcctgaccatggcgcgggagcgtgggcagcttgtgttccttgagggactcaagtctgcagtggacgtcgtcttccaggctcaaaaggagccacaccccctgcagtttctcagggaggctaatgctgggaacttgaaaccattgtttgagtttgtacgggaggccctgaagccagtagacagtggagaggctcggtggacgtacccggtgctgttggtggacgacctcagtgtgctcctgagcctgggcatgggggcggtggctgtgctagacttcattcactactgcagagccaccgtgtgctgggaactaaaggcttccatcttgtatctgatgcagggaaacatggtggtccttgtgcacgacagtggagatgcggaggatgaggagaatgacatcctgctgaatggcctcagtcatcagagccatctgatactgcgggctgagggcctggccactggcttctgcagggatgtgcacgggcagctgaggatcctgtggaggagaccatcgcagcccgcagtccaccgggatcagagcttcacttaccagtataagatacaggacaaaagcgtgtccttttttgccaaaggaatgtctcctgctgttctgtgacctgatttcggagcagctgaagctacataggactgtttttggacgtggaagatagagcaacatagcaagaatgggtctttctcctctgtagtaatatttcaggctggaccggcgactccactgtgaccagagggttgagtgctgcagtgatggcatgccttggctgccctgggccctgttcagaaaacacaagggaccacaatcctgcctttgctgagagagaggctggatgctagacccaagtgaaaggggtcctttggagcctttgtttaaatatgccttagccccagctgcccatttttggttgacaagcctttcagagccagagtgggtatagatgtgccagccaggagatggcaccggatggcaggtgtgcaaggtgacaactaggataatcatggctggaataaagtaagtttccacactgga

SEQ ID NO: 26990 - DNA, 1102 bp, Homo sapiens
ggacgcgtgggtcgacccacgcgtccggcagcactccgggttctcctccagagcgctagtcccaggagctcggaatgttcgtggaacttaataacctgcttaacaccacccccgacagggcggagcaggggaaactgactctactctgtgatgccaagacagatgggagtttccttgtacaccactttctctccttctatctcaaagctaattgtaaagtctgctttgtggcactcatccagtccttcagccactacagtatcgtgggacagaagctgggtgtcagcctgaccatggcgcgggagcgtgggcagcttgtgttccttgagggactcaagtctgcagtggacgtcgtcttccaggctcaaaaggagccacaccccctgcagtttctcagggaaacatggtggtccttgtgcacgacagtggagatgcggaggatgaggagaatgacatcctgctgaatggcctcagtcatcagagccatctgatactgcgggctgagggcctggccactggcttctgcagggatgtgcacgggcagctgaggatcctgtggaggagaccatcgcagcccgcagtccaccgggatcagagcttcacttaccagtataagatacaggacaaaagcgtgtccttttttgccaaaggaatgtctcctgctgttctgtgacctgatttcggagcagctgaagctacataggactgtttttggacgtggaagatagagcaacatagcaagaatgggtctttctcctctgtagtaatatttcaggctggaccggcgactccactgtgaccagagggttgagtgctgcagtgatggcatgccttggctgccctgggccctgttcagaaaacacaagggaccacaatcctgcctttgctgagagagaggctggatgctagacccaagtgaaaggggtcctttggagcctttgtttaaatatgccttagccccagctgcccatttttggttgacaagcctttcagagccagagtgggtatagatgtgccagccaggagatggcaccggatggcaggtgtgcaaggtgacaactaggataatcatggctggaataaagtaagtttccacactgga

SEQ ID NO: 26991 - DNA, 991 bp, Homo sapiens
gcgcgcttccttgcgcgagccgggctgtcgggtgtgttttgctctccatcctccgtcgtctctgcagcactccgggttctcctccagagcgctagtcccaggagctcggaatgttcgtggaacttaataacctgcttaacaccacccccgacagggcggagcaggggaaactgactctactctgtgatgccaagacagatgggagtttccttgtacaccactttctctccttctatctcaaagctaattgtaaagtctgctttgtggcactcatccagtccttcagccactacagtatcgtgggacagaagctgggtgtcagcctgaccatggcgcgggagcgtgggcagcttgtgttccttgagggactcaagtctgcagtggacgtcgtcttccaggctcaaaaggagccacaccccctgcagtttctcagctgaggatcctgtggaggagaccatcgcagcccgcagtccaccgggatcagagcttcacttaccagtataagatacaggacaaaagcgtgtccttttttgccaaaggaatgtctcctgctgttctgtgacctgatttcggagcagctgaagctacataggactgtttttggacgtggaagatagagcaacatagcaagaatgggtctttctcctctgtagtaatatttcaggctggaccggcgactccactgtgaccagagggttgagtgctgcagtgatggcatgccttggctgccctgggccctgttcagaaaacacaagggaccacaatcctgcctttgctgagagagaggctggatgctagacccaagtgaaaggggtcctttggagcctttgtttaaatatgccttagccccagctgcccatttttggttgacaagcctttcagagccagagtgggtatagatgtgccagccaggagatggcaccggatggcaggtgtgcaaggtgacaactaggataatcatggctggaataaagtaagtttccacactgga

SEQ ID NO: 26992 - DNA, 1313 bp, Homo sapiens
ttcctgtggcgagccggggctgtcgggctgtgtttggtgtctcctcatcactccgacgatctcgtagtcagcactcacgggtactgcgctccagacgcgcaagctcgccaggcagtctcgggaatgtgtctggcgaagctcaagtaacccgtgtgttaacctaccagcacaccggaacagagaggagatccagagggagagaacgtgagcctgctaacgtacatgctggatgcgcgaaacgcacgaggagtggcgaagtttcccgtgctacgaggctcatatgtacgttctccttcttcctagatctcaaaacatgcataaaatggtgtacatatcgtcctgctgtaagggggatgtcaatctgcatgccgtgtcagccatttacagataacgtggcgcacagcaagctggatgtcacacctgaccatggtggctggagtgtgggctgtgtgtgttccttgagggagtcaagtacgtgcccgatggagcgtacgatctatgcgcaggctcataggagaggaagccatcaacctcgcgcatgcaggtttctcagggaggctaatgctgggaacttgaaaccattgtttgagtttgtacgggaggccctgaagccagtagacagtggagaggctcggtggacgtacccggtgctgttggtggacgacctcagtgtgctcctgagcctgggcatgggggcggtggctgtgctagacttcattcactactgcagagccaccgtgtgctgggaactaaagctgaggatcctgtggaggagaccatcgcagcccgcagtccaccgggatcagagcttcacttaccagtataagatacaggacaaaagcgtgtccttttttgccaaaggaatgtctcctgctgttctgtgacctgatttcggagcagctgaagctacataggactgtttttggacgtggaagatagagcaacatagcaagaatgggtctttctcctctgtagtaatatttcaggctggaccggcgactccactgtgaccagagggttgagtgctgcagtgatggcatgccttggctgccctgggccctgttcagaaaacacaagggaccacaatcctgcctttgctgagagagaggctggatgctagacccaagtgaaaggggtcctttggagcctttgtttaaatatgccttagccccagctgcccatttttggttgacaagcctttcagagccagagtgggtatagatgtgccagccaggagatggcaccggatggcaggtgtgcaaggtgacaactaggataatcatggctggaataaagtaagtttccacactgga

SEQ ID NO: 26993 - DNA, 326 bp, Homo sapiens
tgtacaccactttctctccttctatctcaaaggtatgggactcattgatgctgtagaaaagaaacccaagatgggtgcagaaataataaaaaccaaaactatttaaggaagcaataacagcatttacaagccaagccttggtgttgggatacctaggggggctattttattaggataacaggttactaggccatctcgttccttccccagccctgccaaagagtggcatgtgctcactgtttctgtgtcctaccttccccttctccacccactgtgtggacattgcctcactgaggtcctatgtggcctcctgattttgttgctcc

SEQ ID NO: 26994 - DNA, 334 bp, Homo sapiens
  misc_feature (25)..(25): n is a, c, g, or t
  misc_feature (37)..(37): n is a, c, g, or t
  misc_feature (71)..(71): n is a, c, g, or t
ctttaagggtcttcctctgaaagantttttccttctntttcctttttttttcctctttcacattttcttgnttgagccaatatgactactgtaatggaggggaaccctttatttgtagttagctggtgataggctttattttacaagttggccccattaccagatggcacatctgactatcatctcatagaggcctcagctgaagggcacagagaaggtagggtggggttcccagtggagcaggtcctggggtggctgctcctctttcattcttctctgtctctgtagctgaggatcctgtggaggagaccatcgcagcccgcagtccaccggg

SEQ ID NO: 26995 - DNA, 700 bp, Homo sapiens
gcgcgcttccttgcgcgagccgggctgtcgggtgtgttttgctctccatcctccgtcgtctctgcagcactccgggttctcctccagagcgctagtcccaggagctcggaatgttcgtggaacttaataacctgcttaacaccacccccgacagggcggagcaggggaaactgactctactctgtgatgccaagacagatgggagtttccttgtacaccactttctctccttctatctcaaagctaattgtaaagtctgctttgtggcactcatccagtccttcagccactacagtatcgtgggacagaagctgggtgtcagcctgaccatggcgcgggagcgtgggcagcttgtgttccttgagggactcaagtctgcagtggacgtcgtcttccaggctgagcctgggcatgggggcggtggctgtgctagacttcattcactactgcagagccaccgtgtgctgggaactaaaggtactcatggaactgccttctctgcgcccacctgtgacctccaagaactcagacaggtccagacctcacttgcttgctgtgatctttttatttgcttggggttttggctttactctggcaggcccagaaagcttttgcagccaccctgttttcccttacctgccattgctgaaaagtaaagccccccaaaataaagggatgatcaacattgcattcagtgggg

SEQ ID NO: 26996 - DNA, 512 bp, Homo sapiens
ctgggaaaagtggcagcttgcaaggaacattacaaagtgcacttagaaattaggtggttaaactgtgccaattgttttcgttgttttataatatcattttccaaaactgtccagtaagttttattatttttaaaactagtttttcaactcattagttctaggctgtactctcttgtaagctttatgataaccactttagttttgtgaataataaattttattcttttgttaatacttgtatacaatttaattgaaaactgtagcttgcacactggaccagatgagtccctcactggcacagtgccctgcacctggagtgatgtttcataaaacggaattttaatagtgtaagagcaccaagatttctctgcacctatacctagcgttggactgtgcattccaaatgaaattcctcctctttatccctgtaatgcactgactaacagaagacttactacacatttaaactgtatattgacatgctattaaatgcgttttttattaaaaaaaaa

SEQ ID NO: 26997 - DNA, 316 bp, Homo sapiens
agtgtggccctcctggcccatttctgcctggagtcaatcactcctatgctgtcctggctcaatgccacttaccatgtcaggcataataatgtgctctcacgtccttctttcccattagtcagtgagtaaagcaaggctgtctcactcttctttgcatccccactgcatagattggaaccaggcagcctgatacctggggaagagtgcaggctttgcagggagacaaacgtggatccaaattccaaatctgaaaaggagctggtggctaattcaagtgaggcactcaaactttctgtgtttcagtgtgttcattgtc

SEQ ID NO: 26998 - DNA, 378 bp, Homo sapiens
gctataaatcatatcttgaactaagttcaaaatttgagtcaaaccaacacaagttgtctgattgcattcctgacccacatggatatcccttgtgtataaaacaagttgccccatcttgatcctttccaatttgtgatctccctgacagaacaccagccatgggggttgtggcttctccacaaaccatctcttgacaagttcagtcccagtggtctctcatggccacctggcataactctacttacagccacacagtcaaacatttaattgtttaattattttgcacagaatgatcctgtctgtctcccagaatctaagctctaggagggagtgaggagggtaggaagcgtgtcttctgagttttcttctacattcagt

SEQ ID NO: 26999 - DNA, 359 bp, Homo sapiens
cgtcgacctgaagcagacaggttgaggggaaatatttgaagtcaggaaatgtttcttaaatatgggctttgttagccctggatgcagagtttcagaagcttaaaagatccaaaatgttttaacacttggaatatttctacttcaatacaaacatctatactaccataaagaactgtaaaaactaaaaagtgaaatctgcccctccaccacccctacccccaacaacaaattcccgcttcccataggtaaccatggttaaaagtttagtgtgactcctttcagacttttttacagtgtgtaatgtatttttccatgttatttattatacagcttatatgatttttacttttcagtgatca

SEQ ID NO: 27000 - DNA, 808 bp, Homo sapiens
ctgtggatactccgaacagaccagtgaggcagagcagcaaaagcagcctggaactggaggcggccaggagaggagcagcaagccggtgcccacagtcagccacggcaccctcagcaggcccattaggaggaattgagaagcttctccagtgtttgccctaaaatctcaatccattttaagtgacagaaagtgacaaaaaacaccccagaggaaaatactggggcctaagggagtaatctcagaactcttgtaataataataataatagcagccaacatctaatacatgcttactctgtgccaggccctattctaagcactttgtctgtgttaattcatttaatattcacatcattctataagctgaagacaatcattattcccattttacagatgaggaaactgaagtacagagaagtaagttgcgcaggattacatgtccagtggatggatgtaggtgtcaaattggctctgacacgttttctcacacaagcccaaaggaggtggagttaggggcaggacagacaagtctggagaacactggtaagagagttgctagtgttctgttcatcctctaacccagggagacattgtgtaggtctgtgacttctgggaccccagggagccagtctggccggcacttctttgtccagtcctgctgcctggtgcctcctgaggtttctgtttcccaatcagggtacgggttccattctccacctccctctccagggcaggaggcaccctccatccctcaatccaaataagctgggagagatgcctcagggagttggccaggctccaggcccctg

SEQ ID NO: 27001 - DNA, 715 bp, Homo sapiens
gggctgagctaaacacagtccttccatgagttctgcaaaccttgggttggaaaagaggctctagtttgccttaggctacctggactgagcaatataaggcatgggagaggtggtttatctgtttaaggtgccatgtcttgtttatactcactgatgagaagaaaaaacttaaatgaagacttcagactgaattttttttccttgtattaaaaacttagagtgagagttaagcttagatttagtttttctaaaaccttaaaaactagaaaccatttattaaagctagattttttttttcttttgagatagactttctcactctgtcgcccaggctggagtgcagtggtgcaatcttggctcactgcaacctccgcctcccgggttcaaactattcttgtgcctcagcctcctgagtagctggaattacaggtgtgagccaccatgcctggctaatttttttttggtatttttagtagagacagggttttgccatgttggccaggctggtctcgaactctaggcctcaagtgatctgcccgcctcagcctcccaaagtgtgggaattacaggagtgagccaccacacctggcctaaagccagattttcatagtccttagaaccaaacaaatttccccaagcacagtaagaactctgtaataatatttccaagtcaacactggaataaataggagtaggacagcctatctgcctctgc

SEQ ID NO: 27002 - DNA, 430 bp, Homo sapiens
ctaaacactgtctttgcgtagaatataatgctactgatgtgaggaaaagaaatccagtgcctggcacatagaaaaggatagatacacttttgtgggaggaaaaacagtggtaaaaacatggactggagtctcagctctaccatttactaattatgtgactttggtcaaatatttgacccctctgagacttggatttcacatctggaaatgtgaagaataaacactacttaatagaattattgtgcaaattaaattaagtgtaaaaagcttggttcacagtaggtggcaaataaatatgtacttcctctaaggaaatgtgtcattttctctaacatagtttatattcataaggagacaacacacaaacacatacacaatcaatcaacaaaaatgtgatacagtagattattaagcaccttgctctgattaa

SEQ ID NO: 27003 - DNA, 264 bp, Homo sapiens
gcctagacattttcacagctttatgctgtacagcagttagcttgtgcctgaatgcacaggaatgcaactccggcaattatttaccagatggaacgtgttttttgtgtttctgttttaagggaactccgttaaagtttttgattctagttttgatgcagtggattgtaaacctgttataacctgctgagaagggaaaaaacccatatttttctgttttcaggaaaaatcatttccatatgaaaggccatctggagaactgggcat

SEQ ID NO: 27004 - DNA, 361 bp, Homo sapiens
ggcacaatctcggcttaatgcaacctccaccttccgggtacaagcgattctcctgcctcagcctcccaagtagctgggactacaggcgcacacatcacgcacgcccagctaatttttgtatttttagtagagatggggttttaccatgtgggccaggatggtctcgatctcccgacctcatgatcctcccattttggcctcccaaagctctgggattacaggtgtgagctactgtgcccggcccacttagttattttaagatagggtcttgctctgttgtccgagctggagtgcaatggtgctatcatagctcactgcaacctcgaccttctaggctcaagtgatcctcctgcctcagcct

SEQ ID NO: 27005 - DNA, 353 bp, Homo sapiens
gaaaaagtctgatctactcttcagtagatctcaataatgttctctaatgttggtctcattcttcagtttatcagatcttttactgatggcactgtaaaagccaagttccaccaatatgttctgtagaacaaaaaatcctaaatcagtggcttgcaacagcaaatgtttatttctctcttgcattgcatttgagtgtggtttagaagtagcatacctaagctcaaaccagctccaatctttgttgttattattattgtttttgtttttaatgggattcaggtttaaagactagcccagatctaggatatgctcttcctgagtcatagggaggaacaaaaaaaaggctgaatgag

SEQ ID NO: 27006 - DNA, 437 bp, Homo sapiens
agtttctaaagcgtcgaccttaagttggtttgtctagtatactttctcacgattagactgaggggatagatttttggaaagactatcacagatgtgaagtgccctcctcctcacattgtgtcaggaggtacatgatgcccacatataacattactagggatgttagccattcttatgtagtaaaggcaatgtttgctaggtttctccactataaagttactaatttttgccaggccttgggggctcacgcctgtaatcccagcactttgggaggctgaggcgggtggattatgagcgcaagagatctagaccatcttggccaacatggtgaagccccatctctactaaagatacaaaaattagctgggtgtggtggcgcgcacatgtaatcccagctactcgggaggctgaggcaggagaatcgcttgaacccagga

SEQ ID NO: 27007 - DNA, 431 bp, Homo sapiens
gtgtcactcattccctggtcattctagtaaaaacagccagctccacaccttttccctggctgtaactccctcccctgttttatcccctgcctggccccatacttactccaaacagacacatatatgctacttttttactgtctgtctctcctctgactaaaatgtaaactccttaaagggcagaaactgactgttccttgctgtaatcctcacgtcatcacaccggagtctgtgtgaatgattaaatggtgtaagaactaggccttagagaactaggctagaactcacatattcagagatggtgctgtgggagtgacatgagagaattatagaaagtgaaaatagaatatgatcaacctaaaagcagagctggaggatgctgaagaccttgcctgtaaaatcccatgagtccggttctaagggaaagaccc

SEQ ID NO: 27008 - DNA, 677 bp, Homo sapiens
ataatcccagtgacaagtggtgaaacccatgcaaatagataagggatccacccgagagatgttaaggatacggaattgatggggcttggtgaccagtgagatctagggtgagagaagacttaaggctacccctaataaataatactgtcattccatctttttaattatttttttaatatttttattttaagttccaggatgcatgtgcagaacatgcaggtttgttacacaggtatacatgtgccatggtggtttgctgcacctatcaacccgtcatctaggttttaagccctgcatgcattaggtatttgtcctaatgctctcccttccccttgtcccccccaccccccgacaggccctggtgtgtgatgatgttcctctccctgtgtccatgtgtcacttccatctttaatgggtgactgggtgatatactaaggaaagagtatagaggaaaagaaatagattttgagggtgcaaataattctattttgtccacccaaaatgatttggtggcccaggggaagattactagttggaaatgtagatttaagtgttggagagggaatgaagtttttggctttggatacattgacttatttatgtctcatccgtaaaactaaatacttatattgtctcactagattttgtggtttaagaaccaaatggataatatgtag

SEQ ID NO: 27009 - DNA, 413 bp, Homo sapiens
ctgtaatcacagctaattgaatgtctgctgatgccaaaattggcttctgattgaattcagaacttttgtttaattaattatcatccacttgagtactgctgcttccctcagaccaggtggttaactgtttcctctcttctgagactgttgtcttccccctgagccctaacacttatactaaagagttaatctgcttccggggagatgcctcactctggttgcaaagagggtgaggcaaaatgtcaaggagtcaagaaagtggaaaggcacccaaaatgggagaaaacatttgcaaatctgataaaggtctagtatccgagtacataaaaaacgcttacatctcagcaatttttaaaaccccaattaaaaaacaagcaaaagatgcaaatagacattaatatatgtcttctttc

SEQ ID NO: 27010 - DNA, 622 bp, Homo sapiens
tcacaataaccaagatatggaattaagctaaatatccatcaatggatggataaaaaatgtggtatatacatataccaaatttgtatatacattcatatatatatatatgaataatattctgccataaaaagaatgaaattctgtcatttgcagaatcatggataagactagcgaacattatgttaagtggaataagtcagacacagaaaaattaatactgtctgtccttacccatatgcaggagctaaacaaatttgagctcattaaagtaaatggtagaattgtggttattagatgttgggaaggatgtgggagcagaggttggttaatggacacaaaattatagctatattggaggaataagttctgttgtagtgctctatagctggtcacatggaaataactataatttatggtatattttcaaaaagctagaagagaagattttgaatgttgtcaacacaaaagtatgataaatgtttgaggtgtttgaaatgctaattaccctgatttgatcattacgcattgtacacctgtatcaaaatatcactctgtttccataaatatgtacaattattgcatgccaactaacaataaaaggacaagataaagattcaaaaaa

SEQ ID NO: 27011 - DNA, 497 bp, Homo sapiens
gtgaccgtgtgccgcacctttgttctgcccgttccttactccttatttaggtgatgaaagatgtggtgccccaactttaagttccacttgacgcagaatttcctgattgaggatggagcctggggctaccttgaggtaattacgggatagtcgttgtacctggaacgtacatttttctaaagttgccacacagtaagactcccacagttctgtccacaccccttcccatgacattattgtttcttcaaaagggaccagccgctgagattttgttagcagggaaatctgtttcacaggaaggagggatgtgtagatgggacctaaacatcgaagtttataatttggtgaaaacctgataaatgggaagaccatttgaaatagatgtttcagtggctgggagtcccagatacccttgaatttaacactgctcattacatacctcagtgaccagaaattggagaccagcctgggcaacatcgcaagaccccatctctaca

SEQ ID NO: 27012 - DNA, 348 bp, Homo sapiens
gtggcatgatctcaactcactgcagcctccatccccagggctcaagtgatcctccaatctcagcctcccaagtagcctggaccacagacacatgctaccacacccagctaatttttatatttttggtagagacggggtttcaccatgttggccaggctggtcttgacctcctgagctcaagcaatctgcccacctcggcctcccaaagtgctgggattacaggagtgagccactgcacccggcccactttatgcccacctcttgagcttggcttgggaactgtggccaggccagactcactgaatgtccagtttaaagatgggaggcaatggggcatatcatccatct

SEQ ID NO: 27013 - DNA, 441 bp, Homo sapiens
gtgagcccacatattctgtttgctttgtatgcatttacaaattttgtattgtgtgtgcatgtagagtatatatttgtagcaattagtacactgtcacatgacagtcaaccatatttttaatgaaagaatgcatggccagctgactggatgaatagttcaatgtgctaatattcctagtttaaaagaaaatgctctgttggctgggtgcggtggctcacgtctgtaatccaagcactttgggaagccgaggtgggcagatcacctgaggtcaggagttcgagaccagcctggccaacatggcaaaaccccgtttctactaaaaatacaaaaaaaaatttagctgggtgtggtggcaggcacctgttatcccagctacttgggaggctgaggcaagagaattgcttgaactgggaggcggaggttgcagtgagccaagatcgt

SEQ ID NO: 27014 - DNA, 447 bp, Homo sapiens
  misc_feature (247)..(247): n is a, c, g, or t
tttctttacagcaatcagaaaatagactaatacagggacaggtgcctgacatggaaggaacatccatcttggactacatggagtgaaaagcaagggctgaatacgatggaacaagaccaccgggacgcgtggagagtgacagaagaacaccccacaccaaccccaaaagaaacaaaaagcacccccggaggaagagaggagagagcagagtatccagcaaagaggagaaacagtgggccgggcgcgngtggctcacgcctagtaatcccgagcagctttgggagggaccgaggtggagcggatcactagggtcagggagattgagaccatccgtggctaacagtggtgaaacgccgtctctactaaaatacaaaaaaaaaattagctgggcgtggttgcgggcgcctgtggtcccagctattcgggaggctgaggcaggagaatagc

SEQ ID NO: 27015 - DNA, 288 bp, Homo sapiens
tagagacggagtttcaccaggttgaccaggctggtctcaaactcttgacctcaagtgatatgctggcctcggcctcccaaagtgctgggattacaggcgtgagccactgcacccggcctaaatgctcactaaaatttattaactgaatggcttatgtgaagaaactcttgttgaattactggaagaggttaaggcaaacacctgtctttgataatacttattctaaaatgttatttataagcttggttatatgtatagtgagattttaccaagttatgatttgtataa

SEQ ID NO: 27016 - DNA, 615 bp, Homo sapiens
gaaaaggatatagagagaccaagttgttgaggacaatagctggagtttagtcttccagaagtatttttcttgccagaattgatcaaaggaagagccaacggcactggataggagattctagcatttggctgcttctccaagacaagcgaggttagaagggagttgagaagttatgtcatcttccactgcagcagataccccttttttagtacttggagatcccccgaatcacagcatttctaaatcagccctggattccacaagtgaagcagcggaggaaccaggaggtcagcggtgtcactcaaatctgtggcaatcaagtgggagttctcaaaaggctatcaaaggaagggggttatgataaggaaaggctcaagacctgcctcagaaggagtgagcagggaagagcaggactgactccactcagtgcaggatccagtacaaaatgaagatgtgaggcttttgtgcaaacagcaggaaaacattacctttacaggtactaaaatgtaatgtttttcctttcttccatagtgtctttctcaacttgttatggctgtgttttttatttgctacttaatgctgttctaactaaaaacttaaatgttaaattccaat

SEQ ID NO: 27017 - DNA, 493 bp, Homo sapiens
tcactttactactcacactaaactgcactttccagtgtcatgtgggagaacgtgttctatacaagctgtcctcaaggggagtatggaaaagaataattagaaaaaaatgtttgatttctgactattcttagactttgtaaatccatggcagatataagatcttaatgccaaaagattttgatttgcctcaattacgtttttcccagtgaagagggagttcttgcaactccaaaagtgagcttcagaaataagcagcactggccgggtacagtggctcacgcctgtcatcccagcactttgggaggccgaggtggatggatcacctgaggtcaggagttcgagaccagcctgaccaacatggtgaaacccggtctctactgaaaatacaaaattagccagggtgtggtggcacacacctgtaatcctggctagttgggaggccgatgcaggaaaatcacttgaacctgggaggtggaggttgcagtgagctgga

SEQ ID NO: 27018 - DNA, 498 bp, Homo sapiens
cttgggagagagactgaagagcaatggattgatagttatctgaagtcctcacaggttaaggatggttgagaagataagctagctcattcagctaccttgctggcatactagctatgtgacaggcactgttctggttgaggactgctctctcagagcagtaaagtaaatcaaataacttgcccaaagtcacactgctggaaaatgccagagctgttcaaagctcctccctaactccaaccctctccaattctctacagctatctgctctgtgtcttcccccaagaaagcgatggaaaccagagcaggaggtttccgtaaccagtcattataatttgtcagggagccatactgcagttcaactagacaagcacattgtcattccctgccatataaggaaacagagctaaacaccattgctttcactattgactggagaggttgctcaagttagagttagacaagatgaggatctagacctagagcagttaaattaaatta

SEQ ID NO: 27019 - DNA, 674 bp, Homo sapiens
tataatcacagtccttttgtttctttttcagtttctaatatgaacagaaattaatgcttttaattcaagctaaccttgtaaaataatttagtataatttttgtgttggtaaattcttaagtgaataagacaacatgtataatctcagtgggaaaacttcagtttatatgtctcatatcaaagtctaaattttaagaattaggtgggtctgtatttcaactcacaaaggatgaaaagaaagaattagataggtcatatgtacactgttagtagaactaggaattcttagagccatcctgaaaaatagtttcatgatgtgtatgataagccttaaaaatggttatatccttttatattgtattaatgtcatgtctagtaatcgatcctaaagaaataaccagtcagccggcacagtggctcacacctgtaatcccagcactttgagagtccgaggcaggcggatcacttgaggccaggagttcgagaccagcttagccaacatgatgaaaccccatctcttctaaaaatacgaaaattagccaggtgttgtggcacatgcctgtaatcccagctactcgggatgctgaggcagagaatcgcttgaacctgggaggcggaggctgcagtgagctgagatgtgccactgcactccagcctgggtgacagagtgagact

SEQ ID NO: 27020 - DNA, 667 bp, Homo sapiens
gctacaaataatgttgctgttttaagtattcatattaaatagatgccttctatatggaacatggcagaaagactgaaaaataacagtaattaattgtgtaattcagaattcataccaatcggtgttgaaactcaaacattgcaaaaatgggtggcaatattcagtgcttaacacttttatagcattggtacatgtgaaaaatgagtgttcaggtggattttatccttgcaagcatgtttttataagaattgtgattgtgcctatcataacagttgttttctgtatcttgaaaaagtattctccacattttaaatgtttttatattagagaattatttaatgcacacttgtcaaatatatatatatatatatgtagtactaatgttactttttatcttttgttttagatgtaagagcatgctcatatgttaggtacttacataaattgttacattattttttcttatgtaatacctttttgtttgtttatgtggttcaaatatattctttccttaaactctttaaaaaaaaaaaagaagtgattgctaatgggttcaaggtttccttttgggctgatgaaaatattttaaaattagacagtggtaatgatttaagaatctgtaaatataactaaaaattactgaaaagaataaaatttatataatgtg

SEQ ID NO: 27021 - DNA, 769 bp, Homo sapiens
gcctgccctggcctcccaaagtgctgggattacaggcgtgagccactgcgcctgacctgtattagggtttgaaagagtgaatatataaatattagtgatttggtttggctttctaggctagatagtgattagaaactgaggagttggaaataacaggaatagatgctgctgttgtcactgatgtgaaactggttggtttcagatttgttaggaggtcagcaaacttcagtccatgggctaaatccggtcacaccattcctctacctgttgagtggttacattagagacccaatggccattcaggccaaaagtactgactctggctttgaaagcaatggtgtgctctagatcttactgggaatcagctggcctgagttccaactgcttttaatgatagtttaaaacctggctaacttgtgattagaaccaaatgatatcttttggggaacaatttcatatagtcttaaataggtggctttattcaaaccgcatagttccaaatcatgatatcccgtatttctctctgtgtgtttgtgtgctttttttttttgacagagtctcccactctgtctctctgaggctggagtgcagtggcgtgatctctgcttactgcagctcccacctcctgcgttcaagcgattctctgtctcagccttctgagtagctgggattacaggcgtgagccactgcgccctgcctatctgcttattttaaaagcagtaaattctttacattatccctaagtgtatactctgatattcacagaacc

SEQ ID NO: 27022 - DNA, 455 bp, Homo sapiens
gaaactaaaggttatctggacgtgccattagtaaagccatttcttattaagaagtaaccattaacagcgagtgtagctcaggacacaggcaaaaaacaacaatcccattccccgtttgagttcatttcagggtttaacttcttccggcgccagccaccggactctcttgagattgtctccaaaacttgtacccgcacaacagatagaggtctcttttttgaattatgtgtttgctgaattcagatttattccagcaatcactaataagccatagagtctgaaagggtattttcccagtacccctccttcctcaaagaatgctctaacaacccaacgtagttactcccaatctccaaatactggacatttagattccgtcagtagatggcgcacggagctcttccacggacgtccttacgtgaccccttcacaacaaaaagatcaggaagggggag

SEQ ID NO: 27023 - DNA, 436 bp, Homo sapiens
tgttaaaacccgtgttgttcaagggtcaaccataactgcaggcagaacatctgggcaggaagctcctgcaggaagacctgtaaactcaggtctgtggaacggcgatgatcttcttcccttgcttccagaattattgctgtgagatcaggtgcactggtacatcttcttacccaaacaaccaggagcatttgttggcaagtttattgtgcccagtgccgatgtctggacaattaattccctaggtcagtggctttcacagtttgtgatggtgactccaggaaggaaactcaccatgaccctgtatatacatagaacaaaaatgcagcccactctgatattgtatttgttctattctagttcattaaaagtgaatgttggtcttcatcctttaaatggatattgtcacctgctaatagattggaccagtattttgaac

SEQ ID NO: 27024 - DNA, 411 bp, Homo sapiens
atggcacgcacgaagcaaacagctcgtaagtccactggcggcaaagccccgcgcaagcagctggccactaaggcggctcgcaaaagcgcgccagccaccggtggcgtgaagaagccccaccgctacaggcctggtactgtcgccctccgtgaaatccgccgctatcagaaatcgactgagctactgattcgcaagctaccattccagcgtctggtacgtgagatcgcgcaggacttcaagaccgacctgcgcttccagagctcggctgtgatggcgctgcaggaggcctgcgaggcttacctggtggggctctttgaggacaccaacctgtgtgctatccacgccaagcgagtgactatcatgcccaaggacatccagctcgctcgccgcattcgcggagagagggcataa

SEQ ID NO: 27025 - DNA, 850 bp, Homo sapiens
ggaattgataagaactttattatggagagttctaaaaggtctaggatattactgttgtggaagacagaatttgtctctagagtcaaagagggtaaggaactgtgttgtcaggatgctaaaaccagagggcaaatgcataactcatattattacctaccacagcaacaccccagtgttctttcccgctgagtccgcatgtgtctcagcatctttctcagtgcagagttccaggaagtcaatagcagtcaatgaaaattgatttttgtctttgctttagacagtgccacaaggggttgttactcgagaccaagggtgggtggagctgacagtagggcagtgtataacaggtgaagtttagtagtccccctggaattagagtcggtggctagagtggaatcttgaaacctagaggttgtaactaaccttggagaagtgtgcagccttagaggagggagtagggctggtaggtgtttgaatggttctcaggaagtctaaccacattctctcatgctctaggctgtcagtgcagtgctggcagcacctgggccagagccattaggtgaggttgaaccaagtagcatgctgtctggaaagctggaaatggggcctaaaagacaagagaaagtagcagttgaatacagattatttgtattggccataagtgaagacaagccaaatcaaaggaatatctttgttctgaagtgatacttcttttcttttatcttgagctaatcaattatattgatggagggcgagtgtagtggctcacacctgtaattccagcactttggaaggccaaggcaataggattgcttgagcccaggagtttgagaccagtctgggcaacata

SEQ ID NO: 27026 - DNA, 1182 bp, Homo sapiens
cagtgattgctaaactttcatatgtggaatatatttatgctgctgtttaggctatccaagaaaaccatgaatattttgtattcaagtgacacaacactgggaatcttacctgtctttcaaagtggcattgggctcatggggaacttattgctattcattacatatatgtacatcttcttattttggccccatcagaagaaccccttagatgtgattctcatgcacctaactttggctaatgttataacagttatcatcaggggtgttccatatataatgtcatccttcagacttagaagtacttttgttgatactggttgtaaaacagggctatacatttataaaatgacatggggcatttgtgtatgtacttcttctctcctgagtacatttcaggctgttatcatctgtccttgtcattccaagtgggcatggctcaaactcaaatctccccataaattttcccttattgatttattcctaaacaacaggctaatcaatatgtgggtcattataagcaccgtagccaccagcaaatccactaatgttggacttgtatattctctgatatactgtaaaacaagactgtttatatactaccatgcaatgatatttcaaagtgccatgtttactcaaggtttcctcttcttgttcctcatgatttggactagtttctacatggtgactattttcttaaggcatcaaaagacggtctttcatattcacagtatcagtctgtctccacaatcttttcctgaaacagaagccagtcatgttttcttcttgctggtgagccgctttgttttcttttatgggactaacgtgtgtctttccacttatattagctccatgtatgagaacagcctaatcctggagaacattactagttttgtttcatcttcctacccaattatctgtactttgatattgattaattatgataataaagtttccagattaacctgtgccattttaaatatgattatttccccctgcttaccacacagctttctattgcatcaaagaaatcctgataaaaattattttaaccacaagagaatgtgtttttaaactttcctgagtttagaaatttagtcctttggcctgggaggtccaggctgcaatgagccaagatcacgccactgaactccagcctgggagacagcaagaccctgtctgaaa

SEQ ID NO: 27027 - DNA, 1202 bp, Homo sapiens
cagtgattgctaaactttcatatgtggaatatatttatgctgctgtttaggctgtgctggcttcaatcaaaagatccaagaaaaccatgaatattttgtattcaagtgacacaacactgggaatcttacctgtctttcaaagtggcattgggctcatggggaacttattgctattcattacatatatgtacatcttcttattttggccccatcagaagaaccccttagatgtgattctcatgcacctaactttggctaatgttataacagttatcatcaggggtgttccatatataatgtcatccttcagacttagaagtacttttgttgatactggttgtaaaacagggctatacatttataaaatgacatggggcatttgtgtatgtacttcttctctcctgagtacatttcaggctgttatcatctgtccttgtcattccaagtgggcatggctcaaactcaaatctccccataaattttcccttattgatttattcctaaacaacaggctaatcaatatgtgggtcattataagcaccgtagccaccagcaaatccactaatgttggacttgtatattctctgatatactgtaaaacaagactgtttatatactaccatgcaatgatatttcaaagtgccatgtttactcaaggtttcctcttcttgttcctcatgatttggactagtttctacatggtgactattttcttaaggcatcaaaagacggtctttcatattcacagtatcagtctgtctccacaatcttttcctgaaacagaagccagtcatgttttcttcttgctggtgagccgctttgttttcttttatgggactaacgtgtgtctttccacttatattagctccatgtatgagaacagcctaatcctggagaacattactagttttgtttcatcttcctacccaattatctgtactttgatattgattaattatgataataaagtttccagattaacctgtgccattttaaatatgattatttccccctgcttaccacacagctttctattgcatcaaagaaatcctgataaaaattattttaaccacaagagaatgtgtttttaaactttcctgagtttagaaatttagtcctttggcctgggaggtccaggctgcaatgagccaagatcacgccactgaactccagcctgggagacagcaagaccctgtctgaaa

SEQ ID NO: 27028 - DNA, 2045 bp, Homo sapiens
accagatgcgttttcagaagacagtactccagtgataaggtatctacaccacttaataactgtacctggtaaggagatttaataaggctgagggtggtattaagtttctcagaacagactcatctttgcggatgcagttgcagaacaggaaacagacccagggagaagtttagtccccccagatctcattggccctccgcacaagccaagccacagccactcctgccacacaatcggattgctttcagcactcgcagccgtggaccgccgtgcggtcctttcctctgcagtgagccgatttgctctgccagcagctgtcggtgccgcgctcgacaccgagtcctagctaggcgctcacagaatacgcgctccctccctcccccttctctgtcccccgcctctcgctcaccccggcccactccagcggcgactttgagggattccctctctggcggcctctgcagcagcacagccggcctcattcggggcactgcgagtatggatctccaaggaagaggggtccccagcatcgacagacttcgagttctcctgatgttgttccatacaatggctcaaatcatggcagaacaagaagtggaaaatctctcaggcctttccactaaccctgaaaaagatatatttgtggtgcgggaaaatgggacgacgtgtctcatggcagagtttgcagccaaatttattgtaccttatgatgtgtgggccagcaactacgtagatctgatcacagaacaggccgatatcgcattgacccggggagctgaggtgaagggccgctgtggccacagccagtcggagctgcaagtgttctgggtggatcgcgcatatgcactcaaaatgctctttgtaaaggaaagccacaacatgtccaagggacctgaggcgacttggaggctgagcaaagtgcagtttgtctacgactcctcggagaaaacccacttcaaagacgcagtcagtgctgggaagcacacagccaactcgcaccacctctctgccttggtcacccccgctgggaagtcctatgagtgtcaagctcaacaaaccatttcactggcctctagtgatccgcagaagacggtcaccatgatcctgtctgcggtccacatccaaccttttgacattatctcagattttgtcttcagtgaagagcataaatgcccagtggatgagcgggagcaactggaagaaaccttgcccctgattttggggctcatcttgggcctcgtcatcatggtaacactcgcgatttaccacgtccaccacaaaatgactgccaaccaggtgcagatccctcgggacagatcccagtataagcacatgggctagaggccgttaggcaggcaccccctattcctgctcccccaactggatcaggtagaacaacaaaagcacttttccatcttgtacacgagatacaccaacatagctacaatcaaacaggcctgggtatctgaggcttgcttggcttgtgtccatgcttaaacccacggaagggggagactctttcggatttgtagggtgaaatggcaattattctctccatgctggggaggaggggaggagggtctcagacagctttcgtgctcatggtggcttggctttgactctccaaagagcaataaatgccacttggagctgtatctggccccaaagtttagggattgaaaacatgcttctttgaggaggaaacccctttaggttcagaagaatatggggtgctttgctcccttggacacagctggcttatcctatacagttgtcaatgcacacagaatacaacctcatgctccctgcagcaagacccctgaaagtgattcatgcttctggctggcattctgcatgtttagtgattgtcttgggaatgtttcactgctacccgcatccagcgactgcagcaccagaaaacgactaatgtaactatgcagagttgtttggacttcttcctgtgccaggtccaagtcgggggacctgaagaatcaatctgtgtgagtctgtttttcaaaatgaaataaaacacactattctctggc

SEQ ID NO: 27029 - DNA, 1950 bp, Homo sapiens
  misc_feature (6)..(7): n is a, c, g, or t
tcgaanngtaaccgttcgtacgagaatcgctgtcctctccttgcggccgcagtgtggtggaattcttttccgacacgtagtagtactgacgcttgggaacggcctgggccagaatctcgatctggcgagcgttcaggcccatgcggcggtacagggccgccgtgtcctcatccctggcgtaaatattcggcaggaaaatcttggtcgcggtcgattccacgatcacgtccaggatgccgctgttggcggcgtcggacaggctctgcgttgccatcagcacaaggcagttggccttacgcagcaccttgagccattccctgatcttcgcgcggaatgccgggtggccgagcatcaaccaggcttcgtccaggatgatgacggccgccagtgtggtggaattctaaccctgaaaaagatatatttgtggtgcgggaaaatgggacgacgtgtctcatggcagagtttgcagccaaatttattgtaccttatgatgtgtgggccagcaactacgtagatctgatcacagaacaggccgatatcgcattgacccggggagctgaggtgaagggccgctgtggccacagccagtcggagctgcaagtgttctgggtggatcgcgcatatgcactcaaaatgctctttgtaaaggtaactccgagcccagcgggcagaggggccgcaggctccgcgtgggtgtgggaagtggcggcccctaggtttaagaacccagacgctgcggggacgattgaagcgcacctccccggctcaacaggaaagccacaacatgtccaagggacctgaggcgacttggaggctgagcaaagtgcagtttgtctacgactcctcggagaaaacccacttcaaagacgcagtcagtgctgggaagcacacagccaactcgcaccacctctctgccttggtcacccccgctgggaagtcctatgagtgtcaagctcaacaaaccatttcactggcctctagtgatccgcagaagacggtcaccatgatcctgtctgcggtccacatccaaccttttgacattatctcagattttgtcttcagtgaagagcataaatgcccagtggatgagcgggagcaactggaagaaaccttgcccctgattttggggctcatcttgggcctcgtcatcatggtaacactcgcgatttaccacgtccaccacaaaatgactgccaaccaggtgcagatccctcgggacagatcccagtataagcacatgggctagaggccgttaggcaggcaccccctattcctgctcccccaactggatcaggtagaacaacaaaagcacttttccatcttgtacacgagatacaccaacatagctacaatcaaacaggcctgggtatctgaggcttgcttggcttgtgtccatgcttaaacccacggaagggggagactctttcggatttgtagggtgaaatggcaattattctctccatgctggggaggaggggaggagggtctcagacagctttcgtgctcatggtggcttggctttgactctccaaagagcaataaatgccacttggagctgtatctggccccaaagtttagggattgaaaacatgcttctttgaggaggaaacccctttaggttcagaagaatatggggtgctttgctcccttggacacagctggcttatcctatacagttgtcaatgcacacagaatacaacctcatgctccctgcagcaagacccctgaaagtgattcatgcttctggctggcattctgcatgtttagtgattgtcttgggaatgtttcactgctacccgcatccagcgactgcagcaccagaaaacgactaatgtaactatgcagagttgtttggacttcttcctgtgccaggtccaagtcgggggacctgaagaatcaatctgtgtgagtctgtttttcaaaatgaaataaaacacactattctctggc

SEQ ID NO: 27030 - DNA, 1576 bp, Homo sapiens
aaccgcatgttcccggaacctgggatgcgcgcgcgcaaaggagcgcccaagcgtgcaacccagagtttggacgcgccgccctttacagcccccgccccggggccgggcgagctgagggggcgcggggcgtctgtgttcccagctgatcacagaacaggccgatatcgcattgacccggggagctgaggtgaagggccgctgtggccacagccagtcggagctgcaagtgttctgggtggatcgcgcatatgcactcaaaatgctctttgtaaaggtaactccgagcccagcgggcagaggggccgcaggctccgcgtgggtgtgggaagtggcggcccctaggtttaagaacccagacgctgcggggacgattgaagcgcacctccccggctcaacaggaaagccacaacatgtccaagggacctgaggcgacttggaggctgagcaaagtgcagtttgtctacgactcctcggagaaaacccacttcaaagacgcagtcagtgctgggaagcacacagccaactcgcaccacctctctgccttggtcacccccgctgggaagtcctatgagtgtcaagctcaacaaaccatttcactggcctctagtgatccgcagaagacggtcaccatgatcctgtctgcggtccacatccaaccttttgacattatctcagattttgtcttcagtgaagagcataaatgcccagtggatgagcgggagcaactggaagaaaccttgcccctgattttggggctcatcttgggcctcgtcatcatggtaacactcgcgatttaccacgtccaccacaaaatgactgccaaccaggtgcagatccctcgggacagatcccagtataagcacatgggctagaggccgttaggcaggcaccccctattcctgctcccccaactggatcaggtagaacaacaaaagcacttttccatcttgtacacgagatacaccaacatagctacaatcaaacaggcctgggtatctgaggcttgcttggcttgtgtccatgcttaaacccacggaagggggagactctttcggatttgtagggtgaaatggcaattattctctccatgctggggaggaggggaggagggtctcagacagctttcgtgctcatggtggcttggctttgactctccaaagagcaataaatgccacttggagctgtatctggccccaaagtttagggattgaaaacatgcttctttgaggaggaaacccctttaggttcagaagaatatggggtgctttgctcccttggacacagctggcttatcctatacagttgtcaatgcacacagaatacaacctcatgctccctgcagcaagacccctgaaagtgattcatgcttctggctggcattctgcatgtttagtgattgtcttgggaatgtttcactgctacccgcatccagcgactgcagcaccagaaaacgactaatgtaactatgcagagttgtttggacttcttcctgtgccaggtccaagtcgggggacctgaagaatcaatctgtgtgagtctgtttttcaaaatgaaataaaacacactattctctggc

SEQ ID NO: 27031 - DNA, 1614 bp, Homo sapiens
  misc_feature (6)..(7): n is a, c, g, or t
tcgaanngtaaccgttcgtacgagaatcgctgtcctctccttgcggccgcagtgtggtggaattctaaccctgaaaaagatatatttgtggtgcgggaaaatgggacgacgtgtctcatggcagagtttgcagccaaatttattgtaccttatgatgtgtgggccagcaactacgtagatctgatcacagaacaggccgatatcgcattgacccggggagctgaggtgaagggccgctgtggccacagccagtcggagctgcaagtgttctgggtggatcgcgcatatgcactcaaaatgctctttgtaaaggtaactccgagcccagcgggcagaggggccgcaggctccgcgtgggtgtgggaagtggcggcccctaggtttaagaacccagacgctgcggggacgattgaagcgcacctccccggctcaacaggaaagccacaacatgtccaagggacctgaggcgacttggaggctgagcaaagtgcagtttgtctacgactcctcggagaaaacccacttcaaagacgcagtcagtgctgggaagcacacagccaactcgcaccacctctctgccttggtcacccccgctgggaagtcctatgagtgtcaagctcaacaaaccatttcactggcctctagtgatccgcagaagacggtcaccatgatcctgtctgcggtccacatccaaccttttgacattatctcagattttgtcttcagtgaagagcataaatgcccagtggatgagcgggagcaactggaagaaaccttgcccctgattttggggctcatcttgggcctcgtcatcatggtaacactcgcgatttaccacgtccaccacaaaatgactgccaaccaggtgcagatccctcgggacagatcccagtataagcacatgggctagaggccgttaggcaggcaccccctattcctgctcccccaactggatcaggtagaacaacaaaagcacttttccatcttgtacacgagatacaccaacatagctacaatcaaacaggcctgggtatctgaggcttgcttggcttgtgtccatgcttaaacccacggaagggggagactctttcggatttgtagggtgaaatggcaattattctctccatgctggggaggaggggaggagggtctcagacagctttcgtgctcatggtggcttggctttgactctccaaagagcaataaatgccacttggagctgtatctggccccaaagtttagggattgaaaacatgcttctttgaggaggaaacccctttaggttcagaagaatatggggtgctttgctcccttggacacagctggcttatcctatacagttgtcaatgcacacagaatacaacctcatgctccctgcagcaagacccctgaaagtgattcatgcttctggctggcattctgcatgtttagtgattgtcttgggaatgtttcactgctacccgcatccagcgactgcagcaccagaaaacgactaatgtaactatgcagagttgtttggacttcttcctgtgccaggtccaagtcgggggacctgaagaatcaatctgtgtgagtctgtttttcaaaatgaaataaaacacactattctctggc

SEQ ID NO: 27032 - DNA, 1920 bp, Homo sapiens
accagatgcgttttcagaagacagtactccagtgataaggtatctacaccacttaataactgtacctggtaaggagatttaataaggctgagggtggtattaagtttctcagaacagactcatctttgcggatgcagttgcagaacaggaaacagacccagggagaagtttagtccccccagatctcattggccctccgcacaagccaagccacagccactcctgccacacaatcggattgctttcagcactcgcagccgtggaccgccgtgcggtcctttcctctgcagtgagccgatttgctctgccagcagctgtcggtgccgcgctcgacaccgagtcctagctaggcgctcacagaatacgcgctccctccctcccccttctctgtcccccgcctctcgctcaccccggcccactccagcggcgactttgagggattccctctctggcggcctctgcagcagcacagccggcctcattcggggcactgcgagtatggatctccaaggaagaggggtccccagcatcgacagacttcgagttctcctgatgttgttccatacaatggctcaaatcatggcagaacaagaagtggaaaatctctcaggcctttccactaaccctgaaaaagatatatttgtggtgcgggaaaatgggacgacgctgtggccacagccagtcggagctgcaagtgttctgggtggatcgcgcatatgcactcaaaatgctctttgtaaaggaaagccacaacatgtccaagggacctgaggcgacttggaggctgagcaaagtgcagtttgtctacgactcctcggagaaaacccacttcaaagacgcagtcagtgctgggaagcacacagccaactcgcaccacctctctgccttggtcacccccgctgggaagtcctatgagtgtcaagctcaacaaaccatttcactggcctctagtgatccgcagaagacggtcaccatgatcctgtctgcggtccacatccaaccttttgacattatctcagattttgtcttcagtgaagagcataaatgcccagtggatgagcgggagcaactggaagaaaccttgcccctgattttggggctcatcttgggcctcgtcatcatggtaacactcgcgatttaccacgtccaccacaaaatgactgccaaccaggtgcagatccctcgggacagatcccagtataagcacatgggctagaggccgttaggcaggcaccccctattcctgctcccccaactggatcaggtagaacaacaaaagcacttttccatcttgtacacgagatacaccaacatagctacaatcaaacaggcctgggtatctgaggcttgcttggcttgtgtccatgcttaaacccacggaagggggagactctttcggatttgtagggtgaaatggcaattattctctccatgctggggaggaggggaggagggtctcagacagctttcgtgctcatggtggcttggctttgactctccaaagagcaataaatgccacttggagctgtatctggccccaaagtttagggattgaaaacatgcttctttgaggaggaaacccctttaggttcagaagaatatggggtgctttgctcccttggacacagctggcttatcctatacagttgtcaatgcacacagaatacaacctcatgctccctgcagcaagacccctgaaagtgattcatgcttctggctggcattctgcatgtttagtgattgtcttgggaatgtttcactgctacccgcatccagcgactgcagcaccagaaaacgactaatgtaactatgcagagttgtttggacttcttcctgtgccaggtccaagtcgggggacctgaagaatcaatctgtgtgagtctgtttttcaaaatgaaataaaacacactattctctggc

SEQ ID NO: 27033 - DNA, 1452 bp, Homo sapiens
aaccgcatgttcccggaacctgggatgcgcgcgcgcaaaggagcgcccaagcgtgcaacccagagtttggacgcgccgccctttacagcccccgccccggggccgggcgagctgagggggcgcggggcgtctgtgttcccagctgatcacagaacaggccgatatcgcattgacccggggagctgaggtgaagggccgctgtggccacagccagtcggagctgcaagtgttctgggtggatcgcgcatatgcactcaaaatgctctttgtaaaggaaagccacaacatgtccaagggacctgaggcgacttggaggctgagcaaagtgcagtttgtctacgactcctcggagaaaacccacttcaaagacgcagtcagtgctgggaagcacacagccaactcgcaccacctctctgccttggtcacccccgctgggaagtcctatgagtgtcaagctcaacaaaccatttcactggcctctagtgatccgcagaagacggtcaccatgatcctgtctgcggtccacatccaaccttttgacattatctcagattttgtcttcagtgaagagcataaatgcccagtggatgagcgggagcaactggaagaaaccttgcccctgattttggggctcatcttgggcctcgtcatcatggtaacactcgcgatttaccacgtccaccacaaaatgactgccaaccaggtgcagatccctcgggacagatcccagtataagcacatgggctagaggccgttaggcaggcaccccctattcctgctcccccaactggatcaggtagaacaacaaaagcacttttccatcttgtacacgagatacaccaacatagctacaatcaaacaggcctgggtatctgaggcttgcttggcttgtgtccatgcttaaacccacggaagggggagactctttcggatttgtagggtgaaatggcaattattctctccatgctggggaggaggggaggagggtctcagacagctttcgtgctcatggtggcttggctttgactctccaaagagcaataaatgccacttggagctgtatctggccccaaagtttagggattgaaaacatgcttctttgaggaggaaacccctttaggttcagaagaatatggggtgctttgctcccttggacacagctggcttatcctatacagttgtcaatgcacacagaatacaacctcatgctccctgcagcaagacccctgaaagtgattcatgcttctggctggcattctgcatgtttagtgattgtcttgggaatgtttcactgctacccgcatccagcgactgcagcaccagaaaacgactaatgtaactatgcagagttgtttggacttcttcctgtgccaggtccaagtcgggggacctgaagaatcaatctgtgtgagtctgtttttcaaaatgaaataaaacacactattctctggc

SEQ ID NO: 27034 - DNA, 2313 bp, Homo sapiens
accagatgcgttttcagaagacagtactccagtgataaggtatctacaccacttaataactgtacctggtaaggagatttaataaggctgagggtggtattaagtttctcagaacagactcatctttgcggatgcagttgcagaacaggaaacagacccagggagaagtttagtccccccagatctcattggccctccgcacaagccaagccacagccactcctgccacacaatcggattgctttcagcactcgcagccgtggaccgccgtgcggtcctttcctctgcagtgagccgatttgctctgccagcagctgtcggtgccgcgctcgacaccgagtcctagctaggcgctcacagaatacgcgctccctccctcccccttctctgtcccccgcctctcgctcaccccggcccactccagcggcgactttgagggattccctctctggcggcctctgcagcagcacagccggcctcattcggggcactgcgagtatggatctccaaggaagaggggtccccagcatcgacagacttcgagttctcctgatgttgttccatacaatggctcaaatcatggcagaacaagaagtggaaaatctctcaggcctttccactaaccctgaaaaagatatatttgtggtgcgggaaaatgggacgacgtgtctcatggcagagtttgcagccaaatttattgtaccttatgatgtgtgggccagcaactacgtagatctgatcacagaacaggccgatatcgcattgacccggggagctgaggtgaagggccgctgtggccacagccagtcggagctgcaagtgttctgggtggatcgcgcatatgcactcaaaatgctctttgtaaaggaaagccacaacatgtccaagggacctgaggcgacttggaggctgagcaaagtgcagtttgtctacgactcctcggagaaaacccacttcaaagacgcagtcagtgctgggaagcacacagccaactcgcaccacctctctgccttggtcacccccgctgggaagtcctatgagtgtcaagctcaacaaaccatttcactggcctctagtgatccgcagaagacggtcaccatgatcctgtctgcggtccacatccaaccttttgacattatctcagattttgtcttcagtgaagagcataaatgcccagtggatgagcgggagcaactggaagaaaccttgcccctgattttggggctcatcttgggcctcgtcatcatggtaacactcgcgatttaccacgtccaccacaaaatgactgccaaccaggtgcagatccctcgggacagatcccagtataagcacatgggctagaggccgttaggcaggcaccccctattcctgctcccccaactggatcaggtagaacaacaaaagcacttttccatcttgtacacgagatacaccaacatagctacaatcaaacaggcctgggtatctgaggcttgcttggcttgtgtccatgcttaaacccacggaagggggagactctttcggatttgtagggtgaaatggcaattattctctccatgctggggaggaggggaggagggtctcagacagctttcgtgctcatggtggcttggctttgactctccaaagagcaataaatgccacttggagctgtatctggccccaaagtttagggattgaaaacatgcttctttgaggaggaaacccctttaggttcagaagaatatggggtgctttgctcccttggacacagctggcttatcctatacagttgtcaatgcacacagaatacaacctcatgctccctgcagcaagacccctgaaagtgattcatgcttctggctggcattctgcatgtttagtgattgtcttgggaatgtttcactgctacccgcatccagcgactgcagcaccagaaaacgactaatgtaactatgcagagttgtttggacttcttcctgtgccaggtccaagtcgggggacctgaagaatcaatctgtgtgagtctgtttttcaaaatgaaataaaacacactattctctggcctttggctgctttcttgaaacaagaaaacaaagctaaaatggtgtctttggcgtccagaagagaaagaggaaaagatgaagacggattttgcatgtttgcaagaggaaaagtaaagacagggcaggaaaccaatgagggggaagttggcttttctaggtgaaaaaaacatggatttttttggcaaatataaatagttttaataatggcacctcttgaccagttggcctaatattgcttctgatgcttcttggtcttgagtttggcatt

SEQ ID NO: 27035 - DNA, 2169 bp, Homo sapiens
accagatgcgttttcagaagacagtactccagtgataaggtatctacaccacttaataactgtacctggtaaggagatttaataaggctgagggtggtattaagtttctcagaacagactcatctttgcggatgcagttgcagaacaggaaacagacccagggagaagtttagtccccccagatctcattggccctccgcacaagccaagccacagccactcctgccacacaatcggattgctttcagcactcgcagccgtggaccgccgtgcggtcctttcctctgcagtgagccgatttgctctgccagcagctgtcggtgccgcgctcgacaccgagtcctagctaggcgctcacagaatacgcgctccctccctcccccttctctgtcccccgcctctcgctcaccccggcccactccagcggcgactttgagggattccctctctggcggcctctgcagcagcacagccggcctcattcggggcactgcgagtatggatctccaaggaagaggggtccccagcatcgacagacttcgagttctcctgatgttgttccatacaatggctcaaatcatggcagaacaagaagtggaaaatctctcaggcctttccactaaccctgaaaaagatatatttgtggtgcgggaaaatgggacgacgtgtctcatggcagagtttgcagccaaatttattgtaccttatgatgtgtgggccagcaactacgtagatctgatcacagaacaggccgatatcgcattgacccggggagctgaggtgaagggccgctgtggccacagccagtcggagctgcaagtgttctgggtggatcgcgcatatgcactcaaaatgctctttgtaaaggtaactccgagcccagcgggcagaggggccgcaggctccgcgtgggtgtgggaagtggcggcccctaggtttaagaacccagacgctgcggggacgattgaagcgcacctccccggctcaacaggaaagccacaacatgtccaagggacctgaggcgacttggaggctgagcaaagtgcagtttgtctacgactcctcggagaaaacccacttcaaagacgcagtcagtgctgggaagcacacagccaactcgcaccacctctctgccttggtcacccccgctgggaagtcctatgagtgtcaagctcaacaaaccatttcactggcctctagtgatccgcagaagacggtcaccatgatcctgtctgcggtccacatccaaccttttgacattatctcagattttgtcttcagtgaagagcataaatgcccagtggatgagcgggagcaactggaagaaaccttgcccctgattttggggctcatcttgggcctcgtcatcatggtaacactcgcgatttaccacgtccaccacaaaatgactgccaaccaggtgcagatccctcgggacagatcccagtataagcacatgggctagaggccgttaggcaggcaccccctattcctgctcccccaactggatcaggtagaacaacaaaagcacttttccatcttgtacacgagatacaccaacatagctacaatcaaacaggcctgggtatctgaggcttgcttggcttgtgtccatgcttaaacccacggaagggggagactctttcggatttgtagggtgaaatggcaattattctctccatgctggggaggaggggaggagggtctcagacagctttcgtgctcatggtggcttggctttgactctccaaagagcaataaatgccacttggagctgtatctggccccaaagtttagggattgaaaacatgcttctttgaggaggaaacccctttaggttcagaagaatatggggtgctttgctcccttggacacagctggcttatcctatacagttgtcaatgcacacagaatacaacctcatgctccctgcagcaagacccctgaaagtgattcatgcttctggctggcattctgcatgtttagtgattgtcttgggaatgtttcactgctacccgcatccagcgactgcagcaccagaaaacgactaatgtaactatgcagagttgtttggacttcttcctgtgccaggtccaagtcgggggacctgaagaatcaatctgtgtgagtctgtttttcaaaatgaaataaaacacactattctctggc

SEQ ID NO: 27036 - DNA, 318 bp, Homo sapiens
aactgccctattgctaatctctaccttatattgcaaggtggatattgttatccctaatttacaaatgagaaaattgttgcttaaagtgatcaagtggctcacacaatggtgtaccactagtaagtagctttggtaaacactgatgtctctggtaccaaagccagtgttcttgatcctcgcaccctgatgccttttaactaaattgcacaatacatgtgaaagcattttgcaacctaaaaagtggtatacaaatggtagtttatatgagagacagaaagtcctgggaagggcaatttccagatcaccctgaagaaggaa

SEQ ID NO: 27037 - DNA, 1293 bp, Homo sapiens
gtgcaatgaaaggatgtgggagtttgagacccatctctgctgtgtggccctgggtgagtcagttgaagctctcagaacgcccagctatccccactgcagaaggctctccctgaaagggcacaggtggaggacgtttgcatttatctggagacagttcatggagaaacacaaagaggtgtcctgacaagacaacaggtccacagcagtcgtcatcatgagtgctcaccatatgccagggttcatcttttaaaatccttaaccaaacaaccaaactgtggttgggattattctctttttataggtgagaaaactgaggctgaaagccattgggtggtttgccaaagctgagaagtagctgagctggggtttgtactcacaccacggtgactcggaggcccaagccagttctgacacactgccttcccatgacattcccacgacaggttcccgaggtcgttggaatgcttacacatttcagcaacttcatggcaactgcccagctcgacccagaagataatactaccttgtactccccctgccgcttccttcctccaggcagctcacagacatgacctcattccctctcccagagtcccataggggtgaaggacagggtggggatcgttaactctgcttcctagggaggaaagggaggcccagagagggatgctggcccaccctgggtcatccagccagctagcgggagagctgcaactggaaatcaggcttccctgccctcggggacagttatttagcctcctggatgtgagctagaatcacccctaagatgcagcaattggggtactcctcttggggtactgggactcagtggctgaaacagctccaagagagttgggcctgtgctgaaaacagaaatccgagatgcatataaattcaatccgtatgagaagagcagggtggcctgggaggagtggtcaccgcagtggctccacctcctacccggccacctgcagccctgcctgggctgctcttggtctctctgtgcccagcttccctggccggatgccctgggggccagagcagccgcaggtgcgatgaaaagaacactggccttgaggtcatgggacctggggaggatattcaccaggggcccctaagttagtcattttagctctcagcttttccatttttcattcaaaaaatggggactctaactccatgaaagagacattgtgtgtgaaatatttcatcataagctgtgaagcctgcaaagaaactcctggtgttctctgtagcctgatttcatctctactaaacgctattttgaaaatg

SEQ ID NO: 27038 - DNA, 848 bp, Homo sapiens
gtacctgacctccctcagtctctggacctaggacccctggccctgtgggtcgcaggttccctggatgatgctggggaaaaggcctgtgttcattgcctcagttctaatttttctttttcaaaaggaagctctcagaacgcccagctatccccactgcagaaggctctccctgaaagggcacaggtggaggacgtttgcatttatctggagacagttcatggagaaacacaaagaggtgtcctgacaagacaacaggtccacagcagtcgtcatcatgagtgctcaccatatgccagggttcatcttttaaaatccttaaccaaacaaccaaactgtggttgggattattctctttttataggtgagaaaactgaggctgaaagccattgggtggtttgccaaagctgagaagtagctgagctggggtttgtactcacaccacggtgactcggaggcccaagccagttctgacacactgccttcccatgacattcccacgacaggttcccgaggtcgttggaatgcttacacatttcagcaacttcatggcaactgcccagctcgacccagaagataatactaccttgtactccccctgccgcttccttcctccaggcagctcacagacatgacctcattccctctcccagagtcccataggggtgaaggacagggtggggatcgttaactctgcttcctagggaggaaagggaggcccagagagggatgctggcccaccctgggtcatccagccagctagcgggagagctgcaactggaaatcaggcttccctgccctcggggacagttatttagcctcctggatgtgagctagaatcacccctaaga

SEQ ID NO: 27039 - DNA, 746 bp, Homo sapiens
  misc_feature (22)..(22): n is a, c, g, or t
ctgtcgtgcaggcgtaggcgtnggggagttttgctcctcaaagggtgtctgtgcatcagcagcactggtggcatcacctgggaggtgttagatacacagattctcaggccccaccctagccctgctgaatcagaacctgcatttcaacaagaaccccaggtatacatgttaaagtctgagaagcactttttacagccatcttaggccgatcggtctgaatgtcacctgaaaatgaaagtgttctaggattggttgttttccgtcacctccactagactgtcagccctgtgagggcaggacctgtttggtttaacactcttctcccagctcccatgagtgcaccagccctgccggggcttgtgtgggttctgccaatgtatcccccagggactctccttgccctgttcccacatcaggccagctctctttcttctgagaccctgatggccttgctgctttgtggtcccatgaggcatctctgctggtctgcccatctatacctggtattgctcctatgtttttgctctcagagggccatcttattgctcccacttccagcttctcaatagggcctcagtgtaatcttcatgaactttccaaattgtttttagtctcacaaagcccacttccattcattaaagaccctgagcaggttggagagcatttatagtcacagctgagtctgtgaatataaccaacaactgtgatgacccctctgttaataaataacttggacatcagcaaaa

SEQ ID NO: 27040 - DNA, 2361 bp, Homo sapiens
ggtcaccaggacaacgggcgtcgccggcgccgtgtgacttcgggctgtgggctcgctcgcggctcttcggccatggttttctcaaacaatgatgaaggccttattaacaaaaagttacccaaagaacttctgttaagaatattttccttcttggatatagtaactttgtgccgatgtgcacagatttccaaggcttggaacatcttagccctggatggaagcaactggcaaagaatagatctttttaactttcaaacagatgtagagggtcgagtggtggaaaatatctcgaagcgatgcggtggattcctgaggaagctcagcttgcgaggctgcattggtgttggggattcctccttgaagacctttgcacagaactgccgaaacattgaacatttgaacctcaatggatgcacaaaaatcactgacagcacgtgttatagccttagcagattctgttccaagctgaaacatctggatctgacctcctgtgtgtctattacaaacagctccttgaaggggatcagtgagggctgccgaaacctggagtacctgaacctctcttggtgtgatcagatcacgaaggatggcatcgaggcactggtgcgaggttgtcgaggcctgaaagccctgctcctgaggggctgcacacagttagaagatgaagctctgaaacacattcagaattactgccatgagcttgtgagcctcaacttgcagtcctgctcacgtatcacggatgaaggtgtggtgcagatatgcaggggctgtcaccggctacaggctctctgcctttcgggttgcagcaacctcacagatgcctctcttacagccctgggtttgaactgtccgcgactgcaaattttggaggctgcccgatgctcccatttgactgacgcaggttttacacttttagctcggaattgccacgaattggagaagatggatcttgaagaatgcatcctgataaccgacagcacactcatccagctctccattcactgtcctaaactgcaagccctgagcctgtcccactgtgaactcatcacagatgatgggatcctgcacctgagcaacagtacctgtggccatgagaggctgcgggtactggagttggacaactgcctcctcatcactgatgtggccctggaacacctagagaactgccgaggcctggagcgcctcgagctgtacgactgccagcaggttacccgtgcaggcatcaagcggatgcgggctcagctccctcatgtcaaagtccacgcctactttgctcccgtcaccccaccgacagcagtggcaggaagtggacagcgactgtgcaggtgctgtgtcattctctgacagcagctgcctgggcccaaggggtgatgaggcatcctttcctctagaagacctgagtcttcctgaccgactccaccatcacccaatctgttgattctccattgggaaaggcatttacaggtaaaagacttctgtatggattgcagttactctggtgatagttttcacctttattctgctgtgaaacaatcaaatcaaagccttgtgtcagttaacacatgacaagtggtctcaatgcagctaggaccatgccagaaacctggatctcttaagagattggtacctacctaggtacgaaagttctacccttggcatactcagcattcctcaaaaagaccatcagtgttagcacaaactgagcagaaaaaataagctgttgattttctacctgatacttaagccagtggcctactttaattcacaattccattttgattagcaggacttttccactttgaagataaatagcaactttatcaaagtgactgtactgcaaattaattcataatgcctgatagttttatatatagagacttatgtggaaggcatgttaataggtttccatgagacaccaaagaaaagaggactctatactgggtggagcagggtcttcacctttttgtttctgtcaacttgtcatatacacctccagggaccaaaaacaaaagcagctcggagtctgtgttgcctgattggaaagtagaagctctggtgtatgctacagcacataacacatttttactaaaggaaaaaagctaattatgtccatgcctctcgtaaaactggggggaaccttaaagagaaagaactaaggcttaagttatctgtagtataatcaattagaagtaatgaatggatgcatgtaaaatggatgtgattttttttcaagcttattttgaaatcttaaaaatcaggttacaccatagctactcaaaagttttacacacttaaaactcagatcagtaagtgttggtaccttttagactcataaaattgaataaaccattgcaatgcttt

SEQ ID NO: 27041 - DNA, 385 bp, Homo sapiens
gtctagacactgattaatcttagagaagacctaaagtgatgacagcagcaaaaatttataaaggcatttaaaatatatgcttaagtataattgctttgaagagctttctcctccctctttaccagtatcctctttatcagtttcccaacaggcacctatcaagatttaagaatggcgaagacaagaaaggatttataagcaacatctgacatcacatggtgacctgaaacatggctctgacctagctagtgctccttttgccctcttccctaatgagcagcctcaccagtacccatttgcttctctgatacctctaaaggttaataatcctcaagacagaccagacaggcccagcatcaaaatacatcaactgtgtacagtaaaa

SEQ ID NO: 27042 - DNA, 2568 bp, Homo sapiens
ggtcaccaggacaacgggcgtcgccggcgccgtgtgacttcgggctgtgggctcgctcgcggctcttcggccatggttttctcaaacaatgatgaaggccttattaacaaaaagttacccaaagaacttctgttaagaatattttccttcttggatatagtaactttgtgccgatgtgcacagatttccaaggcttggaacatcttagccctggatggaagcaactggcaaagaatagatctttttaactttcaaacagatgtagagggtcgagtggtggaaaatatctcgaagcgatgcggtggattcctgaggaagctcagcttgcgaggctgcattggtgttggggattcctccttgaagacctttgcacagaactgccgaaacattgaacatttgaacctcaatggatgcacaaaaatcactgacagcacgtgttatagccttagcagattctgttccaagctgaaacatctggatctgacctcctgtgtgtctattacaaacagctccttgaaggggatcagtgagggctgccgaaacctggagtacctgaacctctcttggtgtgatcagatcacgaaggatggcatcgaggcactggtgcgaggttgtcgaggcctgaaagccctgctcctgaggggctgcacacagttagaagatgaagctctgaaacacattcagaattactgccatgagcttgtgagcctcaacttgcagtcctgctcacgtatcacggatgaaggtgtggtgcagatatgcaggggctgtcaccggctacaggctctctgcctttcgggttgcagcaacctcacagatgcctctcttacagccctgggtttgaactgtccgcgactgcaaattttggaggctgcccgatgctcccatttgactgacgcaggttttacacttttagctcggaattgccacgaattggagaagatggatcttgaagaatgcatcctgataaccgacagcacactcatccagctctccattcactgtcctaaactgcaagccctgagcctgtcccactgtgaactcatcacagatgatgggatcctgcacctgagcaacagtacctgtggccatgagaggctgcgggtactggagttggacaactgcctcctcatcactgatgtggccctggaacacctagagaactgccgaggcctggagcgcctcgagctgtacgactgccagcaggttacccgtgcaggcatcaagcggatgcgggctcagctccctcatgtcaaagtccacgcctactttgctcccgtcaccccaccgacagcagtggcaggaagtggacagcgactgtgcaggtgctgtgtcattctctgacagcagctgcctgggcccaaggggtgatgaggcatcctttcctctagaagacctgagtcttcctgaccgactccaccatcacccaatctgttgattctccattgggaaaggcatttacaggtaaaagacttctgtatggattgcagttactctggtgatagttttcacctttattctgctgtgaaacaatcaaatcaaagccttgtgtcagttaacacatgacaagtggtctcaatgcagctaggaccatgccagaaacctggatctcttaagagattggtacctacctaggtacgaaagttctacccttggcatactcagcattcctcaaaaagaccatcagtgttagcacaaactgagcagaaaaaataagctgttgattttctacctgatacttaagccagtggcctactttaattcacaattccattttgattagcaggacttttccactttgaagataaatagcaactttatcaaagtgactgtactgcaaattaattcataatgcctgatagttttatatatagagacttatgtggaaggcatgttaataggtttccatgagacaccaaagaaaagaggactctatactgggtggagcagggtcttcacctttttgtttctgtcaacttgtcatatacacctccagggaccaaaaacaaaagcagctcggagtctgtgttgcctgattggaaagtagaagctctggtgtatgctacagcacataacacatttttactaaaggaaaaaagctaattatgtccatgcctctcgtaaaactggggggaaccttaaagagaaagaactaaggcttaagttatctgtagtataatcaattagaagtaatgaatggatgcatgtaaaatggatgtgattttttttcaagcttattttgaaatcttaaaaatcaggttacaccatagctactcaaaagttttacacacttaaaactcagatcagtaagtgttggtaccttttagactcataaaattgaataaaccattgcaatgctttaaaaaaaattaagtcagagggttttattgctatgattttatggcagacacatccaagcaaaaccattttccaaatgcagaccttcctgatgttatctgaaatctgataaaatgaccctactctctgctgtggttcattctcgctccatgctgtccatatttatgatctttattaagaacctgtcaatcagtcatcaccaccttcatt

SEQ ID NO: 27043 - DNA, 2514 bp, Homo sapiens
ggtcaccaggacaacgggcgtcgccggcgccgtgtgacttcgggctgtgggctcgctcgcggctcttcggccatggttttctcaaacaatgatgaaggccttattaacaaaaagttacccaaagaacttctgttaagaatattttccttcttggatatagtaactttgtgccgatgtgcacagatttccaaggcttggaacatcttagccctggatggaagcaactggcaaagaatagatctttttaactttcaaacagatgtagagggtcgagtggtggaaaatatctcgaagcgatgcggtggattcctgaggaagctcagcttgcgaggctgcattggtgttggggattcctccttgaagacctttgcacagaactgccgaaacattgaacatttgaacctcaatggatgcacaaaaatcactgacagcacgtgttatagccttagcagattctgttccaagctgaaacatctggatctgacctcctgtgtgtctattacaaacagctccttgaaggggatcagtgagggctgccgaaacctggagtacctgaacctctcttggtgtgatcagatcacgaaggatggcatcgaggcactggtgcgaggttgtcgaggcctgaaagccctgctcctgaggggctgcacacagttagaagatgaagctctgaaacacattcagaattactgccatgagcttgtgagcctcaacttgcagtcctgctcacgtatcacggatgaaggtgtggtgcagatatgcaggggctgtcaccggctacaggctctctgcctttcgggttgcagcaacctcacagatgcctctcttacagccctgggtttgaactgtccgcgactgcaaattttggaggctgcccgatgctcccatttgactgacgcaggttttacacttttagctcggaattgccacgaattggagaagatggatcttgaagaatgcatcctgataaccgacagcacactcatccagctctccattcactgtcctaaactgcaagccctgagcctgtcccactgtgaactcatcacagatgatgggatcctgcacctgagcaacagtacctgtggccatgagaggctgcgggtactggagttggacaactgcctcctcatcactgatgtggccctggaacacctagagaactgccgaggcctggagcgcctcgagctgtacgactgccagcaggttacccgtgcaggcatcaagcggatgcgggctcagctccctcatgtcaaagtccacgcctactttgctcccgtcaccccaccgacagcagtggcaggaagtggacagcgactgtgcaggtgctgtgtcattctctgacagcagctgcctgggcccaaggggtgatgaggcatcctttcctctagaagacctgagtcttcctgaccgactccaccatcacccaatctgttgattctccattgggaaaggcatttacaggtaaaagacttctgtatggattgcagttactctggtgatagttttcacctttattctgctgtgaaacaatcaaatcaaagccttgtgtcagttaacacatgacaagtggtctcaatgcagctaggaccatgccagaaacctggatctcttaagagattggtacctacctaggtacgaaagttctacccttggcatactcagcattcctcaaaaagaccatcagtgttagcacaaactgagcagaaaaaataagctgttgattttctacctgatacttaagccagtggcctactttaattcacaattccattttgattagcaggacttttccactttgaagataaatagcaactttatcaaagtgactgtactgcaaattaattcataatgcctgatagttttatatatagagacttatgtggaaggcatgttaataggtttccatgagacaccaaagaaaagaggactctatactgggtggagcagggtcttcacctttttgtttctgtcaacttgtcatatacacctccagggaccaaaaacaaaagcagctcggagtctgtgttgcctgattggaaagtagaagctctggtgtatgctacagcacataacacatttttactaaaggaaaaaagctaattatgtccatgcctctctataatcaattagaagtaatgaatggatgcatgtaaaatggatgtgattttttttcaagcttattttgaaatcttaaaaatcaggttacaccatagctactcaaaagttttacacacttaaaactcagatcagtaagtgttggtaccttttagactcataaaattgaataaaccattgcaatgctttaaaaaaaattaagtcagagggttttattgctatgattttatggcagacacatccaagcaaaaccattttccaaatgcagaccttcctgatgttatctgaaatctgataaaatgaccctactctctgctgtggttcattctcgctccatgctgtccatatttatgatctttattaagaacctgtcaatcagtcatcaccaccttcatt

SEQ ID NO: 27044 - DNA, 1709 bp, Homo sapiens
ggtcaccaggacaacgggcgtcgccggcgccgtgtgacttcgggctgtgggctcgctcgcggctcttcggccatggttttctcaaacaatgatgaaggccttattaacaaaaagttacccaaagaacttctgttaagaatattttccttcttggatatagtaactttgtgccgatgtgcacagatttccaaggcttggaacatcttagccctggatggaagcaactggcaaagaatagatctttttaactttcaaacagatgtagagggtcgagtggtggaaaatatctcgaagcgatgcggtggattcctgaggaagctcagcttgcgaggctgcattggtgttggggattcctccttgaagacctttgcacagaactgccgaaacattgaacatttgaacctcaatggatgcacaaaaatcactgacagcacgtgttatagccttagcagattctgttccaagctgaaacatctggatctgacctcctgtgtgtctattacaaacagctccttgaaggggatcagtgagggctgccgaaacctggagtacctgaacctctcttggtgtgatcagatcacgaaggatggcatcgaggcactggtgcgaggttgtcgaggcctgaaagccctgctcctgaggggctgcacacagttagaagatgaagctctgaaacacattcagaattactgccatgagcttgtgagcctcaacttgcagtcctgctcacgtatcacggatgaaggtgtggtgcagatatgcaggggctgtcaccggctacaggctctctgcctttcgggttgcagcaacctcacagatgcctctcttacagccctgggtttgaactgtccgcgactgcaaattttggaggctgcccgatgctcccatttgactgacgcaggttttacacttttagctcggaattgccacgaattggagaagatggatcttgaagaatgcatcctgataaccgacagcacactcatccagctctccattcactgtcctaaactgcaagccctgagcctgtcccactgtgaactcatcacagatgatgggatcctgcacctgagcaacagtacctgtggccatgagaggctgcgggtactggagttggacaactgcctcctcatcactgatgtggccctggaacacctagagaactgccgaggcctggagcgcctcgagctgtacgactgccagcaggttacccgtgcaggcatcaagcggatgcgggctcagctccctcatgtcaaagtccacgcctactttgctcccgtcaccccaccgacagcagtggcaggaagtggacagcgactgtgcaggtgctgtgtcattctctgacagcagctgcctgggcccaaggggtgatgaggcatcctttcctctagaagacctgagtcttcctgaccgactccaccatcacccaatctgttgattctccattgggaaaggcatttacagtttcccaacaggcacctatcaagatttaagaatggcgaagacaagaaaggatttataagcaacatctgacatcacatggtgacctgaaacatggctctgacctagctagtgctccttttgccctcttccctaatgagcagcctcaccagtacccatttgcttctctgatacctctaaaggttaataatcctcaagacagaccagacaggcccagcatcaaaatacatcaactgtgtacagtaaaa

SEQ ID NO: 27045 - DNA, 1647 bp, Homo sapiens
ggtcaccaggacaacgggcgtcgccggcgccgtgtgacttcgggctgtgggctcgctcgcggctcttcggccatggttttctcaaacaatgatgaaggccttattaacaaaaagttacccaaagaacttctgttaagaatattttccttcttggatatagtaactttgtgccgatgtgcacagatttccaaggcttggaacatcttagccctggatggaagcaactggcaaagaatagatctttttaactttcaaacagatgtagagggtcgagtggtggaaaatatctcgaagcgatgcggtggattcctgaggaagctcagcttgcgaggctgcattggtgttggggattcctccttgaagacctttgcacagaactgccgaaacattgaacatttgaacctcaatggatgcacaaaaatcactgacagcacgtgttatagccttagcagattctgttccaagctgaaacatctggatctgacctcctgtgtgtctattacaaacagctccttgaaggggatcagtgagggctgccgaaacctggagtacctgaacctctcttggtgtgatcagatcacgaaggatggcatcgaggcactggtgcgaggttgtcgaggcctgaaagccctgctcctgaggggctgcacacagttagaagatgaagctctgaaacacattcagaattactgccatgagcttgtgagcctcaacttgcagtcctgctcacgtatcacggatgaaggtgtggtgcagatatgcaggggctgtcaccggctacaggctctctgcctttcgggttgcagcaacctcacagatgcctctcttacagccctgggtttgaactgtccgcgactgcaaattttggaggctgcccgatgctcccatttgactgacgcaggttttacacttttagctcggaattgccacgaattggagaagatggatcttgaagaatgcatcctgataaccgacagcacactcatccagctctccattcactgtcctaaactgcaagccctgagcctgtcccactgtgaactcatcacagatgatgggatcctgcacctgagcaacagtacctgtggccatgagaggctgcgggtactggagttggacaactgcctcctcatcactgatgtggccctggaacacctagagaactgccgaggcctggagcgcctcgagctgtacgactgccagcaggttacccgtgcaggcatcaagcggatgcgggctcagctccctcatgtcaaagtccacgcctactttgctcccgtcaccccaccgacagcagtggcaggaagtggacagcgactgtgcaggtgctgtgtcattctctgacagcagctgcctgggcccaaggggtgatgaggcatcctttcctctagaagacctgagtcttcctgaccgactccaccatcacccaatctgttgattctccattgggaaaggcatttacagtttcccaacaggcacctatcaagatttaagaatggcgaagacaagaaaggcgccaggagctacacaggcaagaccatttaacaaaagggaaaaagtaaggcctaggaagagcgacttgagccctggtaccgctaactgagtcagcgacacccgagtaccgagccggtttgctcagacctgagg

SEQ ID NO: 27046 - DNA, 2455 bp, Homo sapiens
  misc_feature (154)..(154): n is a, c, g, or t
  misc_feature (219)..(219): n is a, c, g, or t
ggtcaccaggacaacgggcgtcgccggcgccgtgtgacttcgggctgtgggctcgctcgcggctcttcggccatggttttctcaaacaatgatgaaggccttattaacaaaaagttacccaaagaacttctgttaagaatgctgttcagcttgntgttaaattttacttggtctaatccagaatgtactaagtatgtacatagcattggtctggattcnttttgtaatgtgaatattttccttcttggatatagtaactttgtgccgatgtgcacagatttccaaggcttggaacatcttagccctggatggaagcaactggcaaagaatagatctttttaactttcaaacagatgtagagggtcgagtggtggaaaatatctcgaagcgatgcggtggattcctgaggaagctcagcttgcgaggctgcattggtgttggggattcctccttgaagacctttgcacagaactgccgaaacattgaacatttgaacctcaatggatgcacaaaaatcactgacagcacgtgttatagccttagcagattctgttccaagctgaaacatctggatctgacctcctgtgtgtctattacaaacagctccttgaaggggatcagtgagggctgccgaaacctggagtacctgaacctctcttggtgtgatcagatcacgaaggatggcatcgaggcactggtgcgaggttgtcgaggcctgaaagccctgctcctgaggggctgcacacagttagaagatgaagctctgaaacacattcagaattactgccatgagcttgtgagcctcaacttgcagtcctgctcacgtatcacggatgaaggtgtggtgcagatatgcaggggctgtcaccggctacaggctctctgcctttcgggttgcagcaacctcacagatgcctctcttacagccctgggtttgaactgtccgcgactgcaaattttggaggctgcccgatgctcccatttgactgacgcaggttttacacttttagctcggaattgccacgaattggagaagatggatcttgaagaatgcatcctgataaccgacagcacactcatccagctctccattcactgtcctaaactgcaagccctgagcctgtcccactgtgaactcatcacagatgatgggatcctgcacctgagcaacagtacctgtggccatgagaggctgcgggtactggagttggacaactgcctcctcatcactgatgtggccctggaacacctagagaactgccgaggcctggagcgcctcgagctgtacgactgccagcaggttacccgtgcaggcatcaagcggatgcgggctcagctccctcatgtcaaagtccacgcctactttgctcccgtcaccccaccgacagcagtggcaggaagtggacagcgactgtgcaggtgctgtgtcattctctgacagcagctgcctgggcccaaggggtgatgaggcatcctttcctctagaagacctgagtcttcctgaccgactccaccatcacccaatctgttgattctccattgggaaaggcatttacaggtaaaagacttctgtatggattgcagttactctggtgatagttttcacctttattctgctgtgaaacaatcaaatcaaagccttgtgtcagttaacacatgacaagtggtctcaatgcagctaggaccatgccagaaacctggatctcttaagagattggtacctacctaggtacgaaagttctacccttggcatactcagcattcctcaaaaagaccatcagtgttagcacaaactgagcagaaaaaataagctgttgattttctacctgatacttaagccagtggcctactttaattcacaattccattttgattagcaggacttttccactttgaagataaatagcaactttatcaaagtgactgtactgcaaattaattcataatgcctgatagttttatatatagagacttatgtggaaggcatgttaataggtttccatgagacaccaaagaaaagaggactctatactgggtggagcagggtcttcacctttttgtttctgtcaacttgtcatatacacctccagggaccaaaaacaaaagcagctcggagtctgtgttgcctgattggaaagtagaagctctggtgtatgctacagcacataacacatttttactaaaggaaaaaagctaattatgtccatgcctctcgtaaaactggggggaaccttaaagagaaagaactaaggcttaagttatctgtagtataatcaattagaagtaatgaatggatgcatgtaaaatggatgtgattttttttcaagcttattttgaaatcttaaaaatcaggttacaccatagctactcaaaagttttacacacttaaaactcagatcagtaagtgttggtaccttttagactcataaaattgaataaaccattgcaatgcttt

SEQ ID NO: 27047 - DNA, 2515 bp, Homo sapiens
  misc_feature (214)..(214): n is a, c, g, or t
  misc_feature (279)..(279): n is a, c, g, or t
agcgggaggggttccagctacagtgcaggactacacctacctgccaacttttcccatgggccttcaattagtacagtggaataggagttcggatgctggggcaagggaaagagagctaagaagggtcctgctgaggttttctcaaacaatgatgaaggccttattaacaaaaagttacccaaagaacttctgttaagaatgctgttcagcttgntgttaaattttacttggtctaatccagaatgtactaagtatgtacatagcattggtctggattcnttttgtaatgtgaatattttccttcttggatatagtaactttgtgccgatgtgcacagatttccaaggcttggaacatcttagccctggatggaagcaactggcaaagaatagatctttttaactttcaaacagatgtagagggtcgagtggtggaaaatatctcgaagcgatgcggtggattcctgaggaagctcagcttgcgaggctgcattggtgttggggattcctccttgaagacctttgcacagaactgccgaaacattgaacatttgaacctcaatggatgcacaaaaatcactgacagcacgtgttatagccttagcagattctgttccaagctgaaacatctggatctgacctcctgtgtgtctattacaaacagctccttgaaggggatcagtgagggctgccgaaacctggagtacctgaacctctcttggtgtgatcagatcacgaaggatggcatcgaggcactggtgcgaggttgtcgaggcctgaaagccctgctcctgaggggctgcacacagttagaagatgaagctctgaaacacattcagaattactgccatgagcttgtgagcctcaacttgcagtcctgctcacgtatcacggatgaaggtgtggtgcagatatgcaggggctgtcaccggctacaggctctctgcctttcgggttgcagcaacctcacagatgcctctcttacagccctgggtttgaactgtccgcgactgcaaattttggaggctgcccgatgctcccatttgactgacgcaggttttacacttttagctcggaattgccacgaattggagaagatggatcttgaagaatgcatcctgataaccgacagcacactcatccagctctccattcactgtcctaaactgcaagccctgagcctgtcccactgtgaactcatcacagatgatgggatcctgcacctgagcaacagtacctgtggccatgagaggctgcgggtactggagttggacaactgcctcctcatcactgatgtggccctggaacacctagagaactgccgaggcctggagcgcctcgagctgtacgactgccagcaggttacccgtgcaggcatcaagcggatgcgggctcagctccctcatgtcaaagtccacgcctactttgctcccgtcaccccaccgacagcagtggcaggaagtggacagcgactgtgcaggtgctgtgtcattctctgacagcagctgcctgggcccaaggggtgatgaggcatcctttcctctagaagacctgagtcttcctgaccgactccaccatcacccaatctgttgattctccattgggaaaggcatttacaggtaaaagacttctgtatggattgcagttactctggtgatagttttcacctttattctgctgtgaaacaatcaaatcaaagccttgtgtcagttaacacatgacaagtggtctcaatgcagctaggaccatgccagaaacctggatctcttaagagattggtacctacctaggtacgaaagttctacccttggcatactcagcattcctcaaaaagaccatcagtgttagcacaaactgagcagaaaaaataagctgttgattttctacctgatacttaagccagtggcctactttaattcacaattccattttgattagcaggacttttccactttgaagataaatagcaactttatcaaagtgactgtactgcaaattaattcataatgcctgatagttttatatatagagacttatgtggaaggcatgttaataggtttccatgagacaccaaagaaaagaggactctatactgggtggagcagggtcttcacctttttgtttctgtcaacttgtcatatacacctccagggaccaaaaacaaaagcagctcggagtctgtgttgcctgattggaaagtagaagctctggtgtatgctacagcacataacacatttttactaaaggaaaaaagctaattatgtccatgcctctcgtaaaactggggggaaccttaaagagaaagaactaaggcttaagttatctgtagtataatcaattagaagtaatgaatggatgcatgtaaaatggatgtgattttttttcaagcttattttgaaatcttaaaaatcaggttacaccatagctactcaaaagttttacacacttaaaactcagatcagtaagtgttggtaccttttagactcataaaattgaataaaccattgcaatgcttt

SEQ ID NO: 27048 - DNA, 2380 bp, Homo sapiens
ggtcaccaggacaacgggcgtcgccggcgccgtgtgacttcgggctgtgggctcgctcgcggctcttcggccatggttttctcaaacaatgatgaaggccttattaacaaaaagttacccaaagaacttctgttaagaatattttccttcttggatatagtaactttgtgccgatgtgcacagatttccaaggcttggaacatcttagccctggatggaagcaactggcaaagaatagatctttttaactttcaaacagatgtagagggtcgagtggtggaaaatatctcgaagcgatgcggtggattcctgaggaagctcagcttgcgaggctgcattggtgttggggattcctccttgaagacctttgcacagaactgccgaaacattgaacatttgaacctcaatggatgcacaaaaatcactgacagtgcgtctgctctttttcagcacgtgttatagccttagcagattctgttccaagctgaaacatctggatctgacctcctgtgtgtctattacaaacagctccttgaaggggatcagtgagggctgccgaaacctggagtacctgaacctctcttggtgtgatcagatcacgaaggatggcatcgaggcactggtgcgaggttgtcgaggcctgaaagccctgctcctgaggggctgcacacagttagaagatgaagctctgaaacacattcagaattactgccatgagcttgtgagcctcaacttgcagtcctgctcacgtatcacggatgaaggtgtggtgcagatatgcaggggctgtcaccggctacaggctctctgcctttcgggttgcagcaacctcacagatgcctctcttacagccctgggtttgaactgtccgcgactgcaaattttggaggctgcccgatgctcccatttgactgacgcaggttttacacttttagctcggaattgccacgaattggagaagatggatcttgaagaatgcatcctgataaccgacagcacactcatccagctctccattcactgtcctaaactgcaagccctgagcctgtcccactgtgaactcatcacagatgatgggatcctgcacctgagcaacagtacctgtggccatgagaggctgcgggtactggagttggacaactgcctcctcatcactgatgtggccctggaacacctagagaactgccgaggcctggagcgcctcgagctgtacgactgccagcaggttacccgtgcaggcatcaagcggatgcgggctcagctccctcatgtcaaagtccacgcctactttgctcccgtcaccccaccgacagcagtggcaggaagtggacagcgactgtgcaggtgctgtgtcattctctgacagcagctgcctgggcccaaggggtgatgaggcatcctttcctctagaagacctgagtcttcctgaccgactccaccatcacccaatctgttgattctccattgggaaaggcatttacaggtaaaagacttctgtatggattgcagttactctggtgatagttttcacctttattctgctgtgaaacaatcaaatcaaagccttgtgtcagttaacacatgacaagtggtctcaatgcagctaggaccatgccagaaacctggatctcttaagagattggtacctacctaggtacgaaagttctacccttggcatactcagcattcctcaaaaagaccatcagtgttagcacaaactgagcagaaaaaataagctgttgattttctacctgatacttaagccagtggcctactttaattcacaattccattttgattagcaggacttttccactttgaagataaatagcaactttatcaaagtgactgtactgcaaattaattcataatgcctgatagttttatatatagagacttatgtggaaggcatgttaataggtttccatgagacaccaaagaaaagaggactctatactgggtggagcagggtcttcacctttttgtttctgtcaacttgtcatatacacctccagggaccaaaaacaaaagcagctcggagtctgtgttgcctgattggaaagtagaagctctggtgtatgctacagcacataacacatttttactaaaggaaaaaagctaattatgtccatgcctctcgtaaaactggggggaaccttaaagagaaagaactaaggcttaagttatctgtagtataatcaattagaagtaatgaatggatgcatgtaaaatggatgtgattttttttcaagcttattttgaaatcttaaaaatcaggttacaccatagctactcaaaagttttacacacttaaaactcagatcagtaagtgttggtaccttttagactcataaaattgaataaaccattgcaatgcttt

SEQ ID NO: 27049 - DNA, 1781 bp, Homo sapiens
tgattaaatgtctcagtctgttttgtgctgctactacagactggataatttgtaatgaacagaaacttctcatagttctgaaggctgggaagtccaggggctggcatctgctgagggcattcttgctgtgtcatcccattgcagaagggcaaaaaggctagcttccagcttttttttaggacttgagccttggaataagggtcctgcaaacatttactcatgtcttcctgttccagagcctgtcccactgtgaactcatcacagatgatgggatcctgcacctgagcaacagtacctgtggccatgagaggctgcgggtactggagttggacaactgcctcctcatcactgatgtggccctggaacacctagagaactgccgaggcctggagcgcctcgagctgtacgactgccagcaggttacccgtgcaggcatcaagcggatgcgggctcagctccctcatgtcaaagtccacgcctactttgctcccgtcaccccaccgacagcagtggcaggaagtggacagcgactgtgcaggtgctgtgtcattctctgacagcagctgcctgggcccaaggggtgatgaggcatcctttcctctagaagacctgagtcttcctgaccgactccaccatcacccaatctgttgattctccattgggaaaggcatttacaggtaaaagacttctgtatggattgcagttactctggtgatagttttcacctttattctgctgtgaaacaatcaaatcaaagccttgtgtcagttaacacatgacaagtggtctcaatgcagctaggaccatgccagaaacctggatctcttaagagattggtacctacctaggtacgaaagttctacccttggcatactcagcattcctcaaaaagaccatcagtgttagcacaaactgagcagaaaaaataagctgttgattttctacctgatacttaagccagtggcctactttaattcacaattccattttgattagcaggacttttccactttgaagataaatagcaactttatcaaagtgactgtactgcaaattaattcataatgcctgatagttttatatatagagacttatgtggaaggcatgttaataggtttccatgagacaccaaagaaaagaggactctatactgggtggagcagggtcttcacctttttgtttctgtcaacttgtcatatacacctccagggaccaaaaacaaaagcagctcggagtctgtgttgcctgattggaaagtagaagctctggtgtatgctacagcacataacacatttttactaaaggaaaaaagctaattatgtccatgcctctcgtaaaactggggggaaccttaaagagaaagaactaaggcttaagttatctgtagtataatcaattagaagtaatgaatggatgcatgtaaaatggatgtgattttttttcaagcttattttgaaatcttaaaaatcaggttacaccatagctactcaaaagttttacacacttaaaactcagatcagtaagtgttggtaccttttagactcataaaattgaataaaccattgcaatgctttaaaaaaaattaagtcagagggttttattgctatgattttatggcagacacatccaagcaaaaccattttccaaatgcagaccttcctgatgttatctgaaatctgataaaatgaccctactctctgctgtggttcattctcgctccatgctgtccatatttatgatctttattaagaacctgtcaatcagtcatcaccaccttcatt

SEQ ID NO: 27050 - DNA, 1629 bp, Homo sapiens
agtttttctgacattattcacctgttaaagatgaaagagccctcccaccacaacaagaagctgtttgggttctctttctgtaagagcctgtcccactgtgaactcatcacagatgatgggatcctgcacctgagcaacagtacctgtggccatgagaggctgcgggtactggagttggacaactgcctcctcatcactgatgtggccctggaacacctagagaactgccgaggcctggagcgcctcgagctgtacgactgccagcaggttacccgtgcaggcatcaagcggatgcgggctcagctccctcatgtcaaagtccacgcctactttgctcccgtcaccccaccgacagcagtggcaggaagtggacagcgactgtgcaggtgctgtgtcattctctgacagcagctgcctgggcccaaggggtgatgaggcatcctttcctctagaagacctgagtcttcctgaccgactccaccatcacccaatctgttgattctccattgggaaaggcatttacaggtaaaagacttctgtatggattgcagttactctggtgatagttttcacctttattctgctgtgaaacaatcaaatcaaagccttgtgtcagttaacacatgacaagtggtctcaatgcagctaggaccatgccagaaacctggatctcttaagagattggtacctacctaggtacgaaagttctacccttggcatactcagcattcctcaaaaagaccatcagtgttagcacaaactgagcagaaaaaataagctgttgattttctacctgatacttaagccagtggcctactttaattcacaattccattttgattagcaggacttttccactttgaagataaatagcaactttatcaaagtgactgtactgcaaattaattcataatgcctgatagttttatatatagagacttatgtggaaggcatgttaataggtttccatgagacaccaaagaaaagaggactctatactgggtggagcagggtcttcacctttttgtttctgtcaacttgtcatatacacctccagggaccaaaaacaaaagcagctcggagtctgtgttgcctgattggaaagtagaagctctggtgtatgctacagcacataacacatttttactaaaggaaaaaagctaattatgtccatgcctctcgtaaaactggggggaaccttaaagagaaagaactaaggcttaagttatctgtagtataatcaattagaagtaatgaatggatgcatgtaaaatggatgtgattttttttcaagcttattttgaaatcttaaaaatcaggttacaccatagctactcaaaagttttacacacttaaaactcagatcagtaagtgttggtaccttttagactcataaaattgaataaaccattgcaatgctttaaaaaaaattaagtcagagggttttattgctatgattttatggcagacacatccaagcaaaaccattttccaaatgcagaccttcctgatgttatctgaaatctgataaaatgaccctactctctgctgtggttcattctcgctccatgctgtccatatttatgatctttattaagaacctgtcaatcagtcatcaccaccttcatt

SEQ ID NO: 27051 - DNA, 733 bp, Homo sapiens
ggtcaccaggacaacgggcgtcgccggcgccgtgtgacttcgggctgtgggctcgctcgcggctcttcggccatggttttctcaaacaatgatgaaggccttattaacaaaaagttacccaaagaacttctgttaagaatattttccttcttggatatagtaactttgtgccgatgtgcacagatttccaaggcttggaacatcttagccctggatggaagcaactggcaaagaatagatctttttaactttcaaacagatgtagagggtcgagtggtggaaaatatctcgaagcgatgcggtggattcctgaggaagctcagcttgcgaggctgcattggtgttggggattcctccttgaagacctttgcacagaactgccgaaacattgaacatttgaacctcaatggatgcacaaaaatcactgacagcacgtgttatagccttagcagattctgttccaagctgaaacatctggatctgacctcctgtgtgtctattacaaacagctccttgaaggggatcagtgagggctgccgaaacctggagtacctgaacctctcttggtgtgatcagatcacgaaggatggcatcgaggcactggtgcgaggttgtcgaggcctgaaagccctgctcctgaggggctgcacacaggaggtcagatccagatgtttcggcttggaacagaatctgctaaggctatcacacgtgctgtcagtgatttttggtcgac

SEQ ID NO: 27052 - DNA, 494 bp, Homo sapiens
aaatggtttctctggaaaggctctagggtaagcaagtgacagcatggcacagtactagaagatttgcccccttggttcaaattgatttttttgtagagcggagggagcagggagctaggcctctattctcatgattcggtgatgactcaccaagctgtgggtaaaggagaactgattgataggtagtctaggactctgcttctcaaaacgtggtccctagactagcagcactggcatcacctgggagtttctttgaactgcagactgtcgagccccattctagatctatcatcagaatctgcactgtgacaagaaccctagctgattgttacgcgctttaattaagtttgagggagcgctgttctaagcgtgaatggtttcatatgccctctagtggctgtccagcaacttgcagggagctttaaaatgttttctcattttaggacctttgcacagaactgccgaaacattgaacatttgaacctcaatggatg

SEQ ID NO: 27053 - DNA, 617 bp, Homo sapiens
caaatgggctttgtcatcaagctttttttgacagtgttatttgaggctcaggcatctgagcctgttcagtgcatctaccaccaaaagagggcttatgctagagagttggtcttcaaatagaaccagttatggtctttcctgtgtccattacttagaacaagggaaatataagcttaatgagttctaaggtaatttgtattgtgtgtccaaaatagcttctgaacatgcaaacacttaatatttcactgtagtgatgtaaagttatagtgcacttgtatatttcagattgaggaatcttgaaaaaacttatgtatccaggtggcggattagagtttatctttcaagttataattatcctgaaatgttaacaccatctcgtttttgtgtttttttcctctctctgtagaatattttccttcttggatatagtaactttgtgccgatgtgcacagatttccaaggtagagtattcaccagattttttaatcaataaatatcaagttttattagaatgagttttagttcaaattactgaaaattaaaattttattatcttttatacttaatataacataatggtataattttgcatttgatgattaacttaatatacatca

SEQ ID NO: 27054 - DNA, 370 bp, Homo sapiens
attcccacataaagataaatgaacaatggaataccaataaaggcctacgaaagtggaatcacaaataagcataccatagtcagagcgtgaactatggcccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgtagctgc

SEQ ID NO: 27055 - DNA, 5919 bp, Homo sapiens
  misc_feature (17)..(17): n is a, c, g, or t
ctcggctctaccttgtntcacagagtggagactgggatgaaggatgtggtgaactgcgttgggggtatgggtgccctgctgcccctgctggagcgagtagctgcacagcccaaagaggctgaagcaggtccagctgaaacgcatgacctcgtgggtcctgaactgacctctggtcacaacacccagggcctggttctcccattgggtaaatcttcagaggaacggatggagaggaacgcagtggctgcttttctgctgatgctgcggaacttccttcagggtcacatggtgaaccaagagagcctggtgcagtgccaggggcctgccatcatcggggccctcctgcgaaaggtcccaagctgggccatggacatgaacgtgctcatgtccgcccagctgctgatggagcaggtggcagctgagggcagcgggcccctcctgtacctactctaccagcatttgctcttcaactttcacctctggaccctcagtgacttcgccgtgcgcctcggtcacatccagtacatgtccagcatagttcgggagcacagacagaagctgcggaagaagtacggcgtccagtttatcttggatgctctgcgcacccactacagcccgcagcgggagcgccccctggctgctgacgacctacgcaccgtgcagacctccctcctgggcctggcgagggagttcctggtgcggagtctctcagcagatgacgtgcaggtcacgcagaccatgctgagctttttggcggccacaggcgatgacggtcaggcggtgggtgcgctggacctgctgctggccctgctgcacggttccctggtgcaggagtccttggctgtctttctgttggagccagggaacctcgaagtgctactggccctgctagtgcggccagggtcactgcccctgctgcccgatcgagtctgcaagatcctgcgcagactgcagcagaatgagcggctacctgagcggagccgccagcgcctccggctgcgggagtgtggtctccagggtctggttgcctgcttgcctgaggggactgtttccccccagctctgccagggcctctacaagctgttcctgggggcagattgcctgaacctctcagatctgctggctgtggtacagctgtccctccaggctgacctcagcgttcgcctagacatctgtcgccagcttttccacctcatctacggacagccagatgtagtgcggcttctggcccgacaggctggctggcaagatgtgctgacccggctatatgtcctggaggctgccacagccggcagcccccctccgtcttccccagagtcacctacctcccccaagccagccccacccaagccacccactgagtcacctgctgagccttcagatgtcttcctgccctcagaggccccctgccctgaccctgatggcttttaccatgctctctccccattctgcacgccctttgacctgggcctggaacggtctagtgtaggatcaggcaacactgctggtggtggcggcagcagtgggactcttactccagccagccagcccggcactccttcgccactggatgggccgcggccctttcctgctgctcctggccgccacagctccagtctctccaatgtgctggaggacggcagcctcccggagcccaccattagcggggatgatacctcgaacaccagcaacccacagcaaacctctgaggaagagttgtgcaatctgctcaccaacgtgctgttctcggtgacgtggcgtggcgtggaaggcagcgatgaggctgcctggcgggagcgtggccaggttttctcagtgctcacccagctgggggcctcagccacacttgtgcgcccaccagactgcatcaagcgcagcctcctggagatgatgctggagtcagccctgaccgacatcaaagaggcccccgtgggggtcctggccagcctcacccagcaagcgctttggctgctgcgtctgctgcaggacttcctgtgtgctgaaggccatggtaaccaggaactgtggagtgagaagctctttgaaggtgtatgcagcctacttgatcgcctgggagcctggccccacctggccaacggcacagctgatctccgtgagatggcgcagattggcctacggcttgtacttggctacatcctgctggaagacccacagctgcatgcccaggcctacgtgagattgcacatgctgctacagactgcagtgccagcccgccgcgaggaggcctgctatgtgctctccaagctggaggctgcactggggcgggtgctgaacacctcttccttggagtcagccactgatgaggcagggtccccacttgcagctgcagcagctgcagcagctgcagagcgctgctcctggctggtgccactggtgcgcacgctgctagaccgtgcctatgagccgctggggctgcagtggggactgccctccctgccacccaccaatggcagccccaccttctttgaagacttccaggctttttgtgccacacccgaatggcgccacttcatcgacaaacaggtacagccaaccatgtcccagttcgaaatggacacgtatgctaagagccacgaccttatgtcaggtttctggaatgcctgctatgacatgcttatgagcagtgggcagcggcgccagtgggagcgcgcccagagtcgtcgggccttccaggagctggtgctggaacctgcgcagaggcgggcgcgcctggaggggctacgctacacggcagtgctgaagcagcaggcaacgcagcactccatggccctgctgcactggggggcgctgtggcgccagctcgccagcccatgtggggcctgggcgctgagggacactcccatcccccgctggaaactgtccagcgccgagacatattcacgcatgcgtctgaagctggtgcccaaccatcacttcgaccctcacctggaagccagcgctctccgagacaatctgggtgaggttcccctgacacccaccgaggaggcctcactgcctctggcagtgaccaaagaggccaaagtgagcaccccacccgagttgctgcaggaggaccagctcggcgaggacgagctggctgagctggagaccccgatggaggcagcagaactggatgagcagcgtgagaagctggtgctgtcggccgagtgccagctggtgacggtagtggccgtggtcccagggctgctggaggtcaccacacagaatgtatacttctacgatggcagcactgagcgcgtggaaaccgaggagggcatcggctatgatttccggcgcccactggcccagctgcgtgaggtccacctgcggcgtttcaacctgcgccgttcagcacttgagctcttctttatcgatcaggccaactacttcctcaacttcccatgcaaggtgggcacgaccccagtctcatctcctagccagactcccagaccccagcctggccccatcccaccccatacccaggtacggaaccaggtgtactcgtggctcctgcgcctacggcccccctctcaaggctacctaagcagccgctccccccaggagatgctgcgtgcctcaggccttacccagaaatgggtacagcgtgagatatccaacttcgagtacttgatgcaactcaacaccattgcggggcggacctacaatgacctgtctcagtaccctgtggtatgaaagctttgaggacccagcagggaccattgacaagttccactatggcacccactactccaatgcagcaggcgtgatgcactacctcatccgcgtggagcccttcacctccctgcacgtccagctgcaaagtggccgctttgactgctccgaccggcagttccactcggtggcggcagcctggcaggcacgcctggagagccctgccgatgtgaaggagctcatcccggaattcttctactttcctgacttcctggagaaccagaacggttttgacctgggctgtctccagctgaccaacgagaaggtaggcgatgtggtgctacccccgtgggccagctctcctgaggacttcatccagcagcaccgccaggctctggagtcggagtatgtgtctgcacacctacacgagtggatcgacctcatctttggctacaagcagcgggggccagccgccgaggaggccctcaatgtcttctattactgcacctatgagggggctgtagacctggaccatgtgacagatgagcgggaacggaaggctctggagggcattatcagcaactttgggcagactccctgtcagctgctgaaggagccacatccaactcggctctcagctgaggaagcagcccatcgccttgcacgcctggacactaactcacctagcatcttccagcacctggacgaactcaaggcattcttcgcagaggttgtcagtgatggtgtacccctggtgctagccctggtcccccaccggcagccccactccttcatcacccagggttccccagacctgttggtgactgtgagtgccagtgggctgctgggcacccacagctggttgccctatgaccgcaacataagcaactacttcagcttcagcaaagaccccaccatgggcagccacaagacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgttgagccagctcagctgccaccttgatgtagtaacctgccttgcactggacacctgtggcatctacctcatctcaggctcccgggacaccacgtgcatggtgtggcggctcctgcatcagggtggtctgtcagtaggcctggcaccaaagcctgtgcaggtcctgtatgggcatggggctgcagtgagctgtgtggccatcagcactgaacttgacatggctgtgtctggatctgaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgtagctgc

SEQ ID NO: 27056 - DNA, 6273 bp, Homo sapiens
ctagaggatccccagactcggcaccgttcgctgccctccctcagtgagcctttctcctcctgctgtatcggctccgctggataccgcatcgactctaccctcgcaggcacccaggacactcggtggggcagccccacatccctggagggtgagctgggggctgtggccatctttcacgaagccctgcaggcgacggctctgaggaccctgtgcaccctggggcccaatgagacggcacccttcaagcctgagggggagctgcatgagctcagcaccaggctgctcctccattactcacctcaggcttgtaagaacaacatctgcctggacctgtcccccagtcatgggcttgatgggcgcctgacgggccacagagtggagacctgggatgtgaaggatgtggtgaactgcgttgggggtatgggtgccctgctgcccctgctggagcgagtagctgcacagcccaaagaggctgaagcaggtccagctgaaacgcatgacctcgtgggtcctgaactgacctctggtcacaacacccagggcctggttctcccattgggtaaatcttcagaggaacggatggagaggaacgcagtggctgcttttctgctgatgctgcggaacttccttcagggtcacatggtgaaccaagagagcctggtgcagtgccaggggcctgccatcatcggggccctcctgcgaaaggtcccaagctgggccatggacatgaacgtgctcatgtccgcccagctgctgatggagcaggtggcagctgagggcagcgggcccctcctgtacctactctaccagcatttgctcttcaactttcacctctggaccctcagtgacttcgccgtgcgcctcggtcacatccagtacatgtccagcatagttcgggagcacagacagaagctgcggaagaagtacggcgtccagtttatcttggatgctctgcgcacccactacagcccgcagcgggagcgccccctggctgctgacgacctacgcaccgtgcagacctccctcctgggcctggcgagggagttcctggtgcggagtctctcagcagatgacgtgcaggtcacgcagaccatgctgagctttttggcggccacaggcgatgacggtcaggcggtgggtgcgctggacctgctgctggccctgctgcacggttccctggtgcaggagtccttggctgtctttctgttggagccagggaacctcgaagtgctactggccctgctagtgcggccagggtcactgcccctgctgcccgatcgagtctgcaagatcctgcgcagactgcagcagaatgagcggctacctgagcggagccgccagcgcctccggctgcgggagtgtggtctccagggtctggttgcctgcttgcctgaggggactgtttccccccagctctgccagggcctctacaagctgttcctgggggcagattgcctgaacctctcagatctgctggctgtggtacagctgtccctccaggctgacctcagcgttcgcctagacatctgtcgccagcttttccacctcatctacggacagccagatgtagtgcggcttctggcccgacaggctggctggcaagatgtgctgacccggctatatgtcctggaggctgccacagccggcagcccccctccgtcttccccagagtcacctacctcccccaagccagccccacccaagccacccactgagtcacctgctgagccttcagatgtcttcctgccctcagaggccccctgccctgaccctgatggcttttaccatgctctctccccattctgcacgccctttgacctgggcctggaacggtctagtgtaggatcaggcaacactgctggtggtggcggcagcagtgggactcttactccagccagccagcccggcactccttcgccactggatgggccgcggccctttcctgctgctcctggccgccacagctccagtctctccaatgtgctggaggacggcagcctcccggagcccaccattagcggggatgatacctcgaacaccagcaacccacagcaaacctctgaggaagagttgtgcaatctgctcaccaacgtgctgttctcggtgacgtggcgtggcgtggaaggcagcgatgaggctgcctggcgggagcgtggccaggttttctcagtgctcacccagctgggggcctcagccacacttgtgcgcccaccagactgcatcaagcgcagcctcctggagatgatgctggagtcagccctgaccgacatcaaagaggcccccgtgggggtcctggccagcctcacccagcaagcgctttggctgctgcgtctgctgcaggacttcctgtgtgctgaaggccatggtaaccaggaactgtggagtgagaagctctttgaaggtgtatgcagcctacttgatcgcctgggagcctggccccacctggccaacggcacagctgatctccgtgagatggcgcagattggcctacggcttgtacttggctacatcctgctggaagacccacagctgcatgcccaggcctacgtgagattgcacatgctgctacagactgcagtgccagcccgccgcgaggaggcctgctatgtgctctccaagctggaggctgcactggggcgggtgctgaacacctcttccttggagtcagccactgatgaggcagggtccccacttgcagctgcagcagctgcagcagctgcagagcgctgctcctggctggtgccactggtgcgcacgctgctagaccgtgcctatgagccgctggggctgcagtggggactgccctccctgccacccaccaatggcagccccaccttctttgaagacttccaggctttttgtgccacacccgaatggcgccacttcatcgacaaacaggtacagccaaccatgtcccagttcgaaatggacacgtatgctaagagccacgaccttatgtcaggtttctggaatgcctgctatgacatgcttatgagcagtgggcagcggcgccagtgggagcgcgcccagagtcgtcgggccttccaggagctggtgctggaacctgcgcagaggcgggcgcgcctggaggggctacgctacacggcagtgctgaagcagcaggcaacgcagcactccatggccctgctgcactggggggcgctgtggcgccagctcgccagcccatgtggggcctgggcgctgagggacactcccatcccccgctggaaactgtccagcgccgagacatattcacgcatgcgtctgaagctggtgcccaaccatcacttcgaccctcacctggaagccagcgctctccgagacaatctgggtgaggttcccctgacacccaccgaggaggcctcactgcctctggcagtgaccaaagaggccaaagtgagcaccccacccgagttgctgcaggaggaccagctcggcgaggacgagctggctgagctggagaccccgatggaggcagcagaactggatgagcagcgtgagaagctggtgctgtcggccgagtgccagctggtgacggtagtggccgtggtcccagggctgctggaggtcaccacacagaatgtatacttctacgatggcagcactgagcgcgtggaaaccgaggagggcatcggctatgatttccggcgcccactggcccagctgcgtgaggtccacctgcggcgtttcaacctgcgccgttcagcacttgagctcttctttatcgatcaggccaactacttcctcaacttcccatgcaaggtgggcacgaccccagtctcatctcctagccagactcccagaccccagcctggccccatcccaccccatacccaggtacggaaccaggtgtactcgtggctcctgcgcctacggcccccctctcaaggctacctaagcagccgctccccccaggagatgctgcgtgcctcaggccttacccagaaatgggtacagcgtgagatatccaacttcgagtacttgatgcaactcaacaccattgcggggcggacctacaatgacctgtctcagtaccctgtggtatgaaagctttgaggacccagcagggaccattgacaagttccactatggcacccactactccaatgcagcaggcgtgatgcactacctcatccgcgtggagcccttcacctccctgcacgtccagctgcaaagtggccgctttgactgctccgaccggcagttccactcggtggcggcagcctggcaggcacgcctggagagccctgccgatgtgaaggagctcatcccggaattcttctactttcctgacttcctggagaaccagaacggttttgacctgggctgtctccagctgaccaacgagaaggtaggcgatgtggtgctacccccgtgggccagctctcctgaggacttcatccagcagcaccgccaggctctggagtcggagtatgtgtctgcacacctacacgagtggatcgacctcatctttggctacaagcagcgggggccagccgccgaggaggccctcaatgtcttctattactgcacctatgagggggctgtagacctggaccatgtgacagatgagcgggaacggaaggctctggagggcattatcagcaactttgggcagactccctgtcagctgctgaaggagccacatccaactcggctctcagctgaggaagcagcccatcgccttgcacgcctggacactaactcacctagcatcttccagcacctggacgaactcaaggcattcttcgcagaggttgtcagtgatggtgtacccctggtgctagccctggtcccccaccggcagccccactccttcatcacccagggttccccagacctgttggtgactgtgagtgccagtgggctgctgggcacccacagctggttgccctatgaccgcaacataagcaactacttcagcttcagcaaagaccccaccatgggcagccacaagacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgttgagccagctcagctgccaccttgatgtagtaacctgccttgcactggacacctgtggcatctacctcatctcaggctcccgggacaccacgtgcatggtgtggcggctcctgcatcagggtggtctgtcagtaggcctggcaccaaagcctgtgcaggtcctgtatgggcatggggctgcagtgagctgtgtggccatcagcactgaacttgacatggctgtgtctggatctgaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgtagctgc

SEQ ID NO: 27057 - DNA, 6044 bp, Homo sapiens
  misc_feature (17)..(17): n is a, c, g, or t
ctcggctctaccttgtntcacagagtggagactgggatgaaggatgtggtgaactgcgttgggggtatgggtgccctgctgcccctgctggagcgagtagctgcacagcccaaagaggctgaagcaggtccagctgaaacgcatgacctcgtgggtcctgaactgacctctggtcacaacacccagggcctggttctcccattgggtaaatcttcagaggaacggatggagaggaacgcagtggctgcttttctgctgatgctgcggaacttccttcagggtcacatggtgaaccaagagagcctggtgcagtgccaggggcctgccatcatcggggccctcctgcgaaaggtcccaagctgggccatggacatgaacgtgctcatgtccgcccagctgctgatggagcaggtggcagctgagggcagcgggcccctcctgtacctactctaccagcatttgctcttcaactttcacctctggaccctcagtgacttcgccgtgcgcctcggtcacatccagtacatgtccagcatagttcgggagcacagacagaagctgcggaagaagtacggcgtccagtttatcttggatgctctgcgcacccactacagcccgcagcgggagcgccccctggctgctgacgacctacgcaccgtgcagacctccctcctgggcctggcgagggagttcctggtgcggagtctctcagcagatgacgtgcaggtcacgcagaccatgctgagctttttggcggccacaggcgatgacggtcaggcggtgggtgcgctggacctgctgctggccctgctgcacggttccctggtgcaggagtccttggctgtctttctgttggagccagggaacctcgaagtgctactggccctgctagtgcggccagggtcactgcccctgctgcccgatcgagtctgcaagatcctgcgcagactgcagcagaatgagcggctacctgagcggagccgccagcgcctccggctgcgggagtgtggtctccagggtctggttgcctgcttgcctgaggggactgtttccccccagctctgccagggcctctacaagctgttcctgggggcagattgcctgaacctctcagatctgctggctgtggtacagctgtccctccaggctgacctcagcgttcgcctagacatctgtcgccagcttttccacctcatctacggacagccagatgtagtgcggcttctggcccgacaggctggctggcaagatgtgctgacccggctatatgtcctggaggctgccacagccggcagcccccctccgtcttccccagagtcacctacctcccccaagccagccccacccaagccacccactgagtcacctgctgagccttcagatgtcttcctgccctcagaggccccctgccctgaccctgatggcttttaccatgctctctccccattctgcacgccctttgacctgggcctggaacggtctagtgtaggatcaggcaacactgctggtggtggcggcagcagtgggactcttactccagccagccagcccggcactccttcgccactggatgggccgcggccctttcctgctgctcctggccgccacagctccagtctctccaatgtgctggaggacggcagcctcccggagcccaccattagcggggatgatacctcgaacaccagcaacccacagcaaacctctgaggaagagttgtgcaatctgctcaccaacgtgctgttctcggtgacgtggcgtggcgtggaaggcagcgatgaggctgcctggcgggagcgtggccaggttttctcagtgctcacccagctgggggcctcagccacacttgtgcgcccaccagactgcatcaagcgcagcctcctggagatgatgctggagtcagccctgaccgacatcaaagaggcccccgtgggggtcctggccagcctcacccagcaagcgctttggctgctgcgtctgctgcaggacttcctgtgtgctgaaggccatggtaaccaggaactgtggagtgagaagctctttgaaggtgtatgcagcctacttgatcgcctgggagcctggccccacctggccaacggcacagctgatctccgtgagatggcgcagattggcctacggcttgtacttggctacatcctgctggaagacccacagctgcatgcccaggcctacgtgagattgcacatgctgctacagactgcagtgccagcccgccgcgaggaggcctgctatgtgctctccaagctggaggctgcactggggcgggtgctgaacacctcttccttggagtcagccactgatgaggcagggtccccacttgcagctgcagcagctgcagcagctgcagagcgctgctcctggctggtgccactggtgcgcacgctgctagaccgtgcctatgagccgctggggctgcagtggggactgccctccctgccacccaccaatggcagccccaccttctttgaagacttccaggctttttgtgccacacccgaatggcgccacttcatcgacaaacaggtacagccaaccatgtcccagttcgaaatggacacgtatgctaagagccacgaccttatgtcaggtttctggaatgcctgctatgacatgcttatgagcagtgggcagcggcgccagtgggagcgcgcccagagtcgtcgggccttccaggagctggtgctggaacctgcgcagaggcgggcgcgcctggaggggctacgctacacggcagtgctgaagcagcaggcaacgcagcactccatggccctgctgcactggggggcgctgtggcgccagctcgccagcccatgtggggcctgggcgctgagggacactcccatcccccgctggaaactgtccagcgccgagacatattcacgcatgcgtctgaagctggtgcccaaccatcacttcgaccctcacctggaagccagcgctctccgagacaatctgggtgaggttcccctgacacccaccgaggaggcctcactgcctctggcagtgaccaaagaggccaaagtgagcaccccacccgagttgctgcaggaggaccagctcggcgaggacgagctggctgagctggagaccccgatggaggcagcagaactggatgagcagcgtgagaagctggtgctgtcggccgagtgccagctggtgacggtagtggccgtggtcccagggctgctggaggtcaccacacagaatgtatacttctacgatggcagcactgagcgcgtggaaaccgaggagggcatcggctatgatttccggcgcccactggcccagctgcgtgaggtccacctgcggcgtttcaacctgcgccgttcagcacttgagctcttctttatcgatcaggccaactacttcctcaacttcccatgcaaggtgggcacgaccccagtctcatctcctagccagactcccagaccccagcctggccccatcccaccccatacccaggtacggaaccaggtgtactcgtggctcctgcgcctacggcccccctctcaaggctacctaagcagccgctccccccaggagatgctgcgtgcctcaggccttacccagaaatgggtacagcgtgagatatccaacttcgagtacttgatgcaactcaacaccattgcggggcggacctacaatgacctgtctcagtaccctgtgttcccctgggtcctgcaggactacgtgtccccaaccctggacctcagcaacccagccgtcttccgggacctgtctaagcccatcggtgtggtgaaccccaagcatgcccagctcgtgagggagaagtatgaaagctttgaggacccagcagggaccattgacaagttccactatggcacccactactccaatgcagcaggcgtgatgcactacctcatccgcgtggagcccttcacctccctgcacgtccagctgcaaagtggccgctttgactgctccgaccggcagttccactcggtggcggcagcctggcaggcacgcctggagagccctgccgatgtgaaggagctcatcccggaattcttctactttcctgacttcctggagaaccagaacggttttgacctgggctgtctccagctgaccaacgagaaggtaggcgatgtggtgctacccccgtgggccagctctcctgaggacttcatccagcagcaccgccaggctctggagtcggagtatgtgtctgcacacctacacgagtggatcgacctcatctttggctacaagcagcgggggccagccgccgaggaggccctcaatgtcttctattactgcacctatgagggggctgtagacctggaccatgtgacagatgagcgggaacggaaggctctggagggcattatcagcaactttgggcagactccctgtcagctgctgaaggagccacatccaactcggctctcagctgaggaagcagcccatcgccttgcacgcctggacactaactcacctagcatcttccagcacctggacgaactcaaggcattcttcgcagaggttgtcagtgatggtgtacccctggtgctagccctggtcccccaccggcagccccactccttcatcacccagggttccccagacctgttggtgactgtgagtgccagtgggctgctgggcacccacagctggttgccctatgaccgcaacataagcaactacttcagcttcagcaaagaccccaccatgggcagccacaagacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgttgagccagctcagctgccaccttgatgtagtaacctgccttgcactggacacctgtggcatctacctcatctcaggctcccgggacaccacgtgcatggtgtggcggctcctgcatcagggtggtctgtcagtaggcctggcaccaaagcctgtgcaggtcctgtatgggcatggggctgcagtgagctgtgtggccatcagcactgaacttgacatggctgtgtctggatctgaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgtagctgc

SEQ ID NO: 27058 - DNA, 5954 bp, Homo sapiens
  misc_feature (17)..(17): n is a, c, g, or t
ctcggctctaccttgtntcacagagtggagactgggatgaaggatgtggtgaactgcgttgggggtatgggtgccctgctgcccctgctggagcgagtagctgcacagcccaaagaggctgaagcaggtccagctgaaacgcatgacctcgtgggtcctgaactgacctctggtcacaacacccagggcctggttctcccattgggtaaatcttcagaggaacggatggagaggaacgcagtggctgcttttctgctgatgctgcggaacttccttcagggtcacatggtgaaccaagagagcctggtgcagtgccaggggcctgccatcatcggggccctcctgcgaaaggtcccaagctgggccatggacatgaacgtgctcatgtccgcccagctgctgatggagcaggtggcagctgagggcagcgggcccctcctgtacctactctaccagcatttgctcttcaactttcacctctggaccctcagtgacttcgccgtgcgcctcggtcacatccagtacatgtccagcatagttcgggagcacagacagaagctgcggaagaagtacggcgtccagtttatcttggatgctctgcgcacccactacagcccgcagcgggagcgccccctggctgctgacgacctacgcaccgtgcagacctccctcctgggcctggcgagggagttcctggtgcggagtctctcagcagatgacgtgcaggtcacgcagaccatgctgagctttttggcggccacaggcgatgacggtcaggcggtgggtgcgctggacctgctgctggccctgctgcacggttccctggtgcaggagtccttggctgtctttctgttggagccagggaacctcgaagtgctactggccctgctagtgcggccagggtcactgcccctgctgcccgatcgagtctgcaagatcctgcgcagactgcagcagaatgagcggctacctgagcggagccgccagcgcctccggctgcgggagtgtggtctccagggtctggttgcctgcttgcctgaggggactgtttccccccagctctgccagggcctctacaagctgttcctgggggcagattgcctgaacctctcagatctgctggctgtggtacagctgtccctccaggctgacctcagcgttcgcctagacatctgtcgccagcttttccacctcatctacggacagccagatgtagtgcggcttctggcccgacaggctggctggcaagatgtgctgacccggctatatgtcctggaggctgccacagccggcagcccccctccgtcttccccagagtcacctacctcccccaagccagccccacccaagccacccactgagtcacctgctgagccttcagatgtcttcctgccctcagaggccccctgccctgaccctgatggcttttaccatgctctctccccattctgcacgccctttgacctgggcctggaacggtctagtgtaggatcaggcaacactgctggtggtggcggcagcagtgggactcttactccagccagccagcccggcactccttcgccactggatgggccgcggccctttcctgctgctcctggccgccacagctccagtctctccaatgtgctggaggacggcagcctcccggagcccaccattagcggggatgatacctcgaacaccagcaacccacagcaaacctctgaggaagagttgtgcaatctgctcaccaacgtgctgttctcggtgacgtggcgtggcgtggaaggcagcgatgaggctgcctggcgggagcgtggccaggttttctcagtgctcacccagctgggggcctcagccacacttgtgcgcccaccagactgcatcaagcgcagcctcctggagatgatgctggagtcagccctgaccgacatcaaagaggcccccgtgggggtcctggccagcctcacccagcaagcgctttggctgctgcgtctgctgcaggacttcctgtgtgctgaaggccatggtaaccaggaactgtggagtgagaagctctttgaaggtgtatgcagcctacttgatcgcctgggagcctggccccacctggccaacggcacagctgatctccgtgagatggcgcagattggcctacggcttgtacttggctacatcctgctggaagacccacagctgcatgcccaggcctacgtgagattgcacatgctgctacagactgcagtgccagcccgccgcgaggaggcctgctatgtgctctccaagctggaggctgcactggggcgggtgctgaacacctcttccttggagtcagccactgatgaggcagggtccccacttgcagctgcagcagctgcagcagctgcagagcgctgctcctggctggtgccactggtgcgcacgctgctagaccgtgcctatgagccgctggggctgcagtggggactgccctccctgccacccaccaatggcagccccaccttctttgaagacttccaggctttttgtgccacacccgaatggcgccacttcatcgacaaacaggtacagccaaccatgtcccagttcgaaatggacacgtatgctaagagccacgaccttatgtcaggtttctggaatgcctgctatgacatgcttatgagcagtgggcagcggcgccagtgggagcgcgcccagagtcgtcgggccttccaggagctggtgctggaacctgcgcagaggcgggcgcgcctggaggggctacgctacacggcagtgctgaagcagcaggcaacgcagcactccatggccctgctgcactggggggcgctgtggcgccagctcgccagcccatgtggggcctgggcgctgagggacactcccatcccccgctggaaactgtccagcgccgagacatattcacgcatgcgtctgaagctggtgcccaaccatcacttcgaccctcacctggaagccagcgctctccgagacaatctgggtgaggttcccctgacacccaccgaggaggcctcactgcctctggcagtgaccaaagaggccaaagtgagcaccccacccgagttgctgcaggaggaccagctcggcgaggacgagctggctgagctggagaccccgatggaggcagcagaactggatgagcagcgtgagaagctggtgctgtcggccgagtgccagctggtgacggtagtggccgtggtcccagggctgctggaggtcaccacacagaatgtatacttctacgatggcagcactgagcgcgtggaaaccgaggagggcatcggctatgatttccggcgcccactggcccagctgcgtgaggtccacctgcggcgtttcaacctgcgccgttcagcacttgagctcttctttatcgatcaggccaactacttcctcaacttcccatgcaaggtgggcacgaccccagtctcatctcctagccagactcccagaccccagcctggccccatcccaccccatacccaggtacggaaccaggtgtactcgtggctcctgcgcctacggcccccctctcaaggctacctaagcagccgctccccccaggagatgctgcgtgcctcaggccttacccagaaatgggtacagcgtgagatatccaacttcgagtacttgatgcaactcaacaccattgcggggcggacctacaatgacctgtctcagtaccctgtgttcccctgggtcctgcaggactacgtgtccccaaccctggacctcagcaacccagccgtcttccgggacctgtctaagcccatcggtgtggtgaaccccaagcatgcccagctcgtgagggagaagtatgaaagctttgaggacccagcagggaccattgacaagttccactatggcacccactactccaatgcagcaggcgtgatgcactacctcatccgcgtggagcccttcacctccctgcacgtccagctgcaaagtggccgctttgactgctccgaccggcagttccactcggtggcggcagcctggcaggcacgcctggagagccctgccgatgtgaaggagctcatcccggaattcttctactttcctgacttcctggagaaccagaacggttttgacctgggctgtctccagctgaccaacgagaaggtaggcgatgtggtgctacccccgtgggccagctctcctgaggacttcatccagcagcaccgccaggctctggagtcggagtatgtgtctgcacacctacacgagtggatcgacctcatctttggctacaagcagcgggggccagccgccgaggaggccctcaatgtcttctattactgcacctatgagggggctgtagacctggaccatgtgacagatgagcgggaacggaaggctctggagggcattatcagcaactttgggcagactccctgtcagctgctgaaggagccacatccaactcggctctcagctgaggaagcagcccatcgccttgcacgcctggacactaactcacctagcatcttccagcacctggacgaactcaaggcattcttcgcagaggtgactgtgagtgccagtgggctgctgggcacccacagctggttgccctatgaccgcaacataagcaactacttcagcttcagcaaagaccccaccatgggcagccacaagacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgttgagccagctcagctgccaccttgatgtagtaacctgccttgcactggacacctgtggcatctacctcatctcaggctcccgggacaccacgtgcatggtgtggcggctcctgcatcagggtggtctgtcagtaggcctggcaccaaagcctgtgcaggtcctgtatgggcatggggctgcagtgagctgtgtggccatcagcactgaacttgacatggctgtgtctggatctgaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgtagctgc

SEQ ID NO: 27059 - DNA, 6129 bp, Homo sapiens
  misc_feature (17)..(17): n is a, c, g, or t
ctcggctctaccttgtntcacagagtggagactgggatgaaggatgtggtgaactgcgttgggggtatgggtgccctgctgcccctgctggagcgagtagctgcacagcccaaagaggctgaagcaggtccagctgaaacgcatgacctcgtgggtcctgaactgacctctggtcacaacacccagggcctggttctcccattgggtaaatcttcagaggaacggatggagaggaacgcagtggctgcttttctgctgatgctgcggaacttccttcagggtcacatggtgaaccaagagagcctggtgcagtgccaggggcctgccatcatcggggccctcctgcgaaaggtcccaagctgggccatggacatgaacgtgctcatgtccgcccagctgctgatggagcaggtggcagctgagggcagcgggcccctcctgtacctactctaccagcatttgctcttcaactttcacctctggaccctcagtgacttcgccgtgcgcctcggtcacatccagtacatgtccagcatagttcgggagcacagacagaagctgcggaagaagtacggcgtccagtttatcttggatgctctgcgcacccactacagcccgcagcgggagcgccccctggctgctgacgacctacgcaccgtgcagacctccctcctgggcctggcgagggagttcctggtgcggagtctctcagcagatgacgtgcaggtcacgcagaccatgctgagctttttggcggccacaggcgatgacggtcaggcggtgggtgcgctggacctgctgctggccctgctgcacggttccctggtgcaggagtccttggctgtctttctgttggagccagggaacctcgaagtgctactggccctgctagtgcggccagggtcactgcccctgctgcccgatcgagtctgcaagatcctgcgcagactgcagcagaatgagcggctacctgagcggagccgccagcgcctccggctgcgggagtgtggtctccagggtctggttgcctgcttgcctgaggggactgtttccccccagctctgccagggcctctacaagctgttcctgggggcagattgcctgaacctctcagatctgctggctgtggtacagctgtccctccaggctgacctcagcgttcgcctagacatctgtcgccagcttttccacctcatctacggacagccagatgtagtgcggcttctggcccgacaggctggctggcaagatgtgctgacccggctatatgtcctggaggctgccacagccggcagcccccctccgtcttccccagagtcacctacctcccccaagccagccccacccaagccacccactgagtcacctgctgagccttcagatgtcttcctgccctcagaggccccctgccctgaccctgatggcttttaccatgctctctccccattctgcacgccctttgacctgggcctggaacggtctagtgtaggatcaggcaacactgctggtggtggcggcagcagtgggactcttactccagccagccagcccggcactccttcgccactggatgggccgcggccctttcctgctgctcctggccgccacagctccagtctctccaatgtgctggaggacggcagcctcccggagcccaccattagcggggatgatacctcgaacaccagcaacccacagcaaacctctgaggaagagttgtgcaatctgctcaccaacgtgctgttctcggtgacgtggcgtggcgtggaaggcagcgatgaggctgcctggcgggagcgtggccaggttttctcagtgctcacccagctgggggcctcagccacacttgtgcgcccaccagactgcatcaagcgcagcctcctggagatgatgctggagtcagccctgaccgacatcaaagaggcccccgtgggggtcctggccagcctcacccagcaagcgctttggctgctgcgtctgctgcaggacttcctgtgtgctgaaggccatggtaaccaggaactgtggagtgagaagctctttgaaggtgtatgcagcctacttgatcgcctgggagcctggccccacctggccaacggcacagctgatctccgtgagatggcgcagattggcctacggcttgtacttggctacatcctgctggaagacccacagctgcatgcccaggcctacgtgagattgcacatgctgctacagactgcagtgccagcccgccgcgaggaggcctgctatgtgctctccaagctggaggctgcactggggcgggtgctgaacacctcttccttggagtcagccactgatgaggcagggtccccacttgcagctgcagcagctgcagcagctgcagagcgctgctcctggctggtgccactggtgcgcacgctgctagaccgtgcctatgagccgctggggctgcagtggggactgccctccctgccacccaccaatggcagccccaccttctttgaagacttccaggctttttgtgccacacccgaatggcgccacttcatcgacaaacaggtacagccaaccatgtcccagttcgaaatggacacgtatgctaagagccacgaccttatgtcaggtttctggaatgcctgctatgacatgcttatgagcagtgggcagcggcgccagtgggagcgcgcccagagtcgtcgggccttccaggagctggtgctggaacctgcgcagaggcgggcgcgcctggaggggctacgctacacggcagtgctgaagcagcaggcaacgcagcactccatggccctgctgcactggggggcgctgtggcgccagctcgccagcccatgtggggcctgggcgctgagggacactcccatcccccgctggaaactgtccagcgccgagacatattcacgcatgcgtctgaagctggtgcccaaccatcacttcgaccctcacctggaagccagcgctctccgagacaatctgggtgaggttcccctgacacccaccgaggaggcctcactgcctctggcagtgaccaaagaggccaaagtgagcaccccacccgagttgctgcaggaggaccagctcggcgaggacgagctggctgagctggagaccccgatggaggcagcagaactggatgagcagcgtgagaagctggtgctgtcggccgagtgccagctggtgacggtagtggccgtggtcccagggctgctggaggtcaccacacagaatgtatacttctacgatggcagcactgagcgcgtggaaaccgaggagggcatcggctatgatttccggcgcccactggcccagctgcgtgaggtccacctgcggcgtttcaacctgcgccgttcagcacttgagctcttctttatcgatcaggccaactacttcctcaacttcccatgcaaggtgggcacgaccccagtctcatctcctagccagactcccagaccccagcctggccccatcccaccccatacccaggtacggaaccaggtgtactcgtggctcctgcgcctacggcccccctctcaaggctacctaagcagccgctccccccaggagatgctgcgtgcctcaggccttacccagaaatgggtacagcgtgagatatccaacttcgagtacttgatgcaactcaacaccattgcggggcggacctacaatgacctgtctcagtaccctgtgttcccctgggtcctgcaggactacgtgtccccaaccctggacctcagcaacccagccgtcttccgggacctgtctaagcccatcggtgtggtgaaccccaagcatgcccagctcgtgagggagaagtatgaaagctttgaggacccagcagggaccattgacaagttccactatggcacccactactccaatgcagcaggcgtgatgcactacctcatccgcgtggagcccttcacctccctgcacgtccagctgcaaagtggccgctttgactgctccgaccggcagttccactcggtggcggcagcctggcaggcacgcctggagagccctgccgatgtgaaggagctcatcccggaattcttctactttcctgacttcctggagaaccagaacggttttgacctgggctgtctccagctgaccaacgagaaggtaggcgatgtggtgctacccccgtgggccagctctcctgaggacttcatccagcagcaccgccaggctctggagtcggagtatgtgtctgcacacctacacgagtggatcgacctcatctttggctacaagcagcgggggccagccgccgaggaggccctcaatgtcttctattactgcacctatgagggggctgtagacctggaccatgtgacagatgagcgggaacggaaggctctggagggcattatcagcaactttgggcagactccctgtcagctgctgaaggagccacatccaactcggctctcagctgaggaagcagcccatcgccttgcacgcctggacactaactcacctagcatcttccagcacctggacgaactcaaggcattcttcgcagaggttgtcagtgatggtgtacccctggtgctagccctggtcccccaccggcagccccactccttcatcacccagggttccccagacctgttggtaagtgcattgtgcagagccccagctcagctccactcccccttgcctctgccagaaacccacctctgccccctcctgcctgcaggtgactgtgagtgccagtgggctgctgggcacccacagctggttgccctatgaccgcaacataagcaactacttcagcttcagcaaagaccccaccatgggcagccacaagacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgttgagccagctcagctgccaccttgatgtagtaacctgccttgcactggacacctgtggcatctacctcatctcaggctcccgggacaccacgtgcatggtgtggcggctcctgcatcagggtggtctgtcagtaggcctggcaccaaagcctgtgcaggtcctgtatgggcatggggctgcagtgagctgtgtggccatcagcactgaacttgacatggctgtgtctggatctgaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgtagctgc

SEQ ID NO: 27060 - DNA, 6303 bp, Homo sapiens
  misc_feature (17)..(17): n is a, c, g, or t
ctcggctctaccttgtntcacagagtggagactgggatgaaggatgtggtgaactgcgttgggggtatgggtgccctgctgcccctgctggagcgagtagctgcacagcccaaagaggctgaagcaggtccagctgaaacgcatgacctcgtgggtcctgaactgacctctggtcacaacacccagggcctggttctcccattgggtaaatcttcagaggaacggatggagaggaacgcagtggctgcttttctgctgatgctgcggaacttccttcagggtcacatggtgaaccaagagagcctggtgcagtgccaggggcctgccatcatcggggccctcctgcgaaaggtcccaagctgggccatggacatgaacgtgctcatgtccgcccagctgctgatggagcaggtggcagctgagggcagcgggcccctcctgtacctactctaccagcatttgctcttcaactttcacctctggaccctcagtgacttcgccgtgcgcctcggtcacatccagtacatgtccagcatagttcgggagcacagacagaagctgcggaagaagtacggcgtccagtttatcttggatgctctgcgcacccactacagcccgcagcgggagcgccccctggctgctgacgacctacgcaccgtgcagacctccctcctgggcctggcgagggagttcctggtgcggagtctctcagcagatgacgtgcaggtcacgcagaccatgctgagctttttggcggccacaggcgatgacggtcaggcggtgggtgcgctggacctgctgctggccctgctgcacggttccctggtgcaggagtccttggctgtctttctgttggagccagggaacctcgaagtgctactggccctgctagtgcggccagggtcactgcccctgctgcccgatcgagtctgcaagatcctgcgcagactgcagcagaatgagcggctacctgagcggagccgccagcgcctccggctgcgggagtgtggtctccagggtctggttgcctgcttgcctgaggggactgtttccccccagctctgccagggcctctacaagctgttcctgggggcagattgcctgaacctctcagatctgctggctgtggtacagctgtccctccaggctgacctcagcgttcgcctagacatctgtcgccagcttttccacctcatctacggacagccagatgtagtgcggcttctggcccgacaggctggctggcaagatgtgctgacccggctatatgtcctggaggctgccacagccggcagcccccctccgtcttccccagagtcacctacctcccccaagccagccccacccaagccacccactgagtcacctgctgagccttcagatgtcttcctgccctcagaggccccctgccctgaccctgatggcttttaccatgctctctccccattctgcacgccctttgacctgggcctggaacggtctagtgtaggatcaggcaacactgctggtggtggcggcagcagtgggactcttactccagccagccagcccggcactccttcgccactggatgggccgcggccctttcctgctgctcctggccgccacagctccagtctctccaatgtgctggaggacggcagcctcccggagcccaccattagcggggatgatacctcgaacaccagcaacccacagcaaacctctgaggaagagttgtgcaatctgctcaccaacgtgctgttctcggtgacgtggcgtggcgtggaaggcagcgatgaggctgcctggcgggagcgtggccaggttttctcagtgctcacccagctgggggcctcagccacacttgtgcgcccaccagactgcatcaagcgcagcctcctggagatgatgctggagtcagccctgaccgacatcaaagaggcccccgtgggggtcctggccagcctcacccagcaagcgctttggctgctgcgtctgctgcaggacttcctgtgtgctgaaggccatggtaaccaggaactgtggagtgagaagctctttgaaggtgtatgcagcctacttgatcgcctgggagcctggccccacctggccaacggcacagctgatctccgtgagatggcgcagattggcctacggcttgtacttggctacatcctgctggaagacccacagctgcatgcccaggcctacgtgagattgcacatgctgctacagactgcagtgccagcccgccgcgaggaggcctgctatgtgctctccaagctggaggctgcactggggcgggtgctgaacacctcttccttggagtcagccactgatgaggcagggtccccacttgcagctgcagcagctgcagcagctgcagagcgctgctcctggctggtgccactggtgcgcacgctgctagaccgtgcctatgagccgctggggctgcagtggggactgccctccctgccacccaccaatggcagccccaccttctttgaagacttccaggctttttgtgccacacccgaatggcgccacttcatcgacaaacaggtacagccaaccatgtcccagttcgaaatggacacgtatgctaagagccacgaccttatgtcaggtttctggaatgcctgctatgacatgcttatgagcagtgggcagcggcgccagtgggagcgcgcccagagtcgtcgggccttccaggagctggtgctggaacctgcgcagaggcgggcgcgcctggaggggctacgctacacggcagtgctgaagcagcaggcaacgcagcactccatggccctgctgcactggggggcgctgtggcgccagctcgccagcccatgtggggcctgggcgctgagggacactcccatcccccgctggaaactgtccagcgccgagacatattcacgcatgcgtctgaagctggtgcccaaccatcacttcgaccctcacctggaagccagcgctctccgagacaatctgggtgaggttcccctgacacccaccgaggaggcctcactgcctctggcagtgaccaaagaggccaaagtgagcaccccacccgagttgctgcaggaggaccagctcggcgaggacgagctggctgagctggagaccccgatggaggcagcagaactggatgagcagcgtgagaagctggtgctgtcggccgagtgccagctggtgacggtagtggccgtggtcccagggctgctggaggtcaccacacagaatgtatacttctacgatggcagcactgagcgcgtggaaaccgaggagggcatcggctatgatttccggcgcccactggcccagctgcgtgaggtccacctgcggcgtttcaacctgcgccgttcagcacttgagctcttctttatcgatcaggccaactacttcctcaacttcccatgcaaggtgggcacgaccccagtctcatctcctagccagactcccagaccccagcctggccccatcccaccccatacccaggtacggaaccaggtgtactcgtggctcctgcgcctacggcccccctctcaaggctacctaagcagccgctccccccaggagatgctgcgtgcctcaggccttacccagaaatgggtacagcgtgagatatccaacttcgagtacttgatgcaactcaacaccattgcggggcggacctacaatgacctgtctcagtaccctgtgttcccctgggtcctgcaggactacgtgtccccaaccctggacctcagcaacccagccgtcttccgggacctgtctaagcccatcggtgtggtgaaccccaagcatgcccagctcgtgagggagaagtatgaaagctttgaggacccagcagggaccattgacaagttccactatggcacccactactccaatgcagcaggcgtgatgcactacctcatccgcgtggagcccttcacctccctgcacgtccagctgcaaagtggccgctttgactgctccgaccggcagttccactcggtggcggcagcctggcaggcacgcctggagagccctgccgatgtgaaggagctcatcccggaattcttctactttcctgacttcctggagaaccagaacggttttgacctgggctgtctccagctgaccaacgagaaggtaggcgatgtggtgctacccccgtgggccagctctcctgaggacttcatccagcagcaccgccaggctctggagtcggagtatgtgtctgcacacctacacgagtggatcgacctcatctttggctacaagcagcgggggccagccgccgaggaggccctcaatgtcttctattactgcacctatgagggggctgtagacctggaccatgtgacagatgagcgggaacggaaggctctggagggcattatcagcaactttgggcagactccctgtcagctgctgaaggagccacatccaactcggctctcagctgaggaagcagcccatcgccttgcacgcctggacactaactcacctagcatcttccagcacctggacgaactcaaggcattcttcgcagaggttgtcagtgatggtgtacccctggtgctagccctggtcccccaccggcagccccactccttcatcacccagggttccccagacctgttggtaagtgcattgtgcagagccccagctcagctccactcccccttgcctctgccagaaacccacctctgccccctcctgcctgcaggtgactgtgagtgccagtgggctgctgggcacccacagctggttgccctatgaccgcaacataagcaactacttcagcttcagcaaagaccccaccatgggcagccacaagtaggacagagggctgtgggtggggtgggctacaaatgccctgcacccggaattattcccctccctaatcagaatgtaggccagctgcaggggaaaggtctggccaggctccctgagggcctgggtctcttccatgtggcctggcctcacttgctatccccctcactgggtcaggacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgttgagccagctcagctgccaccttgatgtagtaacctgccttgcactggacacctgtggcatctacctcatctcaggctcccgggacaccacgtgcatggtgtggcggctcctgcatcagggtggtctgtcagtaggcctggcaccaaagcctgtgcaggtcctgtatgggcatggggctgcagtgagctgtgtggccatcagcactgaacttgacatggctgtgtctggatctgaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgtagctgc

SEQ ID NO: 27061 - DNA, 6203 bp, Homo sapiens
  misc_feature (17)..(17): n is a, c, g, or t
ctcggctctaccttgtntcacagagtggagactgggatgaaggatgtggtgaactgcgttgggggtatgggtgccctgctgcccctgctggagcgagtagctgcacagcccaaagaggctgaagcaggtccagctgaaacgcatgacctcgtgggtcctgaactgacctctggtcacaacacccagggcctggttctcccattgggtaaatcttcagaggaacggatggagaggaacgcagtggctgcttttctgctgatgctgcggaacttccttcagggtcacatggtgaaccaagagagcctggtgcagtgccaggggcctgccatcatcggggccctcctgcgaaaggtcccaagctgggccatggacatgaacgtgctcatgtccgcccagctgctgatggagcaggtggcagctgagggcagcgggcccctcctgtacctactctaccagcatttgctcttcaactttcacctctggaccctcagtgacttcgccgtgcgcctcggtcacatccagtacatgtccagcatagttcgggagcacagacagaagctgcggaagaagtacggcgtccagtttatcttggatgctctgcgcacccactacagcccgcagcgggagcgccccctggctgctgacgacctacgcaccgtgcagacctccctcctgggcctggcgagggagttcctggtgcggagtctctcagcagatgacgtgcaggtcacgcagaccatgctgagctttttggcggccacaggcgatgacggtcaggcggtgggtgcgctggacctgctgctggccctgctgcacggttccctggtgcaggagtccttggctgtctttctgttggagccagggaacctcgaagtgctactggccctgctagtgcggccagggtcactgcccctgctgcccgatcgagtctgcaagatcctgcgcagactgcagcagaatgagcggctacctgagcggagccgccagcgcctccggctgcgggagtgtggtctccagggtctggttgcctgcttgcctgaggggactgtttccccccagctctgccagggcctctacaagctgttcctgggggcagattgcctgaacctctcagatctgctggctgtggtacagctgtccctccaggctgacctcagcgttcgcctagacatctgtcgccagcttttccacctcatctacggacagccagatgtagtgcggcttctggcccgacaggctggctggcaagatgtgctgacccggctatatgtcctggaggctgccacagccggcagcccccctccgtcttccccagagtcacctacctcccccaagccagccccacccaagccacccactgagtcacctgctgagccttcagatgtcttcctgccctcagaggccccctgccctgaccctgatggcttttaccatgctctctccccattctgcacgccctttgacctgggcctggaacggtctagtgtaggatcaggcaacactgctggtggtggcggcagcagtgggactcttactccagccagccagcccggcactccttcgccactggatgggccgcggccctttcctgctgctcctggccgccacagctccagtctctccaatgtgctggaggacggcagcctcccggagcccaccattagcggggatgatacctcgaacaccagcaacccacagcaaacctctgaggaagagttgtgcaatctgctcaccaacgtgctgttctcggtgacgtggcgtggcgtggaaggcagcgatgaggctgcctggcgggagcgtggccaggttttctcagtgctcacccagctgggggcctcagccacacttgtgcgcccaccagactgcatcaagcgcagcctcctggagatgatgctggagtcagccctgaccgacatcaaagaggcccccgtgggggtcctggccagcctcacccagcaagcgctttggctgctgcgtctgctgcaggacttcctgtgtgctgaaggccatggtaaccaggaactgtggagtgagaagctctttgaaggtgtatgcagcctacttgatcgcctgggagcctggccccacctggccaacggcacagctgatctccgtgagatggcgcagattggcctacggcttgtacttggctacatcctgctggaagacccacagctgcatgcccaggcctacgtgagattgcacatgctgctacagactgcagtgccagcccgccgcgaggaggcctgctatgtgctctccaagctggaggctgcactggggcgggtgctgaacacctcttccttggagtcagccactgatgaggcagggtccccacttgcagctgcagcagctgcagcagctgcagagcgctgctcctggctggtgccactggtgcgcacgctgctagaccgtgcctatgagccgctggggctgcagtggggactgccctccctgccacccaccaatggcagccccaccttctttgaagacttccaggctttttgtgccacacccgaatggcgccacttcatcgacaaacaggtacagccaaccatgtcccagttcgaaatggacacgtatgctaagagccacgaccttatgtcaggtttctggaatgcctgctatgacatgcttatgagcagtgggcagcggcgccagtgggagcgcgcccagagtcgtcgggccttccaggagctggtgctggaacctgcgcagaggcgggcgcgcctggaggggctacgctacacggcagtgctgaagcagcaggcaacgcagcactccatggccctgctgcactggggggcgctgtggcgccagctcgccagcccatgtggggcctgggcgctgagggacactcccatcccccgctggaaactgtccagcgccgagacatattcacgcatgcgtctgaagctggtgcccaaccatcacttcgaccctcacctggaagccagcgctctccgagacaatctgggtgaggttcccctgacacccaccgaggaggcctcactgcctctggcagtgaccaaagaggccaaagtgagcaccccacccgagttgctgcaggaggaccagctcggcgaggacgagctggctgagctggagaccccgatggaggcagcagaactggatgagcagcgtgagaagctggtgctgtcggccgagtgccagctggtgacggtagtggccgtggtcccagggctgctggaggtcaccacacagaatgtatacttctacgatggcagcactgagcgcgtggaaaccgaggagggcatcggctatgatttccggcgcccactggcccagctgcgtgaggtccacctgcggcgtttcaacctgcgccgttcagcacttgagctcttctttatcgatcaggccaactacttcctcaacttcccatgcaaggtgggcacgaccccagtctcatctcctagccagactcccagaccccagcctggccccatcccaccccatacccaggtacggaaccaggtgtactcgtggctcctgcgcctacggcccccctctcaaggctacctaagcagccgctccccccaggagatgctgcgtgcctcaggccttacccagaaatgggtacagcgtgagatatccaacttcgagtacttgatgcaactcaacaccattgcggggcggacctacaatgacctgtctcagtaccctgtgttcccctgggtcctgcaggactacgtgtccccaaccctggacctcagcaacccagccgtcttccgggacctgtctaagcccatcggtgtggtgaaccccaagcatgcccagctcgtgagggagaagtatgaaagctttgaggacccagcagggaccattgacaagttccactatggcacccactactccaatgcagcaggcgtgatgcactacctcatccgcgtggagcccttcacctccctgcacgtccagctgcaaagtggccgctttgactgctccgaccggcagttccactcggtggcggcagcctggcaggcacgcctggagagccctgccgatgtgaaggagctcatcccggaattcttctactttcctgacttcctggagaaccagaacggttttgacctgggctgtctccagctgaccaacgagaaggtaggcgatgtggtgctacccccgtgggccagctctcctgaggacttcatccagcagcaccgccaggctctggagtcggagtatgtgtctgcacacctacacgagtggatcgacctcatctttggctacaagcagcgggggccagccgccgaggaggccctcaatgtcttctattactgcacctatgagggggctgtagacctggaccatgtgacagatgagcgggaacggaaggctctggagggcattatcagcaactttgggcagactccctgtcagctgctgaaggagccacatccaactcggctctcagctgaggaagcagcccatcgccttgcacgcctggacactaactcacctagcatcttccagcacctggacgaactcaaggcattcttcgcagaggttgtcagtgatggtgtacccctggtgctagccctggtcccccaccggcagccccactccttcatcacccagggttccccagacctgttggtgactgtgagtgccagtgggctgctgggcacccacagctggttgccctatgaccgcaacataagcaactacttcagcttcagcaaagaccccaccatgggcagccacaagacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgttgagccagctcagctgccaccttgatgtagtaacctgccttgcactggacacctgtggcatctacctcatctcaggctcccgggacaccacgtgcatggtgtggcggctcctgcatcaggtgtgcctcgtgggcagctctgtggggcccccgtagcccagacctgcagcccatccgtccctcagtggccttccagtcctgtcctcctctagtcttggacaaggccttcatttcctgagcctcaggggacagtcctaagccaaccctggtcctccacagggtggtctgtcagtaggcctggcaccaaagcctgtgcaggtcctgtatgggcatggggctgcagtgagctgtgtggccatcagcactgaacttgacatggctgtgtctggatctgaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgtagctgc

SEQ ID NO: 27062 - DNA, 6140 bp, Homo sapiens
  misc_feature (17)..(17): n is a, c, g, or t
ctcggctctaccttgtntcacagagtggagactgggatgaaggatgtggtgaactgcgttgggggtatgggtgccctgctgcccctgctggagcgagtagctgcacagcccaaagaggctgaagcaggtccagctgaaacgcatgacctcgtgggtcctgaactgacctctggtcacaacacccagggcctggttctcccattgggtaaatcttcagaggaacggatggagaggaacgcagtggctgcttttctgctgatgctgcggaacttccttcagggtcacatggtgaaccaagagagcctggtgcagtgccaggggcctgccatcatcggggccctcctgcgaaaggtcccaagctgggccatggacatgaacgtgctcatgtccgcccagctgctgatggagcaggtggcagctgagggcagcgggcccctcctgtacctactctaccagcatttgctcttcaactttcacctctggaccctcagtgacttcgccgtgcgcctcggtcacatccagtacatgtccagcatagttcgggagcacagacagaagctgcggaagaagtacggcgtccagtttatcttggatgctctgcgcacccactacagcccgcagcgggagcgccccctggctgctgacgacctacgcaccgtgcagacctccctcctgggcctggcgagggagttcctggtgcggagtctctcagcagatgacgtgcaggtcacgcagaccatgctgagctttttggcggccacaggcgatgacggtcaggcggtgggtgcgctggacctgctgctggccctgctgcacggttccctggtgcaggagtccttggctgtctttctgttggagccagggaacctcgaagtgctactggccctgctagtgcggccagggtcactgcccctgctgcccgatcgagtctgcaagatcctgcgcagactgcagcagaatgagcggctacctgagcggagccgccagcgcctccggctgcgggagtgtggtctccagggtctggttgcctgcttgcctgaggggactgtttccccccagctctgccagggcctctacaagctgttcctgggggcagattgcctgaacctctcagatctgctggctgtggtacagctgtccctccaggctgacctcagcgttcgcctagacatctgtcgccagcttttccacctcatctacggacagccagatgtagtgcggcttctggcccgacaggctggctggcaagatgtgctgacccggctatatgtcctggaggctgccacagccggcagcccccctccgtcttccccagagtcacctacctcccccaagccagccccacccaagccacccactgagtcacctgctgagccttcagatgtcttcctgccctcagaggccccctgccctgaccctgatggcttttaccatgctctctccccattctgcacgccctttgacctgggcctggaacggtctagtgtaggatcaggcaacactgctggtggtggcggcagcagtgggactcttactccagccagccagcccggcactccttcgccactggatgggccgcggccctttcctgctgctcctggccgccacagctccagtctctccaatgtgctggaggacggcagcctcccggagcccaccattagcggggatgatacctcgaacaccagcaacccacagcaaacctctgaggaagagttgtgcaatctgctcaccaacgtgctgttctcggtgacgtggcgtggcgtggaaggcagcgatgaggctgcctggcgggagcgtggccaggttttctcagtgctcacccagctgggggcctcagccacacttgtgcgcccaccagactgcatcaagcgcagcctcctggagatgatgctggagtcagccctgaccgacatcaaagaggcccccgtgggggtcctggccagcctcacccagcaagcgctttggctgctgcgtctgctgcaggacttcctgtgtgctgaaggccatggtaaccaggaactgtggagtgagaagctctttgaaggtgtatgcagcctacttgatcgcctgggagcctggccccacctggccaacggcacagctgatctccgtgagatggcgcagattggcctacggcttgtacttggctacatcctgctggaagacccacagctgcatgcccaggcctacgtgagattgcacatgctgctacagactgcagtgccagcccgccgcgaggaggcctgctatgtgctctccaagctggaggctgcactggggcgggtgctgaacacctcttccttggagtcagccactgatgaggcagggtccccacttgcagctgcagcagctgcagcagctgcagagcgctgctcctggctggtgccactggtgcgcacgctgctagaccgtgcctatgagccgctggggctgcagtggggactgccctccctgccacccaccaatggcagccccaccttctttgaagacttccaggctttttgtgccacacccgaatggcgccacttcatcgacaaacaggtacagccaaccatgtcccagttcgaaatggacacgtatgctaagagccacgaccttatgtcaggtttctggaatgcctgctatgacatgcttatgagcagtgggcagcggcgccagtgggagcgcgcccagagtcgtcgggccttccaggagctggtgctggaacctgcgcagaggcgggcgcgcctggaggggctacgctacacggcagtgctgaagcagcaggcaacgcagcactccatggccctgctgcactggggggcgctgtggcgccagctcgccagcccatgtggggcctgggcgctgagggacactcccatcccccgctggaaactgtccagcgccgagacatattcacgcatgcgtctgaagctggtgcccaaccatcacttcgaccctcacctggaagccagcgctctccgagacaatctgggtgaggttcccctgacacccaccgaggaggcctcactgcctctggcagtgaccaaagaggccaaagtgagcaccccacccgagttgctgcaggaggaccagctcggcgaggacgagctggctgagctggagaccccgatggaggcagcagaactggatgagcagcgtgagaagctggtgctgtcggccgagtgccagctggtgacggtagtggccgtggtcccagggctgctggaggtcaccacacagaatgtatacttctacgatggcagcactgagcgcgtggaaaccgaggagggcatcggctatgatttccggcgcccactggcccagctgcgtgaggtccacctgcggcgtttcaacctgcgccgttcagcacttgagctcttctttatcgatcaggccaactacttcctcaacttcccatgcaaggtgggcacgaccccagtctcatctcctagccagactcccagaccccagcctggccccatcccaccccatacccaggtacggaaccaggtgtactcgtggctcctgcgcctacggcccccctctcaaggctacctaagcagccgctccccccaggagatgctgcgtgcctcaggccttacccagaaatgggtacagcgtgagatatccaacttcgagtacttgatgcaactcaacaccattgcggggcggacctacaatgacctgtctcagtaccctgtgttcccctgggtcctgcaggactacgtgtccccaaccctggacctcagcaacccagccgtcttccgggacctgtctaagcccatcggtgtggtgaaccccaagcatgcccagctcgtgagggagaagtatgaaagctttgaggacccagcagggaccattgacaagttccactatggcacccactactccaatgcagcaggcgtgatgcactacctcatccgcgtggagcccttcacctccctgcacgtccagctgcaaagtggccgctttgactgctccgaccggcagttccactcggtggcggcagcctggcaggcacgcctggagagccctgccgatgtgaaggagctcatcccggaattcttctactttcctgacttcctggagaaccagaacggttttgacctgggctgtctccagctgaccaacgagaaggtaggcgatgtggtgctacccccgtgggccagctctcctgaggacttcatccagcagcaccgccaggctctggagtcggagtatgtgtctgcacacctacacgagtggatcgacctcatctttggctacaagcagcgggggccagccgccgaggaggccctcaatgtcttctattactgcacctatgagggggctgtagacctggaccatgtgacagatgagcgggaacggaaggctctggagggcattatcagcaactttgggcagactccctgtcagctgctgaaggagccacatccaactcggctctcagctgaggaagcagcccatcgccttgcacgcctggacactaactcacctagcatcttccagcacctggacgaactcaaggcattcttcgcagaggttgtcagtgatggtgtacccctggtgctagccctggtcccccaccggcagccccactccttcatcacccagggttccccagacctgttggtgactgtgagtgccagtgggctgctgggcacccacagctggttgccctatgaccgcaacataagcaactacttcagcttcagcaaagaccccaccatgggcagccacaagacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgttgagccagctcagctgccaccttgatgtagtaacctgccttgcactggacacctgtggcatctacctcatctcaggctcccgggacaccacgtgcatggtgtggcggctcctgcatcagggtggtctgtcagtaggcctggcaccaaagcctgtgcaggtcctgtatgggcatggggctgcagtgagctgtgtggccatcagcactgaacttgacatggctgtgtctggatctgaggtgtgtgtatgcatgtgccctggggagggtgagtttcctgggcaatccccctggagcccagactcctgcccaggaccctaagttgccttcctgcaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgtagctgc

SEQ ID NO: 27063 - DNA, 5927 bp, Homo sapiens
  misc_feature (17)..(17): n is a, c, g, or t
ctcggctctaccttgtntcacagagtggagactgggatgaaggatgtggtgaactgcgttgggggtatgggtgccctgctgcccctgctggagcgagtagctgcacagcccaaagaggctgaagcaggtccagctgaaacgcatgacctcgtgggtcctgaactgacctctggtcacaacacccagggcctggttctcccattgggtaaatcttcagaggaacggatggagaggaacgcagtggctgcttttctgctgatgctgcggaacttccttcagggtcacatggtgaaccaagagagcctggtgcagtgccaggggcctgccatcatcggggccctcctgcgaaaggtcccaagctgggccatggacatgaacgtgctcatgtccgcccagctgctgatggagcaggtggcagctgagggcagcgggcccctcctgtacctactctaccagcatttgctcttcaactttcacctctggaccctcagtgacttcgccgtgcgcctcggtcacatccagtacatgtccagcatagttcgggagcacagacagaagctgcggaagaagtacggcgtccagtttatcttggatgctctgcgcacccactacagcccgcagcgggagcgccccctggctgctgacgacctacgcaccgtgcagacctccctcctgggcctggcgagggagttcctggtgcggagtctctcagcagatgacgtgcaggtcacgcagaccatgctgagctttttggcggccacaggcgatgacggtcaggcggtgggtgcgctggacctgctgctggccctgctgcacggttccctggtgcaggagtccttggctgtctttctgttggagccagggaacctcgaagtgctactggccctgctagtgcggccagggtcactgcccctgctgcccgatcgagtctgcaagatcctgcgcagactgcagcagaatgagcggctacctgagcggagccgccagcgcctccggctgcgggagtgtggtctccagggtctggttgcctgcttgcctgaggggactgtttccccccagctctgccagggcctctacaagctgttcctgggggcagattgcctgaacctctcagatctgctggctgtggtacagctgtccctccaggctgacctcagcgttcgcctagacatctgtcgccagcttttccacctcatctacggacagccagatgtagtgcggcttctggcccgacaggctggctggcaagatgtgctgacccggctatatgtcctggaggctgccacagccggcagcccccctccgtcttccccagagtcacctacctcccccaagccagccccacccaagccacccactgagtcacctgctgagccttcagatgtcttcctgccctcagaggccccctgccctgaccctgatggcttttaccatgctctctccccattctgcacgccctttgacctgggcctggaacggtctagtgtaggatcaggcaacactgctggtggtggcggcagcagtgggactcttactccagccagccagcccggcactccttcgccactggatgggccgcggccctttcctgctgctcctggccgccacagctccagtctctccaatgtgctggaggacggcagcctcccggagcccaccattagcggggatgatacctcgaacaccagcaacccacagcaaacctctgaggaagagttgtgcaatctgctcaccaacgtgctgttctcggtgacgtggcgtggcgtggaaggcagcgatgaggctgcctggcgggagcgtggccaggttttctcagtgctcacccagctgggggcctcagccacacttgtgcgcccaccagactgcatcaagcgcagcctcctggagatgatgctggagtcagccctgaccgacatcaaagaggcccccgtgggggtcctggccagcctcacccagcaagcgctttggctgctgcgtctgctgcaggacttcctgtgtgctgaaggccatggtaaccaggaactgtggagtgagaagctctttgaaggtgtatgcagcctacttgatcgcctgggagcctggccccacctggccaacggcacagctgatctccgtgagatggcgcagattggcctacggcttgtacttggctacatcctgctggaagacccacagctgcatgcccaggcctacgtgagattgcacatgctgctacagactgcagtgccagcccgccgcgaggaggcctgctatgtgctctccaagctggaggctgcactggggcgggtgctgaacacctcttccttggagtcagccactgatgaggcagggtccccacttgcagctgcagcagctgcagcagctgcagagcgctgctcctggctggtgccactggtgcgcacgctgctagaccgtgcctatgagccgctggggctgcagtggggactgccctccctgccacccaccaatggcagccccaccttctttgaagacttccaggctttttgtgccacacccgaatggcgccacttcatcgacaaacaggtacagccaaccatgtcccagttcgaaatggacacgtatgctaagagccacgaccttatgtcaggtttctggaatgcctgctatgacatgcttatgagcagtgggcagcggcgccagtgggagcgcgcccagagtcgtcgggccttccaggagctggtgctggaacctgcgcagaggcgggcgcgcctggaggggctacgctacacggcagtgctgaagcagcaggcaacgcagcactccatggccctgctgcactggggggcgctgtggcgccagctcgccagcccatgtggggcctgggcgctgagggacactcccatcccccgctggaaactgtccagcgccgagacatattcacgcatgcgtctgaagctggtgcccaaccatcacttcgaccctcacctggaagccagcgctctccgagacaatctgggtgaggttcccctgacacccaccgaggaggcctcactgcctctggcagtgaccaaagaggccaaagtgagcaccccacccgagttgctgcaggaggaccagctcggcgaggacgagctggctgagctggagaccccgatggaggcagcagaactggatgagcagcgtgagaagctggtgctgtcggccgagtgccagctggtgacggtagtggccgtggtcccagggctgctggaggtcaccacacagaatgtatacttctacgatggcagcactgagcgcgtggaaaccgaggagggcatcggctatgatttccggcgcccactggcccagctgcgtgaggtccacctgcggcgtttcaacctgcgccgttcagcacttgagctcttctttatcgatcaggccaactacttcctcaacttcccatgcaaggtgggcacgaccccagtctcatctcctagccagactcccagaccccagcctggccccatcccaccccatacccaggtacggaaccaggtgtactcgtggctcctgcgcctacggcccccctctcaaggctacctaagcagccgctccccccaggagatgctgcgtgcctcaggccttacccagaaatgggtacagcgtgagatatccaacttcgagtacttgatgcaactcaacaccattgcggggcggacctacaatgacctgtctcagtaccctgtgttcccctgggtcctgcaggactacgtgtccccaaccctggacctcagcaacccagccgtcttccgggacctgtctaagcccatcggtgtggtgaaccccaagcatgcccagctcgtgagggagaagtatgaaagctttgaggacccagcagggaccattgacaagttccactatggcacccactactccaatgcagcaggcgtgatgcactacctcatccgcgtggagcccttcacctccctgcacgtccagctgcaaagtggccgctttgactgctccgaccggcagttccactcggtggcggcagcctggcaggcacgcctggagagccctgccgatgtgaaggagctcatcccggaattcttctactttcctgacttcctggagaaccagaacggttttgacctgggctgtctccagctgaccaacgagaaggtaggcgatgtggtgctacccccgtgggccagctctcctgaggacttcatccagcagcaccgccaggctctggagtcggagtatgtgtctgcacacctacacgagtggatcgacctcatctttggctacaagcagcgggggccagccgccgaggaggccctcaatgtcttctattactgcacctatgagggggctgtagacctggaccatgtgacagatgagcgggaacggaaggctctggagggcattatcagcaactttgggcagactccctgtcagctgctgaaggagccacatccaactcggctctcagctgaggaagcagcccatcgccttgcacgcctggacactaactcacctagcatcttccagcacctggacgaactcaaggcattcttcgcagaggttgtcagtgatggtgtacccctggtgctagccctggtcccccaccggcagccccactccttcatcacccagggttccccagacctgttggtgactgtgagtgccagtgggctgctgggcacccacagctggttgccctatgaccgcaacataagcaactacttcagcttcagcaaagaccccaccatgggcagccacaagacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgttgagccagctcagctgccaccttgatgtagtaacctgccttgcactggacacctgtggcatctacctcatctcaggctcccgggacaccacgtgcatggtgtggcggctcctgcatcaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgtagctgc

SEQ ID NO: 27064 - DNA, 6218 bp, Homo sapiens
  misc_feature (17)..(17): n is a, c, g, or t
ctcggctctaccttgtntcacagagtggagactgggatgaaggatgtggtgaactgcgttgggggtatgggtgccctgctgcccctgctggagcgagtagctgcacagcccaaagaggctgaagcaggtccagctgaaacgcatgacctcgtgggtcctgaactgacctctggtcacaacacccagggcctggttctcccattgggtaaatcttcagaggaacggatggagaggaacgcagtggctgcttttctgctgatgctgcggaacttccttcagggtcacatggtgaaccaagagagcctggtgcagtgccaggggcctgccatcatcggggccctcctgcgaaaggtcccaagctgggccatggacatgaacgtgctcatgtccgcccagctgctgatggagcaggtggcagctgagggcagcgggcccctcctgtacctactctaccagcatttgctcttcaactttcacctctggaccctcagtgacttcgccgtgcgcctcggtcacatccagtacatgtccagcatagttcgggagcacagacagaagctgcggaagaagtacggcgtccagtttatcttggatgctctgcgcacccactacagcccgcagcgggagcgccccctggctgctgacgacctacgcaccgtgcagacctccctcctgggcctggcgagggagttcctggtgcggagtctctcagcagatgacgtgcaggtcacgcagaccatgctgagctttttggcggccacaggcgatgacggtcaggcggtgggtgcgctggacctgctgctggccctgctgcacggttccctggtgcaggagtccttggctgtctttctgttggagccagggaacctcgaagtgctactggccctgctagtgcggccagggtcactgcccctgctgcccgatcgagtctgcaagatcctgcgcagactgcagcagaatgagcggctacctgagcggagccgccagcgcctccggctgcgggagtgtggtctccagggtctggttgcctgcttgcctgaggggactgtttccccccagctctgccagggcctctacaagctgttcctgggggcagattgcctgaacctctcagatctgctggctgtggtacagctgtccctccaggctgacctcagcgttcgcctagacatctgtcgccagcttttccacctcatctacggacagccagatgtagtgcggcttctggcccgacaggctggctggcaagatgtgctgacccggctatatgtcctggaggctgccacagccggcagcccccctccgtcttccccagagtcacctacctcccccaagccagccccacccaagccacccactgagtcacctgctgagccttcagatgtcttcctgccctcagaggccccctgccctgaccctgatggcttttaccatgctctctccccattctgcacgccctttgacctgggcctggaacggtctagtgtaggatcaggcaacactgctggtggtggcggcagcagtgggactcttactccagccagccagcccggcactccttcgccactggatgggccgcggccctttcctgctgctcctggccgccacagctccagtctctccaatgtgctggaggacggcagcctcccggagcccaccattagcggggatgatacctcgaacaccagcaacccacagcaaacctctgaggaagagttgtgcaatctgctcaccaacgtgctgttctcggtgacgtggcgtggcgtggaaggcagcgatgaggctgcctggcgggagcgtggccaggttttctcagtgctcacccagctgggggcctcagccacacttgtgcgcccaccagactgcatcaagcgcagcctcctggagatgatgctggagtcagccctgaccgacatcaaagaggcccccgtgggggtcctggccagcctcacccagcaagcgctttggctgctgcgtctgctgcaggacttcctgtgtgctgaaggccatggtaaccaggaactgtggagtgagaagctctttgaaggtgtatgcagcctacttgatcgcctgggagcctggccccacctggccaacggcacagctgatctccgtgagatggcgcagattggcctacggcttgtacttggctacatcctgctggaagacccacagctgcatgcccaggcctacgtgagattgcacatgctgctacagactgcagtgccagcccgccgcgaggaggcctgctatgtgctctccaagctggaggctgcactggggcgggtgctgaacacctcttccttggagtcagccactgatgaggcagggtccccacttgcagctgcagcagctgcagcagctgcagagcgctgctcctggctggtgccactggtgcgcacgctgctagaccgtgcctatgagccgctggggctgcagtggggactgccctccctgccacccaccaatggcagccccaccttctttgaagacttccaggctttttgtgccacacccgaatggcgccacttcatcgacaaacaggtacagccaaccatgtcccagttcgaaatggacacgtatgctaagagccacgaccttatgtcaggtttctggaatgcctgctatgacatgcttatgagcagtgggcagcggcgccagtgggagcgcgcccagagtcgtcgggccttccaggagctggtgctggaacctgcgcagaggcgggcgcgcctggaggggctacgctacacggcagtgctgaagcagcaggcaacgcagcactccatggccctgctgcactggggggcgctgtggcgccagctcgccagcccatgtggggcctgggcgctgagggacactcccatcccccgctggaaactgtccagcgccgagacatattcacgcatgcgtctgaagctggtgcccaaccatcacttcgaccctcacctggaagccagcgctctccgagacaatctgggtgaggttcccctgacacccaccgaggaggcctcactgcctctggcagtgaccaaagaggccaaagtgagcaccccacccgagttgctgcaggaggaccagctcggcgaggacgagctggctgagctggagaccccgatggaggcagcagaactggatgagcagcgtgagaagctggtgctgtcggccgagtgccagctggtgacggtagtggccgtggtcccagggctgctggaggtcaccacacagaatgtatacttctacgatggcagcactgagcgcgtggaaaccgaggagggcatcggctatgatttccggcgcccactggcccagctgcgtgaggtccacctgcggcgtttcaacctgcgccgttcagcacttgagctcttctttatcgatcaggccaactacttcctcaacttcccatgcaaggtgggcacgaccccagtctcatctcctagccagactcccagaccccagcctggccccatcccaccccatacccaggtacggaaccaggtgtactcgtggctcctgcgcctacggcccccctctcaaggctacctaagcagccgctccccccaggagatgctgcgtgcctcaggccttacccagaaatgggtacagcgtgagatatccaacttcgagtacttgatgcaactcaacaccattgcggggcggacctacaatgacctgtctcagtaccctgtgttcccctgggtcctgcaggactacgtgtccccaaccctggacctcagcaacccagccgtcttccgggacctgtctaagcccatcggtgtggtgaaccccaagcatgcccagctcgtgagggagaagtatgaaagctttgaggacccagcagggaccattgacaagttccactatggcacccactactccaatgcagcaggcgtgatgcactacctcatccgcgtggagcccttcacctccctgcacgtccagctgcaaagtggccgctttgactgctccgaccggcagttccactcggtggcggcagcctggcaggcacgcctggagagccctgccgatgtgaaggagctcatcccggaattcttctactttcctgacttcctggagaaccagaacggttttgacctgggctgtctccagctgaccaacgagaaggtaggcgatgtggtgctacccccgtgggccagctctcctgaggacttcatccagcagcaccgccaggctctggagtcggagtatgtgtctgcacacctacacgagtggatcgacctcatctttggctacaagcagcgggggccagccgccgaggaggccctcaatgtcttctattactgcacctatgagggggctgtagacctggaccatgtgacagatgagcgggaacggaaggctctggagggcattatcagcaactttgggcagactccctgtcagctgctgaaggagccacatccaactcggctctcagctgaggaagcagcccatcgccttgcacgcctggacactaactcacctagcatcttccagcacctggacgaactcaaggcattcttcgcagaggttgtcagtgatggtgtacccctggtgctagccctggtcccccaccggcagccccactccttcatcacccagggttccccagacctgttggtgactgtgagtgccagtgggctgctgggcacccacagctggttgccctatgaccgcaacataagcaactacttcagcttcagcaaagaccccaccatgggcagccacaagacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgttgagccagctcagctgccaccttgatgtagtaacctgccttgcactggacacctgtggcatctacctcatctcaggctcccgggacaccacgtgcatggtgtggcggctcctgcatcagggtggtctgtcagtaggcctggcaccaaagcctgtgcaggtcctgtatgggcatggggctgcagtgagctgtgtggccatcagcactgaacttgacatggctgtgtctggatctgaggtgtgtgtatgcatgtgccctggggagggtgagtttcctgggcaatccccctggagcccagactcctgcccaggaccctaagttgccttcctgcaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtatggggaaggggtgcccagcaaagatggaggggcagttgggatcctgtccttgctgacactccctgcttcctccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgtagctgc

SEQ ID NO: 27065 - DNA, 2665 bp, Homo sapiens
cttggttcccccaagtgtaggtacctgccagtgggccaagctctgagcttggtcaagggtagatgtgccaatgaagacctggcctctgtccccagcctcactcccttcccctccctgcctagcctctattcctcaaaaggaatcctgttccaggacactctgtccttctcccctgtgacccctctaagtggtgctcccccaacctgtgggcaggctctgtgcccgccttcttgagggtgtgggcagggcagggtgggctggtaggccatcagggccctcatgcagcccctgctcgggtgggtggccagttcccctgggtcctgcaggactacgtgtccccaaccctggacctcagcaacccagccgtcttccgggacctgtctaagcccatcggtgtggtgaaccccaagcatgcccagctcgtgagggagaagtatgaaagctttgaggacccagcagggaccattgacaagttccactatggcacccactactccaatgcagcaggcgtgatgcactacctcatccgcgtggagcccttcacctccctgcacgtccagctgcaaagtggccgctttgactgctccgaccggcagttccactcggtggcggcagcctggcaggcacgcctggagagccctgccgatgtgaaggagctcatcccggaattcttctactttcctgacttcctggagaaccagaacggttttgacctgggctgtctccagctgaccaacgagaaggtaggcgatgtggtgctacccccgtgggccagctctcctgaggacttcatccagcagcaccgccaggctctggagtcggagtatgtgtctgcacacctacacgagtggatcgacctcatctttggctacaagcagcgggggccagccgccgaggaggccctcaatgtcttctattactgcacctatgagggggctgtagacctggaccatgtgacagatgagcgggaacggaaggctctggagggcattatcagcaactttgggcagactccctgtcagctgctgaaggagccacatccaactcggctctcagctgaggaagcagcccatcgccttgcacgcctggacactaactcacctagcatcttccagcacctggacgaactcaaggcattcttcgcagaggttgtcagtgatggtgtacccctggtgctagccctggtcccccaccggcagccccactccttcatcacccagggttccccagacctgttggtgactgtgagtgccagtgggctgctgggcacccacagctggttgccctatgaccgcaacataagcaactacttcagcttcagcaaagaccccaccatgggcagccacaagacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgttgagccagctcagctgccaccttgatgtagtaacctgccttgcactggacacctgtggcatctacctcatctcaggctcccgggacaccacgtgcatggtgtggcggctcctgcatcagggtggtctgtcagtaggcctggcaccaaagcctgtgcaggtcctgtatgggcatggggctgcagtgagctgtgtggccatcagcactgaacttgacatggctgtgtctggatctgaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgtagctgc

SEQ ID NO: 27066 - DNA, 1662 bp, Homo sapiens
atggtgctgaccagccacttacccacaggagccacatccaactcggctctcagctgaggaagcagcccatcgccttgcacgcctggacactaactcacctagcatcttccagcacctggacgaactcaaggcattcttcgcagaggttgtcagtgatggtgtacccctggtgctagccctggtcccccaccggcagccccactccttcatcacccagggttccccagacctgttggtgactgtgagtgccagtgggctgctgggcacccacagctggttgccctatgaccgcaacataagcaactacttcagcttcagcaaagaccccaccatgggcagccacaagacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgttgagccagctcagctgccaccttgatgtagtaacctgccttgcactggacacctgtggcatctacctcatctcaggctcccgggacaccacgtgcatggtgtggcggctcctgcatcagggtggtctgtcagtaggcctggcaccaaagcctgtgcaggtcctgtatgggcatggggctgcagtgagctgtgtggccatcagcactgaacttgacatggctgtgtctggatctgaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgtagctgc

SEQ ID NO: 27067 - DNA, 1174 bp, Homo sapiens
gactacaacacaaacaacaaaacaacggctaggtacgaggctgggtttacatggacacctgtggcatctacctcatctcaggctcccgggacaccacgtgcatggtgtggcggctcctgcatcagggtggtctgtcagtaggcctggcaccaaagcctgtgcaggtcctgtatgggcatggggctgcagtgagctgtgtggccatcagcactgaacttgacatggctgtgtctggatctgaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgtagctgc

SEQ ID NO: 27068 - DNA, 1162 bp, Homo sapiens
  misc_feature (102)..(102): n is a, c, g, or t
ttttgtgtaacccggtagacgatacgattcgacctcgtacccgtcccgcctactactacacgtgctggtagtagtagacgcaagcccgcctactactaccgncggcgtgtctgggtggtctgtcagtaggcctggcaccaaagcctgtgcaggtcctgtatgggcatggggctgcagtgagctgtgtggccatcagcactgaacttgacatggctgtgtctggatctgaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgtagctgc

SEQ ID NO: 27069 - DNA, 4704 bp, Homo sapiens
  misc_feature (17)..(17): n is a, c, g, or t
ctcggctctaccttgtntcacagagtggagactgggatgaaggatgtggtgaactgcgttgggggtatgggtgccctgctgcccctgctggagcgagtagctgcacagcccaaagaggctgaagcaggtccagctgaaacgcatgacctcgtgggtcctgaactgacctctggtcacaacacccagggcctggttctcccattgggtaaatcttcagaggaacggatggagaggaacgcagtggctgcttttctgctgatgctgcggaacttccttcagggtcacatggtgaaccaagagagcctggtgcagtgccaggggcctgccatcatcggggccctcctgcgaaaggtcccaagctgggccatggacatgaacgtgctcatgtccgcccagctgctgatggagcaggtggcagctgagggcagcgggcccctcctgtacctactctaccagcatttgctcttcaactttcacctctggaccctcagtgacttcgccgtgcgcctcggtcacatccagtacatgtccagcatagttcgggagcacagacagaagctgcggaagaagtacggcgtccagtttatcttggatgctctgcgcacccactacagcccgcagcgggagcgccccctggctgctgacgacctacgcaccgtgcagacctccctcctgggcctggcgagggagttcctggtgcggagtctctcagcagatgacgtgcaggtcacgcagaccatgctgagctttttggcggccacaggcgatgacggtcaggcggtgggtgcgctggacctgctgctggccctgctgcacggttccctggtgcaggagtccttggctgtctttctgttggagccagggaacctcgaagtgctactggccctgctagtgcggccagggtcactgcccctgctgcccgatcgagtctgcaagatcctgcgcagactgcagcagaatgagcggctacctgagcggagccgccagcgcctccggctgcgggagtgtggtctccagggtctggttgcctgcttgcctgaggggactgtttccccccagctctgccagggcctctacaagctgttcctgggggcagattgcctgaacctctcagatctgctggctgtggtacagctgtccctccaggctgacctcagcgttcgcctagacatctgtcgccagcttttccacctcatctacggacagccagatgtagtgcggcttctggcccgacaggctggctggcaagatgtgctgacccggctatatgtcctggaggctgccacagccggcagcccccctccgtcttccccagagtcacctacctcccccaagccagccccacccaagccacccactgagtcacctgctgagccttcagatgtcttcctgccctcagaggccccctgccctgaccctgatggcttttaccatgctctctccccattctgcacgccctttgacctgggcctggaacggtctagtgtaggatcaggcaacactgctggtggtggcggcagcagtgggactcttactccagccagccagcccggcactccttcgccactggatgggccgcggccctttcctgctgctcctggccgccacagctccagtctctccaatgtgctggaggacggcagcctcccggagcccaccattagcggggatgatacctcgaacaccagcaacccacagcaaacctctgaggaagagttgtgcaatctgctcaccaacgtgctgttctcggtgacgtggcgtggcgtggaaggcagcgatgaggctgcctggcgggagcgtggccaggttttctcagtgctcacccagctgggggcctcagccacacttgtgcgcccaccagactgcatcaagcgcagcctcctggagatgatgctggagtcagccctgaccgacatcaaagaggcccccgtgggggtcctggccagcctcacccagcaagcgctttggctgctgcgtctgctgcaggacttcctgtgtgctgaaggccatggtaaccaggaactgtggagtgagaagctctttgaaggtgtatgcagcctacttgatcgcctgggagcctggccccacctggccaacggcacagctgatctccgtgagatggcgcagattggcctacggcttgtacttggctacatcctgctggaagacccacagctgcatgcccaggcctacgtgagattgcacatgctgctacagactgcagtgccagcccgccgcgaggaggcctgctatgtgctctccaagctggaggctgcactggggcgggtgctgaacacctcttccttggagtcagccactgatgaggcagggtccccacttgcagctgcagcagctgcagcagctgcagagcgctgctcctggctggtgccactggtgcgcacgctgctagaccgtgcctatgagccgctggggctgcagtggggactgccctccctgccacccaccaatggcagccccaccttctttgaagacttccaggctttttgtgccacacccgaatggcgccacttcatcgacaaacaggtacagccaaccatgtcccagttcgaaatggacacgtatgctaagagccacgaccttatgtcaggtttctggaatgcctgctatgacatgcttatgagcagtgggcagcggcgccagtgggagcgcgcccagagtcgtcgggccttccaggagctggtgctggaacctgcgcagaggcgggcgcgcctggaggggctacgctacacggcagtgctgaagcagcaggcaacgcagcactccatggccctgctgcactggggggcgctgtggcgccagctcgccagcccatgtggggcctgggcgctgagggacactcccatcccccgctggaaactgtccagcgccgagacatattcacgcatgcgtctgaagctggtgcccaaccatcacttcgaccctcacctggaagccagcgctctccgagacaatctgggtgaggttcccctgacacccaccgaggaggcctcactgcctctggcagtgaccaaagaggccaaagtgagcaccccacccgagttgctgcaggaggaccagctcggcgaggacgagctggctgagctggagaccccgatggaggcagcagaactggatgagcagcgtgagaagctggtgctgtcggccgagtgccagctggtgacggtagtggccgtggtcccagggctgctggaggtcaccacacagaatgtatacttctacgatggcagcactgagcgcgtggaaaccgaggagggcatcggctatgatttccggcgcccactggcccagctgcgtgaggtccacctgcggcgtttcaacctgcgccgttcagcacttgagctcttctttatcgatcaggccaactacttcctcaacttcccatgcaaggtgggcacgaccccagtctcatctcctagccagactcccagaccccagcctggccccatcccaccccatacccaggtacggaaccaggtgtactcgtggctcctgcgcctacggcccccctctcaaggctacctaagcagccgctccccccaggagatgctgcgtgcctcaggccttacccagaaatgggtacagcgtgagatatccaacttcgagtacttgatgcaactcaacaccattgcggggcggacctacaatgacctgtctcagtaccctgtgttcccctgggtcctgcaggactacgtgtccccaaccctggacctcagcaacccagccgtcttccgggacctgtctaagcccatcggtgtggtgaaccccaagcatgcccagctcgtgagggagaagtatgaaagctttgaggacccagcagggaccattgacaagttccactatggcacccactactccaatgcagcaggcgtgatgcactacctcatccgcgtggagcccttcacctccctgcacgtccagctgcaaagtggccgctttgactgctccgaccggcagttccactcggtggcggcagcctggcaggcacgcctggagagccctgccgatgtgaaggagctcatcccggaattcttctactttcctgacttcctggagaaccagaacggttttgacctgggctgtctccagctgaccaacgagaaggtaggcgatgtggtgctacccccgtgggccagctctcctgaggacttcatccagcagcaccgccaggctctggagtcggagtatgtgtctgcacacctacacgagtggatcgacctcatctttggctacaagcagcgggggccagccgccgaggaggccctcaatgtcttctattactgcacctatgaggcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgtagctgc

SEQ ID NO: 27070 - DNA, 265 bp, Homo sapiens
ggtgacgtggcgtggcgtggaaggcagcgatgaggctgcctggcgggagcgtggccaggttttctcagtgctcacccagctgggggcctcagccacacttgtgcgcccaccagactgcatcaagcgcaggtgagagggaaagtctggagggggaggggcttcaggaagcctcgggggaaggagagaagatagtcaggtagacccttgagttccccactcacccgccagcctcctggagatgatgctggagtcagccctgaccgac

SEQ ID NO: 27071 - DNA, 466 bp, Homo sapiens
gcatcggctatgatttccggcgcccactggcccagctgcgtgaggtccacctgcggcgtttcaacctgcgccgttcagcacttgagctcttctttatcgatcaggccaactacttcctcaacttcccatgcaaggtgggcacgaccccagtctcatctcctagccagactcccagaccccagcctggccccatcccaccccatacccaggtacggaaccaggtgtactcgtggctcctgcgcctacggcccccctctcaaggctacctaagcagccgctccccccaggagatgctgcgtgcctcaggccttacccaggtgagagccctgggtgtgagggatgtgaagtcgggaccctgaatcacggggcagtgctggacagcccacctggctcacatcttgtctgcccctgtccccagaaatgggtacagcgtgagatatccaacttcgagtacttgatgcaactc

SEQ ID NO: 27072 - DNA, 401 bp, Homo sapiens
tccccgcctttctttgggacctggctgggtgtgcctactgacctgccagcccgcagcgggagcgccccctggctgctgacgacctacgcaccgtgcagacctccctcctgggcctggcgagggagttcctggtgcggagtctctcagcagatgacgtgcaggtcacgcagaccatgctgagctttttggcggccacaggcgatgacggtcaggtaggctggaggttggggagcgggaggcttgggtgaggggagtgggggcccgacacagtgtgagaccctgcatccccaggcggtgggtgcgctggacctgctgctggccctgctgcacggttccctggtgcaggagtccttggctgtctttctgttggagccagggaacctcgaagtgctactggccct

SEQ ID NO: 27073 - DNA, 394 bp, Homo sapiens
gggctgtagacctggaccatgtgacagatgagcgggaacggaaggctctggagggcattatcagcaactttgggcagactccctgtcagctgctgaaggtaaggccagcttagaggatagtggccagggatgcccatgccatggtgctgaccagccacttacccacaggagccacatccaactcggctctcagctgaggaagcagcccatcgccttgcacgcctggacactaactcacctagcatcttccagcacctggacgaactcaaggcattcttcgcagaggtgaaaggaagacaagacctcaactttatattctgtgaaatgggtttaaccccactgtccttaccaaccacgtggggcagatgggaatcctaatcaaggtcactgattt

SEQ ID NO: 27074 - DNA, 6321 bp, Homo sapiens
  misc_feature (17)..(17): n is a, c, g, or t
ctcggctctaccttgtntcacagagtggagactgggatgaaggatgtggtgaactgcgttgggggtatgggtgccctgctgcccctgctggagcgagtagctgcacagcccaaagaggctgaagcaggtccagctgaaacgcatgacctcgtgggtcctgaactgacctctggtcacaacacccagggcctggttctcccattgggtaaatcttcagaggaacggatggagaggaacgcagtggctgcttttctgctgatgctgcggaacttccttcagggtcacatggtgaaccaagagagcctggtgcagtgccaggggcctgccatcatcggggccctcctgcgaaaggtcccaagctgggccatggacatgaacgtgctcatgtccgcccagctgctgatggagcaggtggcagctgagggcagcgggcccctcctgtacctactctaccagcatttgctcttcaactttcacctctggaccctcagtgacttcgccgtgcgcctcggtcacatccagtacatgtccagcatagttcgggagcacagacagaagctgcggaagaagtacggcgtccagtttatcttggatgctctgcgcacccactacagcccgcagcgggagcgccccctggctgctgacgacctacgcaccgtgcagacctccctcctgggcctggcgagggagttcctggtgcggagtctctcagcagatgacgtgcaggtcacgcagaccatgctgagctttttggcggccacaggcgatgacggtcaggcggtgggtgcgctggacctgctgctggccctgctgcacggttccctggtgcaggagtccttggctgtctttctgttggagccagggaacctcgaagtgctactggccctgctagtgcggccagggtcactgcccctgctgcccgatcgagtctgcaagatcctgcgcagactgcagcagaatgagcggctacctgagcggagccgccagcgcctccggctgcgggagtgtggtctccagggtctggttgcctgcttgcctgaggggactgtttccccccagctctgccagggcctctacaagctgttcctgggggcagattgcctgaacctctcagatctgctggctgtggtacagctgtccctccaggctgacctcagcgttcgcctagacatctgtcgccagcttttccacctcatctacggacagccagatgtagtgcggcttctggcccgacaggctggctggcaagatgtgctgacccggctatatgtcctggaggctgccacagccggcagcccccctccgtcttccccagagtcacctacctcccccaagccagccccacccaagccacccactgagtcacctgctgagccttcagatgtcttcctgccctcagaggccccctgccctgaccctgatggcttttaccatgctctctccccattctgcacgccctttgacctgggcctggaacggtctagtgtaggatcaggcaacactgctggtggtggcggcagcagtgggactcttactccagccagccagcccggcactccttcgccactggatgggccgcggccctttcctgctgctcctggccgccacagctccagtctctccaatgtgctggaggacggcagcctcccggagcccaccattagcggggatgatacctcgaacaccagcaacccacagcaaacctctgaggaagagttgtgcaatctgctcaccaacgtgctgttctcggtgacgtggcgtggcgtggaaggcagcgatgaggctgcctggcgggagcgtggccaggttttctcagtgctcacccagctgggggcctcagccacacttgtgcgcccaccagactgcatcaagcgcagcctcctggagatgatgctggagtcagccctgaccgacatcaaagaggcccccgtgggggtcctggccagcctcacccagcaagcgctttggctgctgcgtctgctgcaggacttcctgtgtgctgaaggccatggtaaccaggaactgtggagtgagaagctctttgaaggtgtatgcagcctacttgatcgcctgggagcctggccccacctggccaacggcacagctgatctccgtgagatggcgcagattggcctacggcttgtacttggctacatcctgctggaagacccacagctgcatgcccaggcctacgtgagattgcacatgctgctacagactgcagtgccagcccgccgcgaggaggcctgctatgtgctctccaagctggaggctgcactggggcgggtgctgaacacctcttccttggagtcagccactgatgaggcagggtccccacttgcagctgcagcagctgcagcagctgcagagcgctgctcctggctggtgccactggtgcgcacgctgctagaccgtgcctatgagccgctggggctgcagtggggactgccctccctgccacccaccaatggcagccccaccttctttgaagacttccaggctttttgtgccacacccgaatggcgccacttcatcgacaaacaggtacagccaaccatgtcccagttcgaaatggacacgtatgctaagagccacgaccttatgtcaggtttctggaatgcctgctatgacatgcttatgagcagtgggcagcggcgccagtgggagcgcgcccagagtcgtcgggccttccaggagctggtgctggaacctgcgcagaggcgggcgcgcctggaggggctacgctacacggcagtgctgaagcagcaggcaacgcagcactccatggccctgctgcactggggggcgctgtggcgccagctcgccagcccatgtggggcctgggcgctgagggacactcccatcccccgctggaaactgtccagcgccgagacatattcacgcatgcgtctgaagctggtgcccaaccatcacttcgaccctcacctggaagccagcgctctccgagacaatctgggtgaggttcccctgacacccaccgaggaggcctcactgcctctggcagtgaccaaagaggccaaagtgagcaccccacccgagttgctgcaggaggaccagctcggcgaggacgagctggctgagctggagaccccgatggaggcagcagaactggatgagcagcgtgagaagctggtgctgtcggccgagtgccagctggtgacggtagtggccgtggtcccagggctgctggaggtcaccacacagaatgtatacttctacgatggcagcactgagcgcgtggaaaccgaggagggcatcggctatgatttccggcgcccactggcccagctgcgtgaggtccacctgcggcgtttcaacctgcgccgttcagcacttgagctcttctttatcgatcaggccaactacttcctcaacttcccatgcaaggtgggcacgaccccagtctcatctcctagccagactcccagaccccagcctggccccatcccaccccatacccaggtacggaaccaggtgtactcgtggctcctgcgcctacggcccccctctcaaggctacctaagcagccgctccccccaggagatgctgcgtgcctcaggccttacccagaaatgggtacagcgtgagatatccaacttcgagtacttgatgcaactcaacaccattgcggggcggacctacaatgacctgtctcagtaccctgtgttcccctgggtcctgcaggactacgtgtccccaaccctggacctcagcaacccagccgtcttccgggacctgtctaagcccatcggtgtggtgaaccccaagcatgcccagctcgtgagggagaagtatgaaagctttgaggacccagcagggaccattgacaagttccactatggcacccactactccaatgcagcaggcgtgatgcactacctcatccgcgtggagcccttcacctccctgcacgtccagctgcaaagtggccgctttgactgctccgaccggcagttccactcggtggcggcagcctggcaggcacgcctggagagccctgccgatgtgaaggagctcatcccggaattcttctactttcctgacttcctggagaaccagaacggttttgacctgggctgtctccagctgaccaacgagaaggtaggcgatgtggtgctacccccgtgggccagctctcctgaggacttcatccagcagcaccgccaggctctggagtcggagtatgtgtctgcacacctacacgagtggatcgacctcatctttggctacaagcagcgggggccagccgccgaggaggccctcaatgtcttctattactgcacctatgagggggctgtagacctggaccatgtgacagatgagcgggaacggaaggctctggagggcattatcagcaactttgggcagactccctgtcagctgctgaaggagccacatccaactcggctctcagctgaggaagcagcccatcgccttgcacgcctggacactaactcacctagcatcttccagcacctggacgaactcaaggcattcttcgcagaggttgtcagtgatggtgtacccctggtgctagccctggtcccccaccggcagccccactccttcatcacccagggttccccagacctgttggtgactgtgagtgccagtgggctgctgggcacccacagctggttgccctatgaccgcaacataagcaactacttcagcttcagcaaagaccccaccatgggcagccacaagacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgttgagccagctcagctgccaccttggtatgaacagccttggagctggggagaatgaggcacacaggtatggggccgggttctgaggctggccagggcggatgtgactcctccgttctgcctgtaccctccccttcccatgcagatgtagtaacctgccttgcactggacacctgtggcatctacctcatctcaggctcccgggacaccacgtgcatggtgtggcggctcctgcatcaggtgtgcctcgtgggcagctctgtggggcccccgtagcccagacctgcagcccatccgtccctcagtggccttccagtcctgtcctcctctagtcttggacaaggccttcatttcctgagcctcaggggacagtcctaagccaaccctggtcctccacagggtggtctgtcagtaggcctggcaccaaagcctgtgcaggtcctgtatgggcatggggctgcagtgagctgtgtggccatcagcactgaacttgacatggctgtgtctggatctgaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgtagctgc

SEQ ID NO: 27075 - DNA, 2412 bp, Homo sapiens
agaattctcgcctgccacgcgggcggactacaatgacctgtctcagtaccctgtgttcccctgggtcctgcaggactacgtgtccccaaccctggacctcagcaacccagccgtcttccgggacctgtctaagcccatcggtgtggtgaaccccaagcatgcccagctcgtgagggagaagtatgaaagctttgaggacccagcagggaccattgacaagttccactatggcacccactactccaatgcagcaggcgtgatgcactacctcatccgcgtggagcccttcacctccctgcacgtccagctgcaaagtggccgctttgactgctccgaccggcagttccactcggtggcggcagcctggcaggcacgcctggagagccctgccgatgtgaaggagctcatcccggaattcttctactttcctgacttcctggagaaccagaacggttttgacctgggctgtctccagctgaccaacgagaaggtaggcgatgtggtgctacccccgtgggccagctctcctgaggacttcatccagcagcaccgccaggctctggagtcggagtatgtgtctgcacacctacacgagtggatcgacctcatctttggctacaagcagcgggggccagccgccgaggaggccctcaatgtcttctattactgcacctatgagggggctgtagacctggaccatgtgacagatgagcgggaacggaaggctctggagggcattatcagcaactttgggcagactccctgtcagctgctgaaggagccacatccaactcggctctcagctgaggaagcagcccatcgccttgcacgcctggacactaactcacctagcatcttccagcacctggacgaactcaaggcattcttcgcagaggttgtcagtgatggtgtacccctggtgctagccctggtcccccaccggcagccccactccttcatcacccagggttccccagacctgttggtgactgtgagtgccagtgggctgctgggcacccacagctggttgccctatgaccgcaacataagcaactacttcagcttcagcaaagaccccaccatgggcagccacaagacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgttgagccagctcagctgccaccttgatgtagtaacctgccttgcactggacacctgtggcatctacctcatctcaggctcccgggacaccacgtgcatggtgtggcggctcctgcatcagggtggtctgtcagtaggcctggcaccaaagcctgtgcaggtcctgtatgggcatggggctgcagtgagctgtgtggccatcagcactgaacttgacatggctgtgtctggatctgaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgtagctgc

SEQ ID NO: 27076 - DNA, 1998 bp, Homo sapiens
acgatggtcctcagctcaacgatggtcctcagctcaacgttttgacctgggctgtctccagctgaccaacgagaaggtaggcgatgtggtgctacccccgtgggccagctctcctgaggacttcatccagcagcaccgccaggctctggagtcggagtatgtgtctgcacacctacacgagtggatcgacctcatctttggctacaagcagcgggggccagccgccgaggaggccctcaatgtcttctattactgcacctatgagggggctgtagacctggaccatgtgacagatgagcgggaacggaaggctctggagggcattatcagcaactttgggcagactccctgtcagctgctgaaggagccacatccaactcggctctcagctgaggaagcagcccatcgccttgcacgcctggacactaactcacctagcatcttccagcacctggacgaactcaaggcattcttcgcagaggttgtcagtgatggtgtacccctggtgctagccctggtcccccaccggcagccccactccttcatcacccagggttccccagacctgttggtgactgtgagtgccagtgggctgctgggcacccacagctggttgccctatgaccgcaacataagcaactacttcagcttcagcaaagaccccaccatgggcagccacaagacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgttgagccagctcagctgccaccttgatgtagtaacctgccttgcactggacacctgtggcatctacctcatctcaggctcccgggacaccacgtgcatggtgtggcggctcctgcatcagggtggtctgtcagtaggcctggcaccaaagcctgtgcaggtcctgtatgggcatggggctgcagtgagctgtgtggccatcagcactgaacttgacatggctgtgtctggatctgaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgtagctgc

SEQ ID NO: 27077 - DNA, 1245 bp, Homo sapiens
ctacaggattaagttaagcgtcggtggccactgggatggcagcctgcgggtgactgcactaccccgtggcaagctgttgagccagctcagctgccaccttgatgtagtaacctgccttgcactggacacctgtggcatctacctcatctcaggctcccgggacaccacgtgcatggtgtggcggctcctgcatcagggtggtctgtcagtaggcctggcaccaaagcctgtgcaggtcctgtatgggcatggggctgcagtgagctgtgtggccatcagcactgaacttgacatggctgtgtctggatctgaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgtagctgc

SEQ ID NO: 27078 - DNA, 1811 bp, Homo sapiens
gcaggctgtactggcccgaggtcgtatgattgggcagccacaagtaggacagagggctgtgggtggggtgggctacaaatgccctgcacccggaattattcccctccctaatcagaatgtaggccagctgcaggggaaaggtctggccaggctccctgagggcctgggtctcttccatgtggcctggcctcacttgctatccccctcactgggtcaggacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgttgagccagctcagctgccaccttggtatgaacagccttggagctggggagaatgaggcacacaggtatggggccgggttctgaggctggccagggcggatgtgactcctccgttctgcctgtaccctccccttcccatgcagatgtagtaacctgccttgcactggacacctgtggcatctacctcatctcaggctcccgggacaccacgtgcatggtgtggcggctcctgcatcaggtgtgcctcgtgggcagctctgtggggcccccgtagcccagacctgcagcccatccgtccctcagtggccttccagtcctgtcctcctctagtcttggacaaggccttcatttcctgagcctcaggggacagtcctaagccaaccctggtcctccacagggtggtctgtcagtaggcctggcaccaaagcctgtgcaggtcctgtatgggcatggggctgcagtgagctgtgtggccatcagcactgaacttgacatggctgtgtctggatctgaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgtagctgc

SEQ ID NO: 27079 - DNA, 5864 bp, Homo sapiens
  misc_feature (17)..(17): n is a, c, g, or t
ctcggctctaccttgtntcacagagtggagactgggatgaaggatgtggtgaactgcgttgggggtatgggtgccctgctgcccctgctggagcgagtagctgcacagcccaaagaggctgaagcaggtccagctgaaacgcatgacctcgtgggtcctgaactgacctctggtcacaacacccagggcctggttctcccattgggtaaatcttcagaggaacggatggagaggaacgcagtggctgcttttctgctgatgctgcggaacttccttcagggtcacatggtgaaccaagagagcctggtgcagtgccaggggcctgccatcatcggggccctcctgcgaaaggtcccaagctgggccatggacatgaacgtgctcatgtccgcccagctgctgatggagcaggtggcagctgagggcagcgggcccctcctgtacctactctaccagcatttgctcttcaactttcacctctggaccctcagtgacttcgccgtgcgcctcggtcacatccagtacatgtccagcatagttcgggagcacagacagaagctgcggaagaagtacggcgtccagtttatcttggatgctctgcgcacccactacagcccgcagcgggagcgccccctggctgctgacgacctacgcaccgtgcagacctccctcctgggcctggcgagggagttcctggtgcggagtctctcagcagatgacgtgcaggtcacgcagaccatgctgagctttttggcggccacaggcgatgacggtcaggcggtgggtgcgctggacctgctgctggccctgctgcacggttccctggtgcaggagtccttggctgtctttctgttggagccagggaacctcgaagtgctactggccctgctagtgcggccagggtcactgcccctgctgcccgatcgagtctgcaagatcctgcgcagactgcagcagaatgagcggctacctgagcggagccgccagcgcctccggctgcgggagtgtggtctccagggtctggttgcctgcttgcctgaggggactgtttccccccagctctgccagggcctctacaagctgttcctgggggcagattgcctgaacctctcagatctgctggctgtggtacagctgtccctccaggctgacctcagcgttcgcctagacatctgtcgccagcttttccacctcatctacggacagccagatgtagtgcggcttctggcccgacaggctggctggcaagatgtgctgacccggctatatgtcctggaggctgccacagccggcagcccccctccgtcttccccagagtcacctacctcccccaagccagccccacccaagccacccactgagtcacctgctgagccttcagatgtcttcctgccctcagaggccccctgccctgaccctgatggcttttaccatgctctctccccattctgcacgccctttgacctgggcctggaacggtctagtgtaggatcaggcaacactgctggtggtggcggcagcagtgggactcttactccagccagccagcccggcactccttcgccactggatgggccgcggccctttcctgctgctcctggccgccacagctccagtctctccaatgtgctggaggacggcagcctcccggagcccaccattagcggggatgatacctcgaacaccagcaacccacagcaaacctctgaggaagagttgtgcaatctgctcaccaacgtgctgttctcggtgacgtggcgtggcgtggaaggcagcgatgaggctgcctggcgggagcgtggccaggttttctcagtgctcacccagctgggggcctcagccacacttgtgcgcccaccagactgcatcaagcgcagcctcctggagatgatgctggagtcagccctgaccgacatcaaagaggcccccgtgggggtcctggccagcctcacccagcaagcgctttggctgctgcgtctgctgcaggacttcctgtgtgctgaaggccatggtaaccaggaactgtggagtgagaagctctttgaaggtgtatgcagcctacttgatcgcctgggagcctggccccacctggccaacggcacagctgatctccgtgagatggcgcagattggcctacggcttgtacttggctacatcctgctggaagacccacagctgcatgcccaggcctacgtgagattgcacatgctgctacagactgcagtgccagcccgccgcgaggaggcctgctatgtgctctccaagctggaggctgcactggggcgggtgctgaacacctcttccttggagtcagccactgatgaggcagggtccccacttgcagctgcagcagctgcagcagctgcagagcgctgctcctggctggtgccactggtgcgcacgctgctagaccgtgcctatgagccgctggggctgcagtggggactgccctccctgccacccaccaatggcagccccaccttctttgaagacttccaggctttttgtgccacacccgaatggcgccacttcatcgacaaacaggtacagccaaccatgtcccagttcgaaatggacacgtatgctaagagccacgaccttatgtcaggtttctggaatgcctgctatgacatgcttatgagcagtgggcagcggcgccagtgggagcgcgcccagagtcgtcgggccttccaggagctggtgctggaacctgcgcagaggcgggcgcgcctggaggggctacgctacacggcagtgctgaagcagcaggcaacgcagcactccatggccctgctgcactggggggcgctgtggcgccagctcgccagcccatgtggggcctgggcgctgagggacactcccatcccccgctggaaactgtccagcgccgagacatattcacgcatgcgtctgaagctggtgcccaaccatcacttcgaccctcacctggaagccagcgctctccgagacaatctgggtgaggttcccctgacacccaccgaggaggcctcactgcctctggcagtgaccaaagaggccaaagtgagcaccccacccgagttgctgcaggaggaccagctcggcgaggacgagctggctgagctggagaccccgatggaggcagcagaactggatgagcagcgtgagaagctggtgctgtcggccgagtgccagctggtgacggtagtggccgtggtcccagggctgctggaggtcaccacacagaatgtatacttctacgatggcagcactgagcgcgtggaaaccgaggagggcatcggctatgatttccggcgcccactggcccagctgcgtgaggtccacctgcggcgtttcaacctgcgccgttcagcacttgagctcttctttatcgatcaggccaactacttcctcaacttcccatgcaaggtgggcacgaccccagtctcatctcctagccagactcccagaccccagcctggccccatcccaccccatacccaggtacggaaccaggtgtactcgtggctcctgcgcctacggcccccctctcaaggctacctaagcagccgctccccccaggagatgctgcgtgcctcaggccttacccagaaatgggtacagcgtgagatatccaacttcgagtacttgatgcaactcaacaccattgcggggcggacctacaatgacctgtctcagtaccctgtgttcccctgggtcctgcaggactacgtgtccccaaccctggacctcagcaacccagccgtcttccgggacctgtctaagcccatcggtgtggtgaaccccaagcatgcccagctcgtgagggagaagtatgaaagctttgaggacccagcagggaccattgacaagttccactatggcacccactactccaatgcagcaggcgtgatgcactacctcatccgcgtggagcccttcacctccctgcacgtccagctgcaaagtggccgctttgactgctccgaccggcagttccactcggtggcggcagcctggcaggcacgcctggagagccctgccgatgtgaaggagctcatcccggaattcttctactttcctgacttcctggagaaccagaacggttttgacctgggctgtctccagctgaccaacgagaaggtaggcgatgtggtgctacccccgtgggccagctctcctgaggacttcatccagcagcaccgccaggctctggagtcggagtatgtgtctgcacacctacacgagtggatcgacctcatctttggctacaagcagcgggggccagccgccgaggaggccctcaatgtcttctattactgcacctatgagggggctgtagacctggaccatgtgacagatgagcgggaacggaaggctctggagggcattatcagcaactttgggcagactccctgtcagctgctgaaggagccacatccaactcggctctcagctgaggaagcagcccatcgccttgcacgcctggacactaactcacctagcatcttccagcacctggacgaactcaaggcattcttcgcagaggttgtcagtgatggtgtacccctggtgctagccctggtcccccaccggcagccccactccttcatcacccagggttccccagacctgttggtgactgtgagtgccagtgggctgctgggcacccacagctggttgccctatgaccgcaacataagcaactacttcagcttcagcaaagaccccaccatgggcagccacaagacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgttgagccagctcagctgccaccttgatgtagtaacctgccttgcactggacacctgtggcatctacctcatctcaggctcccgggacaccacgtgcatggtgtggcggctcctgcatcagggtggtctgtcagtaggcctggcaccaaagcctgtgcaggtcctgtatgggcatggggctgcagtgagctgtgtggccatcagcactgaacttgacatggctgtgtctggatctgaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtatggggaaggggtgcccagcaaagatggaggggcagttgggatcctgtccttgctgacactccctgcttcctccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgaggatggggcgggggtggggaggcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgtagctgc

SEQ ID NO: 27080 - DNA, 862 bp, Homo sapiens
ctagaggatccccagactcggcaccgttcgctgccctccctcagtgagcctttctcctcctgctgtatcggctccgctggataccgcatcgactctaccctcgcaggcacccaggacactcggtggggcagccccacatccctggagggtgagctgggggctgtggccatctttcacgaagccctgcaggcgacggctctgaggaccctgtgcaccctggggcccaatgagacggcacccttcaagcctgagggggagctgcatgagctcagcaccaggctgctcctccattactcacctcaggtatttgggggccccaggggagtggttggctcgactgtgctacttccccggctcccacactctgcctgccaccccctcctccctctgaccctggctgcctgcccattcccctatccctaggcttgtaagaacaacatctgcctggacctgtcccccagtcatgggcttgatgggcgcctgacgggccacagagtggagacctgggatgtgaaggatgtggtgaactgcgttgggggtatgggtgccctgctgcccctgctggagcgagtagctgcacagcccaaagaggctgaagcaggtccagctgaaacgcatgacctcgtgggtcctgaactgacctctggtcacaacacccagggcctggttctcccattgggtaaatcttcagaggaacggatggagaggaacgcagtggctgcttttctgctgatgctgcggaacttccttcagggtcacatggtgaaccaagagagcctggtgcagtgccaggggcctgccatcatcggggccctcctgcgaaaggtccaagctgggcatggactgaacgtctcatgtctgc

SEQ ID NO: 27081 - DNA, 638 bp, Homo sapiens
ttgtgcttgtatatttctggttttgcaatttccagatcatatattacctaaaattttatattctgcttttttccccatttaccattttttcattatataaatttatatatactcttcataaatatttgtagtggctgcataatagtctatcatataggatttttatatgctttcaggttttttcaaataataatggaatttttttcaaatcatttttgtaatagatataacaaataagtccccaaataagtctttaccctaattctgccctgcagaagtaaccattatttattaatagttttctgtgtatctttatatgaacattattatgcataagtttttgtctacgtttttggttattttcttatgatacatatctacaaatagattactagattaaacaatatgaaagtaattttttcctaattgtatatgatggtactatttagaaaacatgaaaaataatgtgttaagggggaaagtaaaaggcacccataattccacaactcagaaatgaacattatttggtatacttccttacacgtatacatacacatatacaaactcacaagtatgtggggagagggataaatatgtatatgatatatctatctgtctataaatatttgtatatatag

SEQ ID NO: 27082 - DNA, 311 bp, Homo sapiens
tttttttttctaaggcactttaggcatacttttaaaaacaaaatttagtttttatacatacttacctttcaaaaacaaaatttagtttatatacatatatatcttaaaagcaggccaggcgtggtggctcacgcctgtaattccagcactttgggaggccaaggcgggaggatcacttgaggtcaggagtttgagaccagcctagccaacatggtgaaaccccgtctctactaaaaatacaaaaaaattagccaggtgtggtggtgggcacctgtaatccaagttacttgggaggctgaggcacaaggatc

SEQ ID NO: 27083 - DNA, 631 bp, Homo sapiens
atgattcagagaaaggagttgcttctgaccggggggaaaacaaagaaattatcatggaagagatgtcatttgattttgctttgaagtagtagttcatgtaaaaatttatgtgagaggctttttaggcagaaggaatagcctgagaaaaggcatagtggcatgcaaatgtggtttgtgtgtaagaaagttggttattctgtttggcttcgatttggcttatcaaagagagttctgggagaaaagttgttcaacattggtttgaggccaaataatggatatccctagatgccagacaagtgaagatttttaaactggggacaatgacgtaatcagagtatactttagaaatattaatgtgacaacagatgaataggggaaattttaggaaaagaaactggatcagataagtaggagggagacaagtctggaagcaatcaatgtgtaggataaactgggacctgctctcagctgaggcaattaaactggaaaagaaatagattgaaaagatactacagaagaagcagtacagaagttgggggactgaaggagagggagccactgcaggtgctagctgcttaaggggataccagtccttttacagatataatagatacagcttctgaggtggagg

SEQ ID NO: 27084 - DNA, 494 bp, Homo sapiens
taaaatatttcattgtgttttatttaggaaaaaaatggtagatgaaagcggaaccaacaggggcattccgtttgtggtttgctgagattccctggaaagcaagcttgggaggccagggtctgtcagaacacaagaccaatgtcttctccaaaacttggatgaacagaaggtgcttacaagctgacagggagttatggggaaggaagcagaatttccagtttggttccaagtcttttctggtcttgacctttagcctaaaaacagagggcccagttgttctccattattactgtaactcaaaaggagacacatgggtccgggagagagttgggaggcaatactaggtttgcacgttctgagttcatggacacccaaggaactgcccctccctaggataactagagccaagccactggacccttctcatcctgtggccttgtctacaattttaatcattttgaagatgaaggttttgaagatgaaggcccagcctc

SEQ ID NO: 27085 - DNA, 183 bp, Homo sapiens
tacttgttcagggcctttatttttctttctatttcatatacacccacactgaacagtctgcattgtgttaataaataaccagcagcaactaagtgaacagaggagggtttcgatgttgctgtcaggtaccagacagttgcttggcactgcggatacagttctctacatatgagctgcatgctc

SEQ ID NO: 27086 - DNA, 1464 bp, Homo sapiens
tattttataaatataattttattacttggaaatacatacaaaaattcaaacacagctaaaaaacagttgctaagcagaggtcctatccaacctggtttaatgaacataaagttattatcagcataaaacttgagtcctgaaacaacttactgtcttcagggtcttcaaataatgggtttaaaaacagataactgttttgttctttacagctatttaaatctttcccccaaatacagagtactaacatttgtttggttcatgaggttttattttagaaaaatagctaaagctattagctaatgatttgaaaactgcagtacgtttgctcatttccagtcttctgtcaccttacattctccatggtttctcaaaaattcccaacagttgttaatagaaagcatttgcaacctccagcagctctctaggatacagaagtgtgggtctaacaaccttgaaatcatttaaggtgacaataattttttttttttttacttttcatttttgcaatttcatgtcattttattttggtccagccatatctccttgtaggagaaaaaaaaactgagttattctgttcttcctgattgtcaatccattacactactttatccattcctttttgccctcaggtttaaaaaagaaaaaaaaaaaagccttcttgacaaccttagcattttctataaatttaagcttattgtgagcttgaacatttcaaacacttctatatttcactctcctctctgtagcttttgtcatgccagttttcccttcttttgcaaatgatctttgacaacctggcttcatcagagagctctgagatgccttagatgcccattctctatcttattggctaggttcttttaatttaaagaaaaaaataatttgtagaatgtcatctaaaagtttccatccttttatggtccccctcacaatttgaaaaactcgaagaggtagctggctaagaagcagaaaggcccccttttggttctggggactcaaccgtgttcttcagtctggtcttgcatcctctcttcccagctgagaagcctgaggccccgagtagatcagataaaccggggaagacttctaccctgaaatgggtctgattcacggttcagagggggaacaagtaagtctaaatttgagacgtgcttccacactattctttctcaaactttaaagtgaacatacttccttgcttgcaatctgttgatggatctcttctgcctacaatatatactacaaaccccttagtctggcacacaaggccctgtgtgaccagctcccatttctttttctagcttccccaaccccaaatgccttactaaaagaacttttttctctaatgcattaggctgtttcatacctttgctcagattattccctctcagccagatccctacctcctgagaacacctattcatctttttaaagctcaaaataaaaataatgtcctcaaatctc

SEQ ID NO: 27087 - DNA, 407 bp, Homo sapiens
aatacttctctctgcattatacagctgttatagccttttgattttgaggatacgatgtgagtgtagctttcacttgggttgcagggtagttgctgtgcacaactgcaaggactttggactcagaaagatatgaattaaaaatcccatctctcctgattagtaagctgtgtgatcttgaccaagctatgcagcctatctgagtctctgtcctgatggataaagcaaataacaataccaacctgtagggttgatatgagaatgaaagataaggtatatcaatgcttagcacatggtacaccttgagtatctggtatgtgttattttcactcttggttgttattattattcttacaattattatgcattggctaggtccaggtgagacatgaggaaacacactcatgatt

SEQ ID NO: 27088 - DNA, 511 bp, Homo sapiens
agcaatctctcatatttatttgagaattttcctgtacacttgctcatttatttttctatattatttattttagactcatcttgtctagttaaaaaatagtgttgacacttgtttgaataatgttaggtttataggtttttagattaggaagaattgacatctctatgatgttaaattatcttttctaaaacatagtgtatcttttcatgtgttcatgatcttcagtagtactttatgaccctcaataatgctttatttgaatatagtttttataccttgttaagttttagctttttgtcattgttcattatatgttcattgtattcataaaatatatgaatatacatattttgtacccaaaccaatagtgaatttacctgaagaatccaagagaatcactaaaactactataaataataaacccgttctgtcatctgtaaaaaaatttacattttcatatccaagttttaaataacatttctcttatccagatcatttttttaatatgatg

SEQ ID NO: 27089 - DNA, 503 bp, Homo sapiens
cagctcgggcacaacgccttctcaaccaggcctgccttcccacacctttgcccctgcggctgagagcctcatggaaaaaccctccagaaattggtgtctatttttgggaattaacaaaaacagtggcaagcagtcagtgttttcagtttattaggactgtccccagacctacagaaaagagaagctgctgattactagttaggaccagacttggcatcggcaacgatgttgcaggccctggcgtgggccctctgggcctgagccctcctcgcagccctgcgggacccctctgtcccccttgaacaccacgttcacccagcgtgggttcctctcctccctgcccttctgcccccgtcagaccacgggacagtctcagccacgtcagagccagcatgggctccccaccacgcaggcctccctgcttctccgggcttctgcttctgttactatgacgagctccacactgccctcccccaggaggtcccatcctgcagcctggtctg

SEQ ID NO: 27090 - DNA, 329 bp, Homo sapiens
aagcataaaacatttaccatctagctcttcatagataaagtttgctgactatggattagaagaatatatatcatataaaatataaacagagaccttagggaaacgcaaatcaaaaccataatgagatattatttcatacacactaggaaggctgtaatttaggggaaaaaaggacaataacaagtgttggccaggatgtagagagattggaactctcatacattgctgatgagaatgtaaaatggtacagccactgtggaaaacagtttggcagttcctgagaaagttaaacatatgctaaagagatgcaatgaaaaagaataaataaa

SEQ ID NO: 27091 - DNA, 303 bp, Homo sapiens
ctacaaggataattctaaggcttctgatataaatacccagttctactagttgccatatatagaggtaagtgagcagtaataggactgtcatctcagctcacttgatacgtcatatgtttgggtgaatgatggttttgtccttaagttttagacatttaattatatctagagggccaggcacagtggctcatacctgtaatcccaacactttgggaggccaagacaggcagatcacctgaggccaggagaattgcttgaacccaggaggcagaggttgcagtgagctgagatcacagccactgg

SEQ ID NO: 27092 - DNA, 299 bp, Homo sapiens
gaaaccctatctctactaaaaatataaaaaattagccgggcatggtgtcaggcgcccgtagtcccagctacttgagaggctgaggcagaagaatggcatgaacccaggaggcggagcttgcagtgagccgagatcgcaccactgcactccagcctgggcaacagagactctgtctcaaaaaaacagacagacagacatacactgacagatattttgcctgtcagtgcggctaaggggctctgcagcctgagtctgcagtgtagtcctcaatgccaggcgaagttcgcatttatttagta

SEQ ID NO: 27093 - DNA, 304 bp, Homo sapiens
acatttgtataggtccattcccaacttctctattccacagcagaacctgtaacagaactttttggagggcaattttacaatatgcgttgaaatgttatcatctgaactccacaacgggatccagttcagcatggcaagaaatttaacttgcagctttccttgcccaagggcacaggggcagtacataaatgtcttctccaggctggttagtaatatttaaataaactcagtaaaataaatgttgaaaaatctcgaaataaagaaaaaattaattagatttatactctgcaacgctacgcagctt

SEQ ID NO: 27094 - DNA, 399 bp, Homo sapiens
gacaccagaatccccttagtaactggccctgggctggcttccaggagctgaagcctcttccctggatacttcttcccgagtgtggaccagaccactggtatgtgcatctctggacccaagggatgggtcctgtgggggtgaatgtggacggaatttggtcttccaggctggcatgtccgccggcatgaactggaggctgctgtggtacaggaagaaccaggggagggcaagaaagcggcaagctgcagtccgggtactgcttctttctcactaccttgtgctaatataaaattttgaagtgtctaagaattctgagttcaaacttggccttttaggttgtgatgaaagtatccttgtcaaggaagaagaaaagaatgtgttttgttaacaacttgtaaa

SEQ ID NO: 27095 - DNA, 353 bp, Homo sapiens
aaaaatttgaaagaagtgacttacaccagatgcacagaaatcaaggtaagggcacaaaaaacattataaaaaaataaaataaaatataaaaacaaggaaacatgagacttccaaaggaacaaaataattcttcatcagtaaattccaataaaaaatgtataaactgcctaaaagataattgaaaacaatgatattgaataagctcagtgagatacaagagaacatagataaacagtatgaagaaatcagaaaaacaattaatgatctgaatgagaaattcaacaaaatgttaaatatcattaaaaagaatcaaacagaaattctggatctgaataagtcaataaatgaaataa

SEQ ID NO: 27096 - DNA, 1743 bp, Homo sapiens
ctttaccattgatcttaaactgtgcaggctaaaaagaggaaccagaactcccttaagcacttttaagactatttaaaaaataaagttttgttggcattgaagagtaagctgcttaagggactgaatgaaaagatagtaccctttgtggctgtatgaagagagaaactgaatttctatccaagagaccttaatttagtttattagggaattatcttccccaaaagtacaagtaattttgcactgcaggagaaggataagtagatttgatttacatcacattttatacacacctttcaaaaggaagaaatctgtttcataaatagtagtaatctatgcttaaacttaacatttaatgttgacttcttacaacagccttgaaaattatttgtaattttgatcatgatgttggaaagcttgtaataaagaatatctttctcttctgcatccttttatcctcaaacttagcatggattcacatgctgagtaaatgtttggttaactagtgaacattttagatagttgtgtcaaaaataagggttagggataggtaaaaccagtaatttactgttttttacagaagacatctcagcatttctttggcatttttgcacaaataaatgactatatattcaccttggccatttttttttttaagtagccctatgagctgctcattctttttcatatacagtggaagtatacagatgttatccattttacaaattgttggatcggaatttgacagaattgggactgtggaacctgggtcacttgaattttctatattttgtatggccaaatcaggaaccagacagtctccatagtctccttggtttttatggaaaattgccatattcacatatttcatttatcctaatgtattgtcatccaaaatgaaagaggtctttcttgaaggtgctttaaagacatcactacatgtattcaattactgatttaaatattcccagaattattttttacctttctctttttcctctcaaacacaaaattttagtagtacctccctctatttcttcactgatttttcatctgttttcattgttatttccactatagaacttctactttatactagcggggaaaatttttttatttagaattttaatatttgaattttgtttatgtatcacatactgtgctacagttagcctcaatgaagattctattttgaactagacatcctgtcaatagtttgtcaagtaacttcattgcttcctttgatagcaattcagtgaaattttttcccaagtgatattttcccccaacttttgtgagtttgataaataggatgagtcttttatattggaaatactgtgaatggaaaattgccaaatcccttcttagtatattttaagcaccctacaacactttacctccctgcctttagtggtatttaaacatatggccaagttagtatttgggtttgattcctttggtgaagattaaggcatcaaaacatttcttaaaatgtttgagtacaaggctaagttataatgtcaactttcaaagactatgttgtgattcggtttgaatatgctgaagtgagcaattatgatttgcccaagtgcaatacaacaaatctataatgtatatttcacattttctacttgaacacattcatgtatatattttgttaaacttcatatgtatttaaaaagaatcatgaactgtatcaaaattctttcaataaaatttctatttaaaaatctcaaaaaaaaaaaa

SEQ ID NO: 27097 - DNA, 960 bp, Homo sapiens
cagttagtgtagaagttttagagtatcttttggtgtaactataaatttactgacatctctaaatttaaaaaatgcatgcccttcattcacatttgaaacattcggaatgtcattttaaaattacttctctttttttgaaaaataaactttaaaaattaaagtaacttctcagtctttcagcatggaaagattggggacatttagagacttggtaatttccatgcgagggcaggtggattgggttcctttgcccaaagcagaacgtgggacaggatcagcctcgtgagatagcacgtctggcctttggtccccttctccattgcttcctctctttatgtttctcttcctatctctccgagttgctgtttctttgtgagtctttttctattcagtctttctgggagttggttcatcttttcctccatctaagttttttatcctcttcgctttttttcctcttttcgtccttagttttatgtatcaactccccgtgcccccattttttttttgcttgaccttctctgtttccttttattcttgaataaatcttagtctctgtttctctttcccactctttcctctctcttactgtctcccttcttgtcctgttctcagctaacttaactggccacatgtgacgaaaacaacaacttcttagcttcttttttgagcatcttaaataattttgtttattttaaatttcaatgaaacatccaaccctcactgtcatcccttggatatacgtttttatttaggtgactgaatttttttcaacctttatggcttgtgatagaaaaattttaccctaacttaaaactaaaaaattggatattgtaatgttaatgtacctaatatgtttttgaatattctatgttttatatgttaaaaatactcaaacatgtttctaagtagaatatcatttacatttaaaaatacatttcaggatatgacttttctgaa

SEQ ID NO: 27098 - DNA, 2638 bp, Homo sapiens
ctggctggcgtccctctcggcagggtgctctttgccccatggggtgggatccagagctgcagacaggcccccaggcttggccaatgaacagaccaggttcggggagggtgttggaaaagagtggatggggtggttccccttaccttgcagcccccaggccctccccccctccctcccaggtggtcgggactcttgatcttcgctcgtggtactgtctgttcggctgtcttccccgcctctccccaggcacctgcatcctcccttggcacctgctgccaggctaggaagggcaaaaacaatcccagttggcgtagtcagggagtctccgccctcctcccaggtttcctcctcccaggcgcctcccctggacccgcccccatctgcccaagataattttagtttccttgggcctggaatctggacacacagggctcccccccgcctctgacttctctgtccgaagtcgggacaccctcctaccacctgtagagaagcgggagtggatctgaaataaaatccaggaatctgggggttcctagacggagccagacttcggaacgggtgtcctgctactcctgctggggctcctccaggacaagggcacacaactggttccgttaagcccctctctcgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagccatccaccgcacccaactctggttccacgggcgcatttcccgtgaggagagccagcggcttattggacagcagggcttggtagacggcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatacaaaaaaaaa

SEQ ID NO: 27099 - DNA, 864 bp, Homo sapiens
  misc_feature (806)..(806): n is a, c, g, or t
  misc_feature (839)..(839): n is a, c, g, or t
  misc_feature (862)..(862): n is a, c, g, or t
agttaagggcctggcgtctccctccctgaagacgtggtcccagccgggtgtcctgacgctcggggttcaggacaagggcacacaactggttccgttaagcccctctctcgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctgggaagcntttcctgaaaattcaagggcttttctgcaaacntgccgggggtttaaaggaccggnaa

SEQ ID NO: 27100 - DNA, 496 bp, Homo sapiens
cagtgagctgtgatcgtgccaccgcactagcatgagaccctgtctcaaaaagaaaaagaaaaagagaaacatcctggtggtagaggggaagggaggaggtcagacctgtcactctcctctgctctcctctggctcagaacttcctgaatgctggcagctttcctgagatccagggctttctgcagctgcggggttcaggacggaagctttggaaacgctttttctgcttcttgcgccgatctggcctctattactccaccaagggcacctctaaggtaaggtcttgagggtaccagccccagcccctccagtccctggtccttttagaagttgccccttctctgctggaacctctgagcccttctccccctgggccccccaggccagccacctccagtttaccatctctccctacatccttgcctagctcacctgcccagggaggtagcaggagaaaagatgatcttagtttaagtcctggctctacttctatttg

SEQ ID NO: 27101 - DNA, 349 bp, Homo sapiens
  misc_feature (4)..(5): n is a, c, g, or t
  misc_feature (10)..(10): n is a, c, g, or t
  misc_feature (13)..(13): n is a, c, g, or t
aggnntccgnttnatcattaaagacttatagcatcacttcactgtagtgatgcacaaatgtgccgctcccccggagtcctgcaatgagacacaggactcccagcaacctgtcctcctcaccaggcccctccagaggctccctggcccccagtgcgtctcccttttccctgcacaagaagtgggaggctgagtgcggagaattgcttgagtccaggagtttgagaccagcctgggcaacatggcaagaccctgtccctacaaaaaataaaaaaatgagccgggcatggtggtgtgcacctgtagtcccagcttctcaggaggctgaggtgggaggatcccttgttccttg

SEQ ID NO: 27102 - DNA, 2550 bp, Homo sapiens
ctggctggcgtccctctcggcagggtgctctttgccccatggggtgggatccagagctgcagacaggcccccaggcttggccaatgaacagaccaggttcggggagggtgttggaaaagagtggatggggtggttccccttaccttgcagcccccaggccctccccccctccctcccaggtggtcgggactcttgatcttcgctcgtggtactgtctgttcggctgtcttccccgcctctccccaggcacctgcatcctcccttggcacctgctgccaggctaggaagggcaaaaacaatcccagttggcgtagtcagggagtctccgccctcctcccaggtttcctcctcccaggcgcctcccctggacccgcccccatctgcccaagataattttagtttccttgggcctggaatctggacacacagggctcccccccgcctctgacttctctgtccgaagtcgggacaccctcctaccacctgtagagaagcgggagtggatctgaaataaaatccaggaatctgggggttcctagacggagccagacttcggaacgggtgtcctgctactcctgctggggctcctccaggacaagggcacacaactggttccgttaagcccctctctcgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatacaaaaaaaaa

SEQ ID NO: 27103 - DNA, 3181 bp, Homo sapiens
ctggctggcgtccctctcggcagggtgctctttgccccatggggtgggatccagagctgcagacaggcccccaggcttggccaatgaacagaccaggttcggggagggtgttggaaaagagtggatggggtggttccccttaccttgcagcccccaggccctccccccctccctcccaggtggtcgggactcttgatcttcgctcgtggtactgtctgttcggctgtcttccccgcctctccccaggcacctgcatcctcccttggcacctgctgccaggctaggaagggcaaaaacaatcccagttggcgtagtcagggagtctccgccctcctcccaggtttcctcctcccaggcgcctcccctggacccgcccccatctgcccaagataattttagtttccttgggcctggaatctggacacacagggctcccccccgcctctgacttctctgtccgaagtcgggacaccctcctaccacctgtagagaagcgggagtggatctgaaataaaatccaggaatctgggggttcctagacggagccagacttcggaacgggtgtcctgctactcctgctggggctcctccaggacaagggcacacaactggttccgttaagcccctctctcgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagccatccaccgcacccaactctggttccacgggcgcatttcccgtgaggagagccagcggcttattggacagcagggcttggtagacggcctgttcctggtccgggagagtcagcggaacccccagggctttgtcctctctttgtgccacctgcagaaagtgaagcattatctcatcctgccgatgtgccgctcccccggagtcctgcaatgagacacaggactcccagcaacctgtcctcctcaccaggcccctccagaggctccctggcccccagtgcgtctcccttttccctgcacaagaagtgggaggctgagtgcggtggctcacacctgtaatcccagcacttaggacggccaaggtgggagaatggcttgagcccaggagttcgagaccagcctgggcaacacagggagaccccatctctacaaataatttaaaaatgagccaggcatggtggtgcacacctgtagtccagctactcaggaggctgaggtgggagcattgcttgagcccagagggtcaaggctgcagtgagccatggtggcaccaccacactccagcctggatgacacagtgagaaaactgtctcaaaaaaaaaaaaagaaagaaaaagaaaaagaaaaaagaaaagaataaaaggaaatggtggggccctggcccaggagggagcttcccaagcctcgggcccctccctgaacttccaccccctttactgtaccccagagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatacaaaaaaaaa

SEQ ID NO: 27104 - DNA, 2662 bp, Homo sapiens
ctggctggcgtccctctcggcagggtgctctttgccccatggggtgggatccagagctgcagacaggcccccaggcttggccaatgaacagaccaggttcggggagggtgttggaaaagagtggatggggtggttccccttaccttgcagcccccaggccctccccccctccctcccaggtggtcgggactcttgatcttcgctcgtggtactgtctgttcggctgtcttccccgcctctccccaggcacctgcatcctcccttggcacctgctgccaggctaggaagggcaaaaacaatcccagttggcgtagtcagggagtctccgccctcctcccaggtttcctcctcccaggcgcctcccctggacccgcccccatctgcccaagataattttagtttccttgggcctggaatctggacacacagggctcccccccgcctctgacttctctgtccgaagtcgggacaccctcctaccacctgtagagaagcgggagtggatctgaaataaaatccaggaatctgggggttcctagacggagccagacttcggaacgggtgtcctgctactcctgctggggctcctccaggacaagggcacacaactggttccgttaagcccctctctcgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccattcgtgtgcaattcctggggcgcaggtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagccatccaccgcacccaactctggttccacgggcgcatttcccgtgaggagagccagcggcttattggacagcagggcttggtagacggcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatacaaaaaaaaa

SEQ ID NO: 27105 - DNA, 1958 bp, Homo sapiens
agttaagggcctggcgtctccctccctgaagacgtggtcccagccgggtgtcctgacgctcggggttcaggacaagggcacacaactggttccgttaagcccctctctcgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagccatccaccgcacccaactctggttccacgggcgcatttcccgtgaggagagccagcggcttattggacagcagggcttggtagacggcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatacaaaaaaaaa

SEQ ID NO: 27106 - DNA, 2651 bp, Homo sapiens
ctggctggcgtccctctcggcagggtgctctttgccccatggggtgggatccagagctgcagacaggcccccaggcttggccaatgaacagaccaggttcggggagggtgttggaaaagagtggatggggtggttccccttaccttgcagcccccaggccctccccccctccctcccaggtggtcgggactcttgatcttcgctcgtggtactgtctgttcggctgtcttccccgcctctccccaggcacctgcatcctcccttggcacctgctgccaggctaggaagggcaaaaacaatcccagttggcgtagtcagggagtctccgccctcctcccaggtttcctcctcccaggcgcctcccctggacccgcccccatctgcccaagataattttagtttccttgggcctggaatctggacacacagggctcccccccgcctctgacttctctgtccgaagtcgggacaccctcctaccacctgtagagaagcgggagtggatctgaaataaaatccaggaatctgggggttcctagacggagccagacttcggaacgggtgtcctgctactcctgctggggctcctccaggacaagggcacacaactggttccgttaagcccctctctcgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagccatccaccgcacccaactctggttccacgggcgcatttcccgtgaggagagccagcggcttattggacagcagggcttggtagacggcctgttcctggtccgggagagtcagcggaacccccagggctttgtcctctctttgtgccacctgcagaaagtgaagcattatctcatcctgccgatgtgccgctcccccggagtcctgcaatgagacacaggactcccagcaacctgtcctcctcaccaggcccctccagaggctccctggcccccagtgcgtctcccttttccctgcacaagaagtgggaggctgagtgcggtggctcacacctgtaatcccagcacttaggacggccaaggtgggagaatggcttgagcccaggagttcgagaccagcctgggcaacacagggagaccccatctctacaaataatttaaaaatgagccaggcatggtggtgcacacctgtagtccagctactcaggaggctgaggtgggagcattgcttgagcccagagggtcaaggctgcagtgagccatggtggcaccaccacactccagcctggatgacacagtgagaaaactgtctcaaaaaaaaaaaaagaaagaaaaagaaaaagaaaaaagaaaagaataaaaggaaatggtggggccctggcccaggagggagcggcacataggtgggtgaccaaaagagtcgagtcatgcgacggagctaagacaagaaacagaaccct

SEQ ID NO: 27107 - DNA, 1160 bp, Homo sapiens
ggatcgtttcttgatttagctctgatgtatgactcgactcttaggatcacccacccatgtgccgcccccaacgcatgtgccgctcccccggagtcctgcaatgagacacaggactcccagcaacctgtcctcctcaccaggcccctccagaggctccctggcccccagtgcgtctcccttttccctgcacaagaagtgggaggctgagtgcggtggctcacacctgtaatcccagcacttaggacggccaaggtgggagaatggcttgagcccaggagttcgagaccagcctgggcaacacagggagaccccatctctacaaataatttaaaaatgagccaggcatggtggtgcacacctgtagtccagctactcaggaggctgaggtgggagcattgcttgagcccagagggtcaaggctgcagtgagccatggtggcaccaccacactccagcctggatgacacagtgagaaaactgtctcaaaaaaaaaaaaagaaagaaaaagaaaaagaaaaaagaaaagaataaaaggaaatggtggggccctggcccaggagggagcttcccaagcctcgggcccctccctgaacttccaccccctttactgtaccccagagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatacaaaaaaaaa

SEQ ID NO: 27108 - DNA, 1665 bp, Homo sapiens
ctggctggcgtccctctcggcagggtgctctttgccccatggggtgggatccagagctgcagacaggcccccaggcttggccaatgaacagaccaggttcggggagggtgttggaaaagagtggatggggtggttccccttaccttgcagcccccaggccctccccccctccctcccaggtggtcgggactcttgatcttcgctcgtggtactgtctgttcggctgtcttccccgcctctccccaggcacctgcatcctcccttggcacctgctgccaggctaggaagggcaaaaacaatcccagttggcgtagtcagggagtctccgccctcctcccaggtttcctcctcccaggcgcctcccctggacccgcccccatctgcccaagataattttagtttccttgggcctggaatctggacacacagggctcccccccgcctctgacttctctgtccgaagtcgggacaccctcctaccacctgtagagaagcgggagtggatctgaaataaaatccaggaatctgggggttcctagacggagccagacttcggaacgggtgtcctgctactcctgctggggctcctccaggacaagggcacacaactggttccgttaagcccctctctcgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggtaaggtcttgagggtaccagccccagcccctccagtccctggtccttttagaagttgccccttctctgctggaacctctgagcccttctccccctgggccccccaggccagccacctccagtttaccatctctccctacatccttgcctagctcacctgcccagggaggtagcaggagaaaagatgatcttagtttaagtcctggctctacttctatttg

SEQ ID NO: 27109 - DNA, 1745 bp, Homo sapiens
ctggctggcgtccctctcggcagggtgctctttgccccatggggtgggatccagagctgcagacaggcccccaggcttggccaatgaacagaccaggttcggggagggtgttggaaaagagtggatggggtggttccccttaccttgcagcccccaggccctccccccctccctcccaggtggtcgggactcttgatcttcgctcgtggtactgtctgttcggctgtcttccccgcctctccccaggcacctgcatcctcccttggcacctgctgccaggctaggaagggcaaaaacaatcccagttggcgtagtcagggagtctccgccctcctcccaggtttcctcctcccaggcgcctcccctggacccgcccccatctgcccaagataattttagtttccttgggcctggaatctggacacacagggctcccccccgcctctgacttctctgtccgaagtcgggacaccctcctaccacctgtagagaagcgggagtggatctgaaataaaatccaggaatctgggggttcctagacggagccagacttcggaacgggtgtcctgctactcctgctggggctcctccaggacaagggcacacaactggttccgttaagcccctctctcgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccagtgagtgcatgagggctgtctgggcgctgggatgccctgatcctcaacctggatgctggagccctgatccctgacacttgtctacccacagcactccctgttcccagaaaaaatggtctccagctgtctcgatgcacacactggtatatcccatgaagacctcatccaggtggggggaccccccatttcactgcagattcacgactccccagcattggccagtgcttctccacccttaagtcctgtgcctcccctctatgttgtagaaagagccaaatcacagtcctgtgtgactggggacagtcactttccctgcctgagcatcagtttcttctattaaatgggggcgagaaatgcatgtggagcatttccttgtaaaaacctgagggtgggctgggcacggtggctcatgcctataatcccagcactttgggaggctgaggcgggaggattacttaagcctagaagtttgagagtttgagaccagcctgggcaacataatgagacctcgtctctc

SEQ ID NO: 27110 - DNA, 987 bp, Homo sapiens
ctggctggcgtccctctcggcagggtgctctttgccccatggggtgggatccagagctgcagacaggcccccaggcttggccaatgaacagaccaggttcggggagggtgttggaaaagagtggatggggtggttccccttaccttgcagcccccaggccctccccccctccctcccaggtggtcgggactcttgatcttcgctcgtggtactgtctgttcggctgtcttccccgcctctccccaggcacctgcatcctcccttggcacctgctgccaggctaggaagggcaaaaacaatcccagttggcgtagtcagggagtctccgccctcctcccaggtttcctcctcccaggcgcctcccctggacccgcccccatctgcccaagataattttagtttccttgggcctggaatctggacacacagggctcccccccgcctctgacttctctgtccgaagtcgggacaccctcctaccacctgtagagaagcgggagtggatctgaaataaaatccaggaatctgggggttcctagacggagccagacttcggaacgggtgtcctgctactcctgctggggctcctccaggacaagggcacacaactggttccgttaagcccctctctcgctcagacgccatggagctggatctgtctccacctcatcttagcagctctccggaagacctttgcccagcccctgggacccctcctgggactccccggccccctgataccccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatacaaaaaaaaa

SEQ ID NO: 27111 - DNA, 417 bp, Homo sapiens
cagaagggaagggagggatgcacgggttctgggtctgtgggagatacacagccgcttccatggaggcaggggatcttggttaggagtccctgagggtctagcaggtgcggaaagggaatgaatcaccctttgcctcccctcaagtcgtgtgcaattcctggggcgcaggtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactgggtaagtcaggtgcatggaactatccgggctgggagatgatgccttgcatcttgggctaggcatgtggctcatccaggagatctggttgatct

SEQ ID NO: 27112 - DNA, 154 bp, Homo sapiens
cttctcctagctctggaggtgctgctctagggcagggaattatgggagaagtgggggcagcccaggcggtttcacgccccacactttgtacagaccgagaggccagttgatctgctctgttttatactagtgacaataaagattattttttgat

SEQ ID NO: 27113 - DNA, 414 bp, Homo sapiens
tacgtggcagatgtgaacgagtccaacgtgtacgtggtgacgcagggccgcaagctctacgggatgcccactgacttcggtttctgtgtcaaggtgaagacctggccaggcctggcccctggcctggggaagcaggaactgctcaggcccctggatcctgcccggggcttctgagccccaattcagacacctagactcctctccctgcaccctggcctgctggaaactcctggattcagctctgctatgtggagcaggggcagacatgtggtcctaaaggcagatatgggaccagtcaatttcctctctctgcagcccaacaagcttcgaaatggccacaaggggcttcggatcttctgcagtgaagatgagcagagccgcacctgctggctggctgccttccgcctcttcaag

SEQ ID NO: 27114 - DNA, 428 bp, Homo sapiens
aagaagacaaaccaccgcctcagcctgcccatgccagcctccggcacgagcctcagtgcaggtgggtgacggccccgagtcctggggcgggggctgcctcaacttctctttgtattcccagtggggagtagatggtataggggtcccctccccaaagtgaccgcccatgtccttccccaccacagccatccaccgcacccaactctggttccacgggcgcatttcccgtgaggagagccagcggcttattggacagcagggcttggtagacgggtaaggggcagggccgggcaacagacccagggataagagagactggggtccaggtggcagccatggtccttgggtagtaatgctgccccatctcctgtcttctggcagcctgttcctggtccgggagagtcagcggaacccccagggctttgtcc

SEQ ID NO: 27115 - DNA, 2551 bp, Homo sapiens
ctggctggcgtccctctcggcagggtgctctttgccccatggggtgggatccagagctgcagacaggcccccaggcttggccaatgaacagaccaggttcggggagggtgttggaaaagagtggatggggtggttccccttaccttgcagcccccaggccctccccccctccctcccaggtggtcgggactcttgatcttcgctcgtggtactgtctgttcggctgtcttccccgcctctccccaggcacctgcatcctcccttggcacctgctgccaggctaggaagggcaaaaacaatcccagttggcgtagtcagggagtctccgccctcctcccaggtttcctcctcccaggcgcctcccctggacccgcccccatctgcccaagataattttagtttccttgggcctggaatctggacacacagggctcccccccgcctctgacttctctgtccgaagtcgggacaccctcctaccacctgtagagaagcgggagtggatctgaaataaaatccaggaatctgggggttcctagacggagccagacttcggaacgggtgtcctgctactcctgctggggctcctccaggacaagggcacacaactggttccgttaagcccctctctcgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagccatccaccgcacccaactctggttccacgggcgcatttcccgtgaggagagccagcggcttattggacagcagggcttggtagacggcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatacaaaaaaaaa

SEQ ID NO: 27116 - DNA, 632 bp, Homo sapiens
  misc_feature (622)..(622): n is a, c, g, or t
ggatcgtttcttgatttagctctgatgtatgactcgactcttaggatcacccacccatgtgccgcccccaacgcatgtgccgctcccccggagtcctgcaatgagacacaggactcccagcaacctgtcctcctcaccaggcccctccagaggctccctggcccccagtgcgtctcccttttccctgcacaagaagtgggaggctgagtgcggtggctcacacctgtaatcccagcacttaggacggccaaggtgggagaatggcttgagcccaggagttcgagaccagcctgggcaacacagggagaccccatctctacaaataatttaaaaatgagccaggcatggtggtgcacacctgtagtccagctactcaggaggctgaggtgggagcattgcttgagcccagagggtcaaggctgcagtgagccatggtggcaccaccacactccagcctggatgacacagtgagaaaactgtctcaaaaaaaaaaaaagaaagaaaaagaaaaagaaaaaagaaaagaataaaaggaaatggtggggccctggcccaggagggagcggccaggcgtttgggctcaactagagttaatagtgcgtactgagctagacacatgaanccagatcccg

SEQ ID NO: 27117 - DNA, 2115 bp, Homo sapiens
agttaagggcctggcgtctccctccctgaagacgtggtcccagccgggtgtcctgacgctcggggttcaggacaagggcacacaactggttccgttaagcccctctctcgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagccatccaccgcacccaactctggttccacgggcgcatttcccgtgaggagagccagcggcttattggacagcagggcttggtagacggcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatacaaaaaaaaa

SEQ ID NO: 27118 - DNA, 2501 bp, Homo sapiens
ctggctggcgtccctctcggcagggtgctctttgccccatggggtgggatccagagctgcagacaggcccccaggcttggccaatgaacagaccaggttcggggagggtgttggaaaagagtggatggggtggttccccttaccttgcagcccccaggccctccccccctccctcccaggtggtcgggactcttgatcttcgctcgtggtactgtctgttcggctgtcttccccgcctctccccaggcacctgcatcctcccttggcacctgctgccaggctaggaagggcaaaaacaatcccagttggcgtagtcagggagtctccgccctcctcccaggtttcctcctcccaggcgcctcccctggacccgcccccatctgcccaagataattttagtttccttgggcctggaatctggacacacagggctcccccccgcctctgacttctctgtccgaagtcgggacaccctcctaccacctgtagagaagcgggagtggatctgaaataaaatccaggaatctgggggttcctagacggagccagacttcggaacgggtgtcctgctactcctgctggggctcctccaggacaagggcacacaactggttccgttaagcccctctctcgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagccatccaccgcacccaactctggttccacgggcgcatttcccgtgaggagagccagcggcttattggacagcagggcttggtagacggcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggatggactctggggcgcggccacaggggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatacaaaaaaaaa

SEQ ID NO: 27119 - DNA, 2216 bp, Homo sapiens
ctggctggcgtccctctcggcagggtgctctttgccccatggggtgggatccagagctgcagacaggcccccaggcttggccaatgaacagaccaggttcggggagggtgttggaaaagagtggatggggtggttccccttaccttgcagcccccaggccctccccccctccctcccaggtggtcgggactcttgatcttcgctcgtggtactgtctgttcggctgtcttccccgcctctccccaggcacctgcatcctcccttggcacctgctgccaggctaggaagggcaaaaacaatcccagttggcgtagtcagggagtctccgccctcctcccaggtttcctcctcccaggcgcctcccctggacccgcccccatctgcccaagataattttagtttccttgggcctggaatctggacacacagggctcccccccgcctctgacttctctgtccgaagtcgggacaccctcctaccacctgtagagaagcgggagtggatctgaaataaaatccaggaatctgggggttcctagacggagccagacttcggaacgggtgtcctgctactcctgctggggctcctccaggacaagggcacacaactggttccgttaagcccctctctcgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagccatccaccgcacccaactctggttccacgggcgcatttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatacaaaaaaaaa

SEQ ID NO: 27120 - DNA, 1979 bp, Homo sapiens
ctggctggcgtccctctcggcagggtgctctttgccccatggggtgggatccagagctgcagacaggcccccaggcttggccaatgaacagaccaggttcggggagggtgttggaaaagagtggatggggtggttccccttaccttgcagcccccaggccctccccccctccctcccaggtggtcgggactcttgatcttcgctcgtggtactgtctgttcggctgtcttccccgcctctccccaggcacctgcatcctcccttggcacctgctgccaggctaggaagggcaaaaacaatcccagttggcgtagtcagggagtctccgccctcctcccaggtttcctcctcccaggcgcctcccctggacccgcccccatctgcccaagataattttagtttccttgggcctggaatctggacacacagggctcccccccgcctctgacttctctgtccgaagtcgggacaccctcctaccacctgtagagaagcgggagtggatctgaaataaaatccaggaatctgggggttcctagacggagccagacttcggaacgggtgtcctgctactcctgctggggctcctccaggacaagggcacacaactggttccgttaagcccctctctcgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgcctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatacaaaaaaaaa

SEQ ID NO: 27121 - DNA, 1654 bp, Homo sapiens
ctggctggcgtccctctcggcagggtgctctttgccccatggggtgggatccagagctgcagacaggcccccaggcttggccaatgaacagaccaggttcggggagggtgttggaaaagagtggatggggtggttccccttaccttgcagcccccaggccctccccccctccctcccaggtggtcgggactcttgatcttcgctcgtggtactgtctgttcggctgtcttccccgcctctccccaggcacctgcatcctcccttggcacctgctgccaggctaggaagggcaaaaacaatcccagttggcgtagtcagggagtctccgccctcctcccaggtttcctcctcccaggcgcctcccctggacccgcccccatctgcccaagataattttagtttccttgggcctggaatctggacacacagggctcccccccgcctctgacttctctgtccgaagtcgggacaccctcctaccacctgtagagaagcgggagtggatctgaaataaaatccaggaatctgggggttcctagacggagccagacttcggaacgggtgtcctgctactcctgctggggctcctccaggacaagggcacacaactggttccgttaagcccctctctcgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccaggtggggggaccccccatttcactgcagattcacgactccccagcattggccagtgcttctccacccttaagtcctgtgcctcccctctatgttgtagaaagagccaaatcacagtcctgtgtgactggggacagtcactttccctgcctgagcatcagtttcttctattaaatgggggcgagaaatgcatgtggagcatttccttgtaaaaacctgagggtgggctgggcacggtggctcatgcctataatcccagcactttgggaggctgaggcgggaggattacttaagcctagaagtttgagagtttgagaccagcctgggcaacataatgagacctcgtctctc

SEQ ID NO: 27122 - DNA, 367 bp, Homo sapiens
agatgagcagagccgcacctgctggctggctgccttccgcctcttcaaggtgagaccctgggagtggcatggggggctggcctggccagagggatccccagctctgccctcaggaagtctcaggaatgaggagggcatcacagccttgctctctgataacccccagtccaagcctgaagttataggaagtgcccatcgaaggcagaaacacagccctggtctgggcaagtcctggtctgaggggggcgtcacagccacgcccccaggacctctcgacctcaagctctctttctctccccacccccagtacggggtgcagctgtacaagaattaccagcaggcacagtctcgccatctgcatccatct

SEQ ID NO: 27123 - DNA, 523 bp, Homo sapiens
ccacctcagcctcctgagtagctggcacaggcgctacctcacccatctaattttttattttttttagagatggggttttgccatgtttgcccaagctggtctagaattcatgagctcaagtgatctacctgcctcggcctcccaatgtgctgggattacagacatgagccactatgttcagccatacctggctaatttttaaaaaatgttttcaagagacagggtctccctgtgttgcccaggttggtctcaagttcctgggattactgctggccttcaaaagtaaatgtgaaataattagttaatttctccctcagttgacaaataatgccaaaagtgataaagattaatgaaatgtctcattaaaaaaaaaaaaaaagaggtaaaatttaaataacttaaggctgattgtattggcttacacttgtaattccagcattttgggagaccaaggcaggaggatcacttgaactcagaagtttgagaccagcctggtcaacatagggaaacctcatctccacaa

SEQ ID NO: 27124 - DNA, 228 bp, Homo sapiens
aattagaaagaaagaggaagtgtggtgagtttactttttggaataaaagcacaaagcagaaaaccaatgggacacccagttactttgtcaacagtatgccaaacactaattttggaagatcctgttaaacttggtatagtccctgagtattatttttattctccattgtctgtttcccagttgtgatcatataatagtaaaactcacctaatgaaagcacctgcttcc

SEQ ID NO: 27125 - DNA, 2129 bp, Homo sapiens
  misc_feature (1808)..(1808): n is a, c, g, or t
tgagccgagatcgcgccactgcactccagcctgggcgacagagcgagactccgtgggcttggcggcggggcaggattccaggcaggagccttgcctctcaggtggcgggctctgcgaccctgcgagatggacgggacagaaggcagtgccgggcagcccggccccgctgagcgatcccaccgaagcagcgtgtcctccgtgggagcccgagcggctgacgtgctggtatacctagcggatgacacggtggtgcccctggctgtggagaacctgccctcgctcagtgcccatgagctgcaccgcgctgtccgcgaggtcctgcagcttccagacatcgccctggatgtcttcgcgctctggctggtctcccctctgctggaggtgcagctgaaacccaagcaccagccctacaagctgggacgccagtggccggagctgctgctgcgcttcaccagtgccccagatgatgacgtggccatggatgagcctttcctgcagttccgaaggaacgtgttcttcccaaagcggcgggagctccagatccatgacgaggaggtcctgcggctgctctatgaggaggccaagggcaacgtgctggctgcacggtacccgtgcgacgtggaggactgcgaggctctgggcgccctggtgtgccgcgtgcagcttgggccctaccagcccggccggccggcagcctgcgacctgagggagaagctggactccttcctccctgcccacctctgtaagcggggccagagtctctttgctgccctccggggccgtggggccagggccgggccgggcgagcagggcctgctgaacgcctaccgccaggtgcaggaggtcagcagcgacggcgggtgcgaggccgccctgggcacccactaccgcgcctatctcctcaagtgccacgagctgccgttttatgggtgtgccttcttccacggtgaggttgacaagccggcccaaggctttttgcaccggggtgggcgcaagccagtttctgtggccatcagtctggaaggcgtgcacgtcatcgatagcagagagaagcatgtcctgctgggcctgcgcttccaggagctgtcgtgggaccacacctcccccgaggaggaggagcccatcttgtggctggagttcgacggggacagcgagggcacacctgtcaacaagctcctcaagatctactccaagcaggccgaactgatgagcagtctcattgagtactgcatcgaactgagccaggcggcggagcccgcaggcccccaggacagtgcgactggctcgccctcggaccccagctcctcactggctcctgttcagcgccccaagctgcggaggcagggcagtgtggtgtccagccggatccagcatctctccaccatcgactacgtggaggacggcaaggggatcaggcgagtgaagccgaagcgcaccacatccttcttcagccggcagctgtccttgggccaggggagctacaccgtggtgcagcccggcgacagcctggagcagggctgaggacgctgcacccggcaggaggagggcgactgggggccctggcccggcactgtcctcctgaggggcaggcgccggctgcaacagtctcatgggtcaccacgtggggagggctgcctcagcaggtttctcagaccacggagaagtgacttttgggcccggggccatgcccgggctgtgcaaagctggccagggcctcctgtagggctcctctgcagcctgccctgccttcccccggatgctgggccctgctgctctctcaggaccatccgatcaagctgcagctgccnacctcacctagaaacatgcctttgtgcccacctcaagatgggcagtgtccctgttctgaagtgccagtggcagctccagtggtagaggaccacgcttgaggtttgggacctgaagctccagtgtggtgcctttggcctcttccctggactgggttgaccgtctcgtcttcctcctgctagtgctccaccccgcgggacttgggtgaaccagtttccaacattcctccggatggtgctcaattaccccaataaccaggtggggcacccattctgaagaagggtaggaaggggcgaccccgggattgtaacgggggccagaaa

SEQ ID NO: 27126 - DNA, 421 bp, Homo sapiens
cctctgacatgggggctaaatgctactgaaaggtggaagctgccaggtttcttgagtcttaagcctgtaattttcacattgttatgagcatgaataatgggatgtgtgatacattggggcccccaagtaaaatctatcatacaaagctgtttgaagaatatcatcgacaagccatactcgcaggaagcggtctgactatgatgcaatggataaaaagagactctctgaataaaaatataataataatcagggaaatgcaaatcgaaaccactatgagacattacctacatcagttaaaatagctagtatcaaggaaccaagagaaaacaagtgttggtgagtttgtggagaaaaggaaaccctcatacactgtcattgagaatgtaaattagggcagccattatggaaaacaacatggagg

SEQ ID NO: 27127 - DNA, 298 bp, Homo sapiens
tctcaaactgcaatgaggaactcacaataccaaacaaacatacagaaactaaacaacttgcttctgaatggcttttgttgggtaaataacgaaattaagacagaaataaaaaaattctttgaaacatatggaaatggagatacaacatagcaaaacctgtgggatatagaaaagaagtgttaagaggaaagtttacagcactaaacacctaaatcaagaagacagaaagatctcaaactaacaacctaaccttacatctgaaagaactagaaaaaacaaacaacccaaagctagcagg

SEQ ID NO: 27128 - DNA, 407 bp, Homo sapiens
ctccctgccctggaaccctggatgtcagcacctgactcctacctgctgtgacattggcaaaagtagctgtggcagaggccgagggtcccacctgcttactgggccccgcttctccggacaggagcagaagctgcagagctttgggacctcagcacttgagcagcatgtggacgcgagcagcgagtaaccccgggctcccagagacgcgtgacggggtccccagggggttgcttgagggccctcaagtcaggagctgatttctatcctcaaatatttaagcatccccaagcccaggtgcggtggctcacacctataatcccagtactttaggaggccgagatggggggatcacttgagcctgggagtttgagaccaccgtgggcaacatagcaagactccagctctac

SEQ ID NO: 27129 - DNA, 204 bp, Homo sapiens
tgaattggaataaataaattttatagtagtcagtactgaaacaagaaatactttaatttagcttgtatacaacatataggctatgttactagaaaaaagttttaaggacatactgtacaagttgtactttataatgattatcttcttgtatgcgcaattaaatgtacacacatgaccagaaattaaataatatattcctattct

SEQ ID NO: 27130 - DNA, 456 bp, Homo sapiens
cgtttaattgacttacagttcagcatggctggggagacttcaggaaacttaaaatcatggcagaagcgggagcaaacctccttcttcacagggctgcaggaaggagaagtgaggagcaaggagggaaaagccccttagaaaaccatcagatcttgtgatacctcactcactatcagagaacagcatgggaataaccacccccatgattcagttacctcccaccgggtccctcccacaacacctggggattatggtaactacagttcaagatatggtttggctgtgtgtccccacccaaatctcaccttaaattgtaatccccaggagtctggtgggaggtgattgaatcatggggcgaacttcccccttgctcttctcatgatagtgagttctcatgagatcaggttttttgaaagtgtctggcacttccccctcactcattctctctctctggca

SEQ ID NO: 27131 - DNA, 400 bp, Homo sapiens
aaaaaaaaaaaaaaaaaaaaaaaaagcaaatgaaaatcttagaaccatagaacgtagtatccaaaataaaaatggatgggctggatagcagaaggtagctcatcactcactgtaaccttgaactcctgggctccagtaatcctcccgcttcagcctcctgattagctgggactgcaggggtataccaccatgcctggctaatcttgggttattttattatagctgctttacaatctgataattccaacaactgtgtcatcttgggcattggcatctgttgattgtctttttccatatgaattgagattttcctgggttctttgtatgccaagtaatttaggaattatatcgtgggacatttgtttattatgttatggggactctggtcttgtttaaatcc

SEQ ID NO: 27132 - DNA, 324 bp, Homo sapiens
tgggattattggcatgagccaccacacccagccccaaatgatcttacatgttaagaaacaacaaagatttattgacatgtttgttgcctgacttctttgttagaatgtaagcttcatgaacaagaagatactgggtctgcaatttttgtcattgaattcccacctagaacagttcctgggatagagcaggcactaaaaaaccatttgtcaaatgggcaaataaatctctaagtaggtattaagatttgggaaaactttgagggggacttttcctttcactgtggctcaaccatgttagctttgagaagctaataagaaaggaaa

SEQ ID NO: 27133 - DNA, 386 bp, Homo sapiens
aaatgtcaccacaatcttccttcctttgcattttcttattgtgcactaagttagttcttgcttagtaagtcttgtctttctctctgctttgacctgtcagtattccaacttccttattttttgatgttcattttctccttgctctctttcttcctttcttgtctgtgaactccattaaccgcttctgcatgtgaccattaatgtgcctgtctttcttctcatgtattagagagaacaaaagctttgggaatcagacagatctgtgttctgatcctgtcttatggtatctgtcttgtttgtctcggcttaaaatggggataatatctacctctcagttttgttggcagttcagtacacggaaataaagttctcactttcttttttaa

SEQ ID NO: 27134 - DNA, 1323 bp, Homo sapiens
tgcgaaactccagtctctgcccccaccttcacatcatcttctccatgtctccttaccttcctttgcctctgtcttgaaaagacactgtgatggcatttaggacccacccagctaattcagtgtgttctcatctgcagatccttgatcaagtcacatttgcagagacctctttttcaaataagagacgaggtctcactatgttggccaggttggtctcgaattcctggccgcaagccgttctccagtctgggcctcccaaagtgctaggattacaggaacagaattgccattgggcccagggagagactacacttcttgtctgctttgttgctagtgcggccttgtggccaagcacagaacgtgtgcagtgatgatggtgcaacttctaggtcgtccccagcatggaaaatgagccctgggcatggaagatgagccctggtcctgcagcggtgctctttcctcttctcacaagctggaatgtgcatgtgctcccacccagctttgaccatggggcgaaaacagtactctgcagtctggcagagcaacaaggtggaaagggcctgggtccttgagtgacgtcatgagccctctcactgtcccgactttgggactgttatatgataaggactttctgtgagtcactgtcttttagagtctctctgttttagctgcctggactttatcctgaataatatggctgttatcatgggtatagtgttactatgagcctcatctaagtaatttctactctgcctttgaccactaaactcatgttggacaagagtcacttagcattattttttcctcaatgaagaggttaagatggagggagcaggagaaattgaggcctgtgttttaccagaaggtgaagggctgtctttgcctttcctacatttatgaaggataattctagacaaaaacattaagttcatatcaaaccatctgctttgtgaagccatgggctttgctagaactttctgtgacatgacatttattaacccgagtctacctggaagttagagctgaggaagttttcctagagtggaaaaagtccaatgcacttgtaaaagtcagaccaagctcagctcagatttcagttttattagaagtatgtcaccttcctgagcccttattatttccccatctgtgaaatgaggacaccgttctctctttctaagcattgctgggaagaccacacaccactgagacagaaggtggggctagcgcagttctgggcattttgtacacccccaacaaatactgatttatttccttctttttccttgctcagaaaaaattggagaaggctttattttaaaattc

SEQ ID NO: 27135 - DNA, 840 bp, Homo sapiens
tctaagaatttgtctctttgtattgagctcaattatgttttacaattaactccctctaaaatgcataagcttatagggctggctactatatgccaggttttatgaattaactcttgatgaaaatacaaaaattgatctaaaatattgaatgtgtagaacctttatggggaaatgattctttgctcttttgtctgtactggatttttcaaaatctttattggtaaaaagaaagaatgtatttctaagaattgttgcaaccatacagggcagccatggagctgactctacattttgttttaaaaatgttgttttatacctgcactatttatttaggagggtcctcttggtagctctttaacccatttattaagattagaagaggttccaccagcaaacaaaagacaactaatctgagtctgtttgaaagcagactgaagcacccactttcacaagacaggccagggctggattccatcctagatggccaagagaaccctctctaaacaataggggtttaaaatgtttttgaagtagcaaggcggtctccactcaggaaaataaaaagttaataagatgatgtggcaagtcctctgatggtgttcgtagagccatttaaggagcaaaatataacttccttaaaaaatcttttttacattagttgtaaggctctctttatcctctgcagagaatggagaagaagcatttacttggcatgtttgaaaattttgcttgagcagacatcaacagtataaatataagaagcaggaaggactatctagaaagaaaagaaacctgggaatcatagttgacttggatgtaaacgtgagtctgcaatgaggt

SEQ ID NO: 27136 - DNA, 630 bp, Homo sapiens
  misc_feature (513)..(513): n is a, c, g, or t
ggtactcagatagtaattagtaaacattttcataaataatcttaaccttttcaagcatttttgtcgattggattgtagcactcaaaagtaaggtctgttttactaatataaaattgggcctgtggaataattctcttcacagaagtgtgtgtgtgtgtgagagagagagaaaatgtatatgcatacatatacatatattattgagacataatttacataatttatgttctataaaattagcatattttaaatatacagttctctggattttgaaaaatgtatacgtgtacataatcatgggtccaccaccccagttaagatatagaacattccagggccaggttcagtggatcatgcttgtaatcgcagcatgttgggaggctgaggagggtggaccacttgaggccaggagtttgagatcagtctgggcaacagggtgaaaccccgcctccactaaaaatacaaaaaaaagaaaaaaaaaaagaaaaaaatagctggccattgtgacatatncctgtaaccgtagctactctggtggctgaggcttgagtatcgcctgggaggcagaggttgcagtgagccaagatggcactgctgcactctagcctgggtgacagtgagactgtcttt

SEQ ID NO: 27137 - DNA, 440 bp, Homo sapiens
gacttcttttatgacctaacatatgatctatcctgcagaatgatccatgtgcacttgagaagaatgtatactctgctgctgttggatggaatgttctgcacatgtctgtaggtgacttgacttgcagtgttgatcaggtcatctgggtctttgttgcctttatgtttggttgttctatccattattaaaagtgagcactgaaatctcctactgttattgtattgctatctatttctcccttaagttcagtcaatgtttgctttatacctttagatactctgatgttgggtgcatatatatttaaaattattgtatcctccaatgtgaattgacgcctttatcattatgtaatatccttctttttttcttgtgacaatttttgacttaaagtctattttttataatatcagtaaaggcattttttgttgtcttttagttat

SEQ ID NO: 27138 - DNA, 338 bp, Homo sapiens
atagacttgtatgagtgagtggattagtgtacatctatttcctccctctgtctgctgattacacaggattctttcaaagccacttcgctagccggaaatctctgtggccagcaagcagcgcctctgatcaggctttgctgcgagaaaacctcaaaacccaaacaacaaaaacaaaaaacacacacagaagaagagttattctgtgccaactgcagttctatgcttggcctgtggctgggccaggcatgcggcgacctgcttctgacttggaaatcgacatctggatgaggggaacgcagcggcacccaaaaactcagagatgccagcaacggcagagc

SEQ ID NO: 27139 - DNA, 284 bp, Homo sapiens
gacagggctgccacataatatggcatgtggatccttctaggaaaaaggatccaggagataatgagagatcacctaagacagaagacaatctttttataacattatcttagaagtgacatccatcacttttgatcaattctttttattagaattgagtcaataagccagtactacatttatggagagaaaagtattcagggttatgaataccaggaggtggggatcattgaagaccattgtaggagctacatattatggatgtgtaagaagggacagagattttt

SEQ ID NO: 27140 - DNA, 410 bp, Homo sapiens
cgtcgtgatccagaagtccagagctgagactgcctgtttgcaggtgctgtcattcagagtccacaggatggatgaatggatatgaaaatgaacaaacgtgtgacacaacactgcatgatttacctgcaatgactttctgatcaagcctgaacatcccaagacaaccatgctgtgaagaagtcggtctaccccactggagaaggaaaggctgttcagggaagtgaagatgccccagctgacagtcaccacctgccagacatgtgagcaaggctgtctgagaccttcagtctcagtcaagccatcagaaagttgcagccagttgagtgatcccaagtgagaccagcagcgataatgcccagtttgccaaaacagaattgtgagaaataataaatcattgttgttttaagcca

SEQ ID NO: 27141 - DNA, 917 bp, Homo sapiens
gtgcttttaggttctgtttggcaatatttaggaatttcacatggatataagtgagatacattttattttgtgtgtgctcatgtgggcagtctttgtcagggcttggtattattctagctttaaaaagaagagtatttaacttactttttatgctcctgtataaaatgtaagcagagttggaggcttatgttctttaaagacttagtagaactgacctgtgaaacaatctaggaatgggctttctgggggtagaaaagggtacagccaggaaactgtctatatttcttctgtgctaattggtttgttcagataatattatctctactctaaattgtgttcatttatatttttagaattttatttaattccaggtatttgttttgcatatatttgaacaaataagtatactgataagcttttactgtccttggttctttagttacccgtaaattatattttcctattttatgtaattgactttttcactttttattctgctttaaatcagccagaagtttatctatttatttattttaaataaccaggtattagatctattactttatcatttttctatctgctaatacatagttgcttgctttatttatttaaaatattgtgaagaatatacacatgtagaaaagtgcacaacacatgttttcccatatatataacatagaacagctacccaagtcaaaagtccacctcatgtccctgctaaacctctatcattccctcctcctcaaacttaagtacggtagtgttaacacggcggtattgtttcacctgcttttgagctttatatatatggactcattagtatgtatttgtgtctttcactcaataatatgagagctgttttaaatttttattttctaaatttattaaattgaaacacagttgacttttgtatatta

SEQ ID NO: 27142 - DNA, 701 bp, Homo sapiens
cactgcagcctgggggacagtgagactccatctcaaaaaaaaagaatagaataactcttgtttaggtgttacaaaatccaggccagaccaatctaaactttaatctcatacccggttcctagatgagtcccttctccagctcaggttcggcctaagcctcagggttccttacttggtgggcaccacctgctcccttccccgcctttgtcctctttttcctctgctggctcctccggggttgggtgtgttcagaggcagagacaggctcaaggtctttggcttttaggttctgttgatgggtgagttccagatatagctttctcttgtaggatatttcatttatttatctattaaaaatatttatttagaacacaccattcatgtgccagaccctgttccaggcactggggagagggtgataaatgagatcaacaaaaatacctgcccacattaagctcctgttctagggaagacaaaaaagaaagaaaatacacgtgtccttagtacattagaaggttccaagtactgtagagaaaaataaagtaggttggactcggtggctcatgcctgtaatcccagcactttgggaggctgaggtgggaggatcacgagactgtagattgagaccatcctggctaacatcgtgaaccccatctctaccataattcggtagtatagaagagtgcacttttaagcctccg

SEQ ID NO: 27143 - DNA, 464 bp, Homo sapiens
cgcctttgtcctctttttcctctgctggctcctccggggttgggtgtgttcagaggcagagacaggctcaaggtctttggcttttaggttctgttgatgggtgagttccagatatagctttctcttgtaggatatttcatttatttatctattaaaaatatttatttagaacacaccattcatgtgccagaccctgttccaggcactggggagagggtgataaatgagatcaacaaaaatacctgcccacattaagctcctgttctagggaagacaaaaaagaaagaaaatacacgtgtccttagtacattagaaggttccaagtactgtagagaaaaataaagtaggttggactcggtggctcatgcctgtaatcccagcactttgggaggctgaggtgggaggattacttgagctcaggaatttgagaccagcctgggcaacatggcaaatcctgtctctac

SEQ ID NO: 27144 - DNA, 174 bp, Homo sapiens
tctataaatttgttctgaccaggaggcatccctggagtctctctgaatctgctgtgattctgggggctgcccaattcacaaattgttcattgttcaattaaactttaaatttaattcagctgaagttttaaacaatggcggctggcttctaacagggaggcggtgaatcctgcc

SEQ ID NO: 27145 - DNA, 333 bp, Homo sapiens
ggatatccaggaagaagtgatgcatgggcaggagtaatttaggattagagtgcaggactgaaagtattgatcagtgaatcattgatttggaagatgacagtaaaaccctaagaatctgaggtaaggaaggatgagagaggaatggacaagaaccagataacaagcttaaaggaatgatttctttttaggtgccctgtataagcaacgacagtgcgaagggataccttatttagcattgtttaaacctctttatctgctccataggcatatgacctcaataaaggcagcagtgtgtttatgatgcagacccagctagaagacaagttcccaggt

SEQ ID NO: 27146 - DNA, 469 bp, Homo sapiens
tgcaataatttataatttttatattatttatgctaactgagcatgaaagattagatggaccatttcagacttctctacctgacctatatcgtctgaacaaactgaccccttttaacataaacactgaaaaggggagcagtcctagtttttgctggcattggtcttaaaggagtgccttagctacttggctccaactcatcctctcatctctggatgaggagctgtcagtggcctcttcaggaccactgattatcagtaggtcccaagtcgtctctatggggaatcagaggcatatgattatcaggcatcatctgaacaaggtgtctatcataaactgagtgtaacagtcctgtcccctaacccaggcttagtccttttctaatgtttcctctccccacctcccttcttcttgtgtccacagagcatgacttgctcttaataacctcttctaaggttgtgacattataag

SEQ ID NO: 27147 - DNA, 727 bp, Homo sapiens
ctttagtctgtagttttggtgtttgttctgcatgtgagtatttgggggtttgtagggggacctggtcacctaattttgttgtaaatggtgcccacagattttgattttgctatcttagttatggctcttttatgtgggaagagattggaaagctatgctgctgccagtgttaccctaaaatcctgtctaaatatcatcagacaaatacatattaattgtaggctaaatcgatgcaaagtgagtaagacagttcgctagatcccagctcccagagatatgcatgcatgtttacaatggggtaaatttccttccaaactctagttcttttcttgacatgctcatgtctgtttcttgcattgagaaaggaagagttatggttactatttctatgaaagattatttagagatctaggtactgtggcttgtaatcccagccatcccagaggctgaggtggaaggattgctggatggcagatttggaggctgaggaaggatagctggagattaagagttggagaccagtctgggcaacataggaagaccccatctcttaaaacaaaacaaaacaaaacaaaacaagtgttgcgtgtgtctgtagtcctacctacttgggaggctgaggctggaggatcacttaagcccaggagtttgagattgcagtgagctgtgattaaaccactgcactctagcatgggtggtagagcaagaccttgtttctttaccaaaa

SEQ ID NO: 27148 - DNA, 554 bp, Homo sapiens
caaaacacattaacattttaaggtatatttatcctttcaaagttaaaaataacttttaccacctccctaaattataaatatattgtaaaaaagcctaaatggtagcgtagtgcttccttgcttctgcccctgatggtctttgtttagcgtcttttgtttgtttgtttgttttttgagactgagtgtcgctctgtcgcccatgggcgatctctgctcactgcatcctccgtctcccgggttcaagcgattctcccgcctcagccatcccagaggctgaggtggaaggattgctggatggcagatttggaggctgaggaaggatagctggagattaagagttggagaccagtctgggcaacataggaagaccccatctcttaaaacaaaacaaaacaaaacaaaacaagtgttgcgtgtgtctgtagtcctacctacttgggaggctgaggctggaggatcacttaagcccaggagtttgagattgcagtgagctgtgattaaaccactgcactctagcatgggtggtagagcaagaccttgtttctttaccaaaa

SEQ ID NO: 27149 - DNA, 3134 bp, Homo sapiens
agctggatgtgttattccttctctgcatcgaaggatcaggaagtttgtgctctctgcgtggctaagtttttcacctactaggacgggggtggggtggggagaacaggtgtccttctaaaatacagcacaagctacagcctgcgtccagccataacccaggagtaacatcagaaacaggtgagaatgaccactttaactcaccgggcccgtcgcactgaaataagcaagaactctgaaaagaagatggaaagtgaggaagacagtaattgggagaaaagtccagacaatgaagattctggagactctaaggatatccgccttactcttatggaagaagtattgcttctgggactaaaagataaagaggggtacacatctttctggaatgactgcatatcatcaggcctgcgagggggcatcctgatagagctggccatgcggggtcgaatctatctggaacccccgaccatgcgtaagaagcgactactagacagaaaggtactgctaaagtcagacagcccaacaggtgatgttttactggatgaaactctgaaacacatcaaagcaactgaacccacagaaactgtccaaacatggatagagctactcactggtgagacctggaaccccttcaaattacagtaccagctgagaaatgtacgagagcgcatcgcaaagaacctagtagagaaaggtattctaaccactgagaagcagaatttcctgctatttgacatgactactcatccagtgaccaatacaacagagaaacagcgactagtgaaaaaacttcaagatagtgtactagagcggtgggtaaatgaccctcagcgtatggacaagcgaacactagcactcctggtgctagcccactcctctgatgtgctagagaatgtcttctcctctctgacagatgacaagtatgatgtggcaatgaatcgagccaaggacttagtagaactggaccctgaagtggaagggacaaagcctagtgccacagaaatgatctgggctgtgctggcagccttcaataaatcttaaagccggcaggtggatttctccttttcccctgctggctggtgactgtcagagaccccatcactgagttttgtgtgatgagatgttttcatcatttttgtttccttttcttgaatcagacttgtgatttggggagagcaacttcagggcttctccatagaccttgaccattataagcagaccttatttctccctacacttccactccataggtaaataaactgggtgaagccacacacacccaatgaacattttctcccatttggtggtttagtttcacccagtgtgcttttggataagcagaaatatctaaatgggattttgagttctccagctatagaatgtgaatgagataaaaagtgaactatctattatatttttctgagtttgttttctatcataaatacatgttttcacagcctttgtctctcagactctgctaaataatgtagcttattgaaataactgtcgctgaataaggagcaatgagaaacaaaactaatttttggagcagatggtctctggaattgcatatcctgctagtgattttctcatctttccttttctaacctaatgagaatgtcccagattcaattacctggatgtcaaagtcctagagccagaaatatattctctcatccctcttagcattctcttgctccctcattcactagggcaaatgtctaaatgaagaaaagtctctctcaacacctcgttcatgcaatcagcattagaatttgtaaggaaggaaggggggtggcatgaaaatttccattcttggggtatatgactgtcctgtttcccccaggccactttttttttttttttctctttggagacagggtcttgctcttgcccaggcaggagtacagtagtgcaatcacagctgactgcagccttgacctccagggctcaaggatcctcctgcctcagtctcccaactaagtgggactacaggcacgtgccaccatactcagcttttttttgtttgttttagacaagagtctcgctttgttgcccaggctggtcttgaattcctgggctcaagcaattcttccacctcagcctcccaaagtgctgagattactggcttgagccactgcacccacccctccagactactttaaatgtctctgctctgactgaattgaaggaattgtaagtttcagttgctgaatatatcagtatatctgaactccggatctttttatttcctatttttggcttcctacataaattaataaagtctgtctatatttaaggtttctgggagtagttttgtctatatttaatccatagatgtgctcctagtcatcagtcttatttcagtaaaaccatctttctggccaaatctctaacacgttttttacttcagtagtgagggcaatgagaagctttattaagaaagatcctatttaaagggctaatttggtattgaaagcatgctgatataaagtccagtatttgaggatataaagaggatgtgcactgagctgtgctgatgttcagcatttattatactttaatgggatagtgcttcttgaccattatagaacaacaaactgtcaaagggttaatacagatgacccagacctgacattaaatcctcttgattagaaataattaaatgaattatttattcatttctctcctctgccaaatctacttagccccacaaaaatgccccagctcagttaacatttttttgtttttcactttaggtatctcttaggcaaatagagatataaattgtaataggaaacagtctctaaatgtgaggctgaatacagcttcagtctggctctctaataggacaaaagccagtccatgtgttgtctctaactgatttagctttttcttttctttgaacaattcggcatgaattgaaaccaggttttcctgtggaaagttatagcttgattgggagatagaagttgaattgagttctttcttgcaactcttagtgtttatttttatatctcagtaagacgaggataccttcagtttgaatctgcataatgttcactgccaaactccttctcatttaatgcttatggccttcacatttctgtataataaagatcaattatcagctc

SEQ ID NO: 27150 - DNA, 3428 bp, Homo sapiens
aaaatacaaaaattagccagacatggtggcgcacacctgtaatcccaactactcaggaggctgaggcacaagaatcacttgaacctgggaagcggaggttgcagtgagccaacatcgcaccactgcactcccagcctgggcaacagagcaagactccctctcaagaaaagaagaagaaaaagaaaaaaagaagtcaacaggcttgaaagatgagcatttctactggactttagaattactcatttgatcttttgtcagtgccatctgtgaagtccaagctattgtactttggaaaagatactgtattacccacccatttttttctggtcattactccttcctttctttctatatttaaatctgtaaatatttcctatttgtatggatgtttagtatgcatgtatgaatatatgatttatttacataagcatacatatggattttttttttcaccactccctccagaaacaggtgagaatgaccactttaactcaccgggcccgtcgcactgaaataagcaagaactctgaaaagaagatggaaagtgaggaagacagtaattgggagaaaagtccagacaatgaagattctggagactctaaggatatccgccttactcttatggaagaagtattgcttctgggactaaaagataaagaggggtacacatctttctggaatgactgcatatcatcaggcctgcgagggggcatcctgatagagctggccatgcggggtcgaatctatctggaacccccgaccatgcgtaagaagcgactactagacagaaaggtactgctaaagtcagacagcccaacaggtgatgttttactggatgaaactctgaaacacatcaaagcaactgaacccacagaaactgtccaaacatggatagagctactcactggtgagacctggaaccccttcaaattacagtaccagctgagaaatgtacgagagcgcatcgcaaagaacctagtagagaaaggtattctaaccactgagaagcagaatttcctgctatttgacatgactactcatccagtgaccaatacaacagagaaacagcgactagtgaaaaaacttcaagatagtgtactagagcggtgggtaaatgaccctcagcgtatggacaagcgaacactagcactcctggtgctagcccactcctctgatgtgctagagaatgtcttctcctctctgacagatgacaagtatgatgtggcaatgaatcgagccaaggacttagtagaactggaccctgaagtggaagggacaaagcctagtgccacagaaatgatctgggctgtgctggcagccttcaataaatcttaaagccggcaggtggatttctccttttcccctgctggctggtgactgtcagagaccccatcactgagttttgtgtgatgagatgttttcatcatttttgtttccttttcttgaatcagacttgtgatttggggagagcaacttcagggcttctccatagaccttgaccattataagcagaccttatttctccctacacttccactccataggtaaataaactgggtgaagccacacacacccaatgaacattttctcccatttggtggtttagtttcacccagtgtgcttttggataagcagaaatatctaaatgggattttgagttctccagctatagaatgtgaatgagataaaaagtgaactatctattatatttttctgagtttgttttctatcataaatacatgttttcacagcctttgtctctcagactctgctaaataatgtagcttattgaaataactgtcgctgaataaggagcaatgagaaacaaaactaatttttggagcagatggtctctggaattgcatatcctgctagtgattttctcatctttccttttctaacctaatgagaatgtcccagattcaattacctggatgtcaaagtcctagagccagaaatatattctctcatccctcttagcattctcttgctccctcattcactagggcaaatgtctaaatgaagaaaagtctctctcaacacctcgttcatgcaatcagcattagaatttgtaaggaaggaaggggggtggcatgaaaatttccattcttggggtatatgactgtcctgtttcccccaggccactttttttttttttttctctttggagacagggtcttgctcttgcccaggcaggagtacagtagtgcaatcacagctgactgcagccttgacctccagggctcaaggatcctcctgcctcagtctcccaactaagtgggactacaggcacgtgccaccatactcagcttttttttgtttgttttagacaagagtctcgctttgttgcccaggctggtcttgaattcctgggctcaagcaattcttccacctcagcctcccaaagtgctgagattactggcttgagccactgcacccacccctccagactactttaaatgtctctgctctgactgaattgaaggaattgtaagtttcagttgctgaatatatcagtatatctgaactccggatctttttatttcctatttttggcttcctacataaattaataaagtctgtctatatttaaggtttctgggagtagttttgtctatatttaatccatagatgtgctcctagtcatcagtcttatttcagtaaaaccatctttctggccaaatctctaacacgttttttacttcagtagtgagggcaatgagaagctttattaagaaagatcctatttaaagggctaatttggtattgaaagcatgctgatataaagtccagtatttgaggatataaagaggatgtgcactgagctgtgctgatgttcagcatttattatactttaatgggatagtgcttcttgaccattatagaacaacaaactgtcaaagggttaatacagatgacccagacctgacattaaatcctcttgattagaaataattaaatgaattatttattcatttctctcctctgccaaatctacttagccccacaaaaatgccccagctcagttaacatttttttgtttttcactttaggtatctcttaggcaaatagagatataaattgtaataggaaacagtctctaaatgtgaggctgaatacagcttcagtctggctctctaataggacaaaagccagtccatgtgttgtctctaactgatttagctttttcttttctttgaacaattcggcatgaattgaaaccaggttttcctgtggaaagttatagcttgattgggagatagaagttgaattgagttctttcttgcaactcttagtgtttatttttatatctcagtaagacgaggataccttcagtttgaatctgcataatgttcactgccaaactccttctcatttaatgcttatggccttcacatttctgtataataaagatcaattatcagctc

SEQ ID NO: 27151 - DNA, 815 bp, Homo sapiens
aaaatacaaaaattagccagacatggtggcgcacacctgtaatcccaactactcaggaggctgaggcacaagaatcacttgaacctgggaagcggaggttgcagtgagccaacatcgcaccactgcactcccagcctgggcaacagagcaagactccctctcaagaaaagaagaagaaaaagaaaaaaagaagtcaacaggcttgaaagatgagcatttctactggactttagaattactcatttgatcttttgtcagtgccatctgtgaagtccaagctattgtactttggaaaagatactgtattacccacccatttttttctggtcattactccttcctttctttctatatttaaatctgtaaatatttcctatttgtatggatgtttagtatgcatgtatgaatatatgatttatttacataagcatacatatggattttttttttcaccactccctccagaaacaggtgagaatgaccactttaactcaccgggcccgtcgcactgaaataagcaagaactctgaaaagaagatggaaagtgaggaagacagtaattgggagaaaagtccagacaatgaagattctggagactctaaggatatccgccttactcttatggaagaagtattgcttctgggactaaaagataaagaggtaatgcagttaggtttgctaggctatctcaaagactattaaatattggaatgttttaggaagtaacctaatggaatatatttaataataaattggtcttagaattgtgctctaaccatctggaagatggaggagttgggacagtgaccgatact

SEQ ID NO: 27152 - DNA, 521 bp, Homo sapiens
agctggatgtgttattccttctctgcatcgaaggatcaggaagtttgtgctctctgcgtggctaagtttttcacctactaggacgggggtggggtggggagaacaggtgtccttctaaaatacagcacaagctacagcctgcgtccagccataacccaggagtaacatcagaaacaggtgagaatgaccactttaactcaccgggcccgtcgcactgaaataagcaagaactctgaaaagaagatggaaagtgaggaagacagtaattgggagaaaagtccagacaatgaagattctggagactctaaggatatccgccttactcttatggaagaagtattgcttctgggactaaaagataaagaggtaatgcagttaggtttgctaggctatctcaaagactattaaatattggaatgttttaggaagtaacctaatggaatatatttaataataaattggtcttagaattgtgctctaaccatctggaagatggaggagttgggacagtgaccgatact

SEQ ID NO: 27153 - DNA, 2126 bp, Homo sapiens
agctggatgtgttattccttctctgcatcgaaggatcaggaagtttgtgctctctgcgtggctaagtttttcacctactaggacgggggtggggtggggagaacaggtgtccttctaaaatacagcacaagctacagcctgcgtccagccataacccaggagtaacatcagaaacaggtgagaatgaccactttaactcaccgggcccgtcgcactgaaataagcaagaactctgaaaagaagatggaaagtgaggaagacagtaattgggagaaaagtccagacaatgaagattctggagactctaaggatatccgccttactcttatggaagaagtattgcttctgggactaaaagataaagaggggtacacatctttctggaatgactgcatatcatcaggcctgcgagggggcatcctgatagagctggccatgcggggtcgaatctatctggaacccccgaccatgcgtaagaagcgactactagacagaaaggtactgctaaagtcagacagcccaacaggtgatgttttactggatgaaactctgaaacacatcaaagcaactgaacccacagaaactgtccaaacatggatagagctactcactggtgagacctggaaccccttcaaattacagtaccagctgagaaatgtacgagagcgcatcgcaaagaacctagtagagaaaggtattctaaccactgagaagcagaatttcctgctatttgacatgactactcatccagtgaccaatacaacagagaaacagcgactagtgaaaaaacttcaagatagtgtactagagcggtgggtaaatgaccctcagcgtatggacaagcgaacactagcactcctggtgctagcccactcctctgatgtgctagagaatgtcttctcctctctgacagatgacaagtatgatgtggcaatgaatcgagccaaggacttagtagaactggaccctgaagtggaagggacaaagcctagtgccaccatactcagcttttttttgtttgttttagacaagagtctcgctttgttgcccaggctggtcttgaattcctgggctcaagcaattcttccacctcagcctcccaaagtgctgagattactggcttgagccactgcacccacccctccagactactttaaatgtctctgctctgactgaattgaaggaattgtaagtttcagttgctgaatatatcagtatatctgaactccggatctttttatttcctatttttggcttcctacataaattaataaagtctgtctatatttaaggtttctgggagtagttttgtctatatttaatccatagatgtgctcctagtcatcagtcttatttcagtaaaaccatctttctggccaaatctctaacacgttttttacttcagtagtgagggcaatgagaagctttattaagaaagatcctatttaaagggctaatttggtattgaaagcatgctgatataaagtccagtatttgaggatataaagaggatgtgcactgagctgtgctgatgttcagcatttattatactttaatgggatagtgcttcttgaccattatagaacaacaaactgtcaaagggttaatacagatgacccagacctgacattaaatcctcttgattagaaataattaaatgaattatttattcatttctctcctctgccaaatctacttagccccacaaaaatgccccagctcagttaacatttttttgtttttcactttaggtatctcttaggcaaatagagatataaattgtaataggaaacagtctctaaatgtgaggctgaatacagcttcagtctggctctctaataggacaaaagccagtccatgtgttgtctctaactgatttagctttttcttttctttgaacaattcggcatgaattgaaaccaggttttcctgtggaaagttatagcttgattgggagatagaagttgaattgagttctttcttgcaactcttagtgtttatttttatatctcagtaagacgaggataccttcagtttgaatctgcataatgttcactgccaaactccttctcatttaatgcttatggccttcacatttctgtataataaagatcaattatcagctc

SEQ ID NO: 27154 - DNA, 2804 bp, Homo sapiens
ttggatgcaaatatagtttaaaaaatgcattgtagtgggtacacatctttctggaatgactgcatatcatcaggcctgcgagggggcatcctgatagagctggccatgcggggtcgaatctatctggaacccccgaccatgcgtaagaagcgactactagacagaaaggtactgctaaagtcagacagcccaacaggtgatgttttactggatgaaactctgaaacacatcaaagcaactgaacccacagaaactgtccaaacatggatagagctactcactggtgagacctggaaccccttcaaattacagtaccagctgagaaatgtacgagagcgcatcgcaaagaacctagtagagaaaggtattctaaccactgagaagcagaatttcctgctatttgacatgactactcatccagtgaccaatacaacagagaaacagcgactagtgaaaaaacttcaagatagtgtactagagcggtgggtaaatgaccctcagcgtatggacaagcgaacactagcactcctggtgctagcccactcctctgatgtgctagagaatgtcttctcctctctgacagatgacaagtatgatgtggcaatgaatcgagccaaggacttagtagaactggaccctgaagtggaagggacaaagcctagtgccacagaaatgatctgggctgtgctggcagccttcaataaatcttaaagccggcaggtggatttctccttttcccctgctggctggtgactgtcagagaccccatcactgagttttgtgtgatgagatgttttcatcatttttgtttccttttcttgaatcagacttgtgatttggggagagcaacttcagggcttctccatagaccttgaccattataagcagaccttatttctccctacacttccactccataggtaaataaactgggtgaagccacacacacccaatgaacattttctcccatttggtggtttagtttcacccagtgtgcttttggataagcagaaatatctaaatgggattttgagttctccagctatagaatgtgaatgagataaaaagtgaactatctattatatttttctgagtttgttttctatcataaatacatgttttcacagcctttgtctctcagactctgctaaataatgtagcttattgaaataactgtcgctgaataaggagcaatgagaaacaaaactaatttttggagcagatggtctctggaattgcatatcctgctagtgattttctcatctttccttttctaacctaatgagaatgtcccagattcaattacctggatgtcaaagtcctagagccagaaatatattctctcatccctcttagcattctcttgctccctcattcactagggcaaatgtctaaatgaagaaaagtctctctcaacacctcgttcatgcaatcagcattagaatttgtaaggaaggaaggggggtggcatgaaaatttccattcttggggtatatgactgtcctgtttcccccaggccactttttttttttttttctctttggagacagggtcttgctcttgcccaggcaggagtacagtagtgcaatcacagctgactgcagccttgacctccagggctcaaggatcctcctgcctcagtctcccaactaagtgggactacaggcacgtgccaccatactcagcttttttttgtttgttttagacaagagtctcgctttgttgcccaggctggtcttgaattcctgggctcaagcaattcttccacctcagcctcccaaagtgctgagattactggcttgagccactgcacccacccctccagactactttaaatgtctctgctctgactgaattgaaggaattgtaagtttcagttgctgaatatatcagtatatctgaactccggatctttttatttcctatttttggcttcctacataaattaataaagtctgtctatatttaaggtttctgggagtagttttgtctatatttaatccatagatgtgctcctagtcatcagtcttatttcagtaaaaccatctttctggccaaatctctaacacgttttttacttcagtagtgagggcaatgagaagctttattaagaaagatcctatttaaagggctaatttggtattgaaagcatgctgatataaagtccagtatttgaggatataaagaggatgtgcactgagctgtgctgatgttcagcatttattatactttaatgggatagtgcttcttgaccattatagaacaacaaactgtcaaagggttaatacagatgacccagacctgacattaaatcctcttgattagaaataattaaatgaattatttattcatttctctcctctgccaaatctacttagccccacaaaaatgccccagctcagttaacatttttttgtttttcactttaggtatctcttaggcaaatagagatataaattgtaataggaaacagtctctaaatgtgaggctgaatacagcttcagtctggctctctaataggacaaaagccagtccatgtgttgtctctaactgatttagctttttcttttctttgaacaattcggcatgaattgaaaccaggttttcctgtggaaagttatagcttgattgggagatagaagttgaattgagttctttcttgcaactcttagtgtttatttttatatctcagtaagacgaggataccttcagtttgaatctgcataatgttcactgccaaactccttctcatttaatgcttatggccttcacatttctgtataataaagatcaattatcagctc

SEQ ID NO: 27155 - DNA, 2298 bp, Homo sapiens
agctggatgtgttattccttctctgcatcgaaggatcaggaagtttgtgctctctgcgtggctaagtttttcacctactaggacgggggtggggtggggagaacaggtgtccttctaaaatacagcacaagctacagcctgcgtccagccataacccaggagtaacatcagaaacaggtgagaatgaccactttaactcaccgggcccgtcgcactgaaataagcaagaactctgaaaagaagatggaaagtgaggaagacagtaattgggagaaaagtccagacaatgaagattctggagactctaaggatatccgccttactcttatggaagaagtattgcttctgggactaaaagataaagaggggtacacatctttctggaatgactgcatatcatcaggcctgcgagggggcatcctgatagagctggccatgcggggtcgaatctatctggaacccccgaccatgcgtaagaagcgactactagacagaaaggtactgctaaagtcagacagcccaacaggtgatgttttactggatgaaactctgaaacacatcaaagcaactgaacccacagaaactgtccaaacatggatagagctactcactggtgagacctggaaccccttcaaattacagtaccagctgagaaatgtacgagagcgcatcgcaaagaacctagtagagaaaggtattctaaccactgagaagcagaatttcctgctatttgacatgactactcatccagtgaccaatacaacagagaaacagcgactagtgaaaaaacttcaagatagtgtactagagcggtgggtaaatgaccctcagcgtatggacaagcgaacactagcactcctggtgctagcccactcctctgatgtgctagagaatgtcttctcctctctgacagatgacaagtatgatgtggcaatgaatcgagccaaggacttagtagaactggaccctgaagtggaagggacaaagcctagtgccacagaaatgatctgggctgtgctggcagccttcaataaatcttaaagccggcaggtggatttctccttttcccctgctggctggtgactgtcagagaccccatcactgagttttgtgtgatgagatgttttcatcatttttgtttccttttcttgaatcagacttgtgatttggggagagcaacttcagggcttctccatagaccttgaccattataagcagaccttatttctccctacacttccactccataggtaaataaactgggtgaagccacacacacccaatgaacattttctcccatttggtggtttagtttcacccagtgtgcttttggataagcagaaatatctaaatgggattttgagttctccagctatagaatgtgaatgagataaaaagtgaactatctattatatttttctgagtttgttttctatcataaatacatgttttcacagcctttgtctctcagactctgctaaataatgtagcttattgaaataactgtcgctgaataaggagcaatgagaaacaaaactaatttttggagcagatggtctctggaattgcatatcctgctagtgattttctcatctttccttttctaacctaatgagaatgtcccagattcaattacctggatgtcaaagtcctagagccagaaatatattctctcatccctcttagcattctcttgctccctcattcactagggcaaatgtctaaatgaagaaaagtctctctcaacacctcgttcatgcaatcagcattagaatttgtaaggaaggaaggggggtggcatgaaaatttccattcttggggtatatgactgtcctgtttcccccaggccactttttttttttttttctctttggagacagggtcttgctcttgcccaggcaggagtacagtagtgcaatcacagctgactgcagccttgacctccagggctcaaggatcctcctgcctcagtctcccaactaagtgggactacaggcacgtgccaccatactcagcttttttttgtttgttttagacaagagtctcgctttgttgcccaggctggtcttgaattcctgggctcaagcaattcttccacctcagcctcccaaagtgctgagattactggcttgagccactgcacccacccctccagactactttaaatgtctctgctctgactgaattgaaggaattgtaagtttcagttgctgaatatatcagtatatctgaactccggatctttttatttcctatttttggcttcctacataaattaataaagtctgtctatattta

SEQ ID NO: 27156 - DNA, 252 bp, Homo sapiens
tcaacttggaattccagtaccagatgagtagtgtaaagttggccccttgcatgtggtgcatgcttggtgttttgatttctcgccagaatcatttcttttttccacccataatccaatagagaaggcaagtttccttgctcctcctccatgctgctaagtggagtttttctaccttgcctttcatgaaagggtccactgaggatgctggccttcggcagtgatcacgtgccttgtggttataggagccagcag

SEQ ID NO: 27157 - DNA, 384 bp, Homo sapiens
ggtactgggaagttgtaacttcaatgcagaagctttagaggcacacaatttatcccacaacatgtcacttgcaagacttgctgtgctgttgcatatttagaaaaggaaaggtggtcagtaggcaagctgagaacacatgttaaactgcatcattcatggatcttgattgaaatcccttatttatgaaacaagcttgtatgtacactttgagtctgttaaatattatggtgaaattccatttatgcagtgggtcacacccaagacttcctgaaaggttagaggtgacccttgctcctaagttggggcctaaatcttggcagtcataaaaaagtatttcttaactaggctatacaatcaacattctcaattttattgaaaaaaaaa

SEQ ID NO: 27158 - DNA, 425 bp, Homo sapiens
gaaggaacatctatttcatctatttggaagtctcaagatagtcactcaatcatctactgtagacatctcttggcccaaagcaaactctgaattcagtctcaaataagactgggatatttcaccctacatttaaaaagtaatctcaagtagatcagcaggccccacccagcccggatacctggtatgaacagcttagaggacagcaaatggtccagtaaatttactgagagtacagagtactcacactgtatgcaaccttgaattaggggattttgaaatcaatggcacataaaaatcaatcaactctcactttatgagtggattacaaaatagtgtaaatccctgtaaataaaaaaaattaatcaaaacttgcttaattgtaaagctggcaaactaagtgactaataaatagtgtttacacaatt

SEQ ID NO: 27159 - DNA, 282 bp, Homo sapiens
gactcaactaggaggtcttattacagtactgtgctgctttttcaaccatggagaggtttgttttctagaaagcaatttttaagaaatagaaggggttatagaggaacaaagaaatatactcatcgaaacaatatataattgtatactacttatgacttcacaatattttaaagacccttgtgttataagttgatattttaatcatgctgatcaaaatgtttaaatagctagaatttcaaacatgaaatctcttgccttatttttagtaaatatatacatata

SEQ ID NO: 27160 - DNA, 1137 bp, Homo sapiens
ctgaacaaattttgctttccttccccacaccctccttatttttataaagttaccaggcagtgacattgccagtgggagtgatgtactttctgatgtcatacccagtattccaagttcaccttgcctgcttcctaaaaagaaaaacaagcaccggaatttagatgaactcccttggagtgcaatgacaaatgatgagcaggtggaatatattgagtatctgagtcggaaagtgagtactgagatgggtcttcgggagcaacttgatattattaagatcattgatccttctgctcaaatctcccctacagacagtgagtttattattgaacttaactgtctcacagatgaaaaactgaagcaggtcagaaactatatcaaggaacatagccctcgccaacggcctgcaagagaggcctggaagagaagcaactttagttgtgcaagcaccagtggagtgagcggtgccagtgccagcgccagcagcagcagtgccagcatggtcagttctgcaagcagcagtgggtccagtgttggaaactctgcttcaaactccagtgccaacatgagtcgagcacacagtgacagcaacctgtctgcaagtgcagcagagcggattcgggattcaaaagtaaaacgtctaatcaatacaaaactttacctttcaatattaacattagtactccttcatataaatttcttgaagagttaaaatgatcctgctgtctagttgcctgtgggttttggtcttaattgaacaagcaggatgctctgctgttgaacaaagcactctaggctgagtgctttgaaatgctgttttgacccacaaccatattgcattcaatcttacctgatttttgtgtatgttttaagtaagataaattggtggaaataatgagttattctcaagattgcaatattgactgcaactcactactgagcgaatctcactacgttgctgatgttgctgtctattagctcctaagaatgttgtgtatgtcttttgtgtgtgttaaatgttttcttaatgttttaatcttaaatgtttcttcttagctaatttaaaaatctaatactttctataatttctgtctactcttttcacagttgagaaagttctgtataatattgtcgggcact

SEQ ID NO: 27161 - DNA, 2779 bp, Homo sapiens
ctgaacaaattttgctttccttccccacaccctccttatttttataaagttaccaggcagtgacattgccagtgggagtgatgtactttctgatgtcatacccagtattccaagttcaccttgcctgcttcctaaaaagaaaaacaagcaccggaatttagatgaactcccttggagtgcaatgacaaatgatgagcaggtggaatatattgagtatctgagtcggaaagtgagtactgagatgggtcttcgggagcaacttgatattattaagatcattgatccttctgctcaaatctcccctacagacagtgagtttattattgaacttaactgtctcacagatgaaaaactgaagcaggtcagaaactatatcaaggaacatagccctcgccaacggcctgcaagagaggcctggaagagaagcaactttagttgtgcaagcaccagtggagtgagcggtgccagtgccagcgccagcagcagcagtgccagcatggtcagttctgcaagcagcagtgggtccagtgttggaaactctgcttcaaactccagtgccaacatgagtcgagcacacagtgacagcaacctgtctgcaagtgcagcagagcggattcgggattcaaaaaagcgatccaagcagcggaagttacagcagaaggccttccgcaagaggcagctgaaggagcagaggcaggcccggaaggagaggctcagtgggctcttccttaacgaagaggtgctgtccttgaaagtgactgaggaagaccatgaagcagatgttgatgttttgatgtaataagggtgaatttatcaacgttctttgtgagcattaaaatactccatccttatgggtttacatgcatcttgaccaaaattttggttagggctgtgctgatgtaccattaataatttaagccagtggttcttggcaggtgatcccaagacctgcagcttcagcatcacttgagaagttgttaggaatgcatactagtgggccccgcccccagacatagtgaatcagaaaccaacagggaggcgcctagcattgtttttttaacaagtgctgggttattctgatgcacagtctagtttaagaaccactactttgggtaaacgttttgactgtttaaagtttatggcggtgaagtgggcgtcttcaaagactagtacttacacagtttagaagatttcaaggtactgctgacagtagtttattatgtcagtatacatacatgtgtagagatcataatttagttcccttcttaatgttacaatttcttagtttacttttcctaaagggccatagcataattcttgattcctggtggaaatcttttctgaggtgtgggggtgggcaaggtgtggattgctgtttacgatagtgccttcattagttttagttctgtctgttttcattcattattgactcaaaggtattagaacaggcccttatctttttcctattagatttatttttgttttttactttatgtaagttcagaatccttttttaagtgatgactactgatgaaataatgttactagtagctgaattttagacttgatgctatgttgattaatatttaaatggtgaaagtaattaggcaaaataagcaattctgcttttctgttgctttcagaatttttaggctgtaaaattgtctcaggcaggaagtcagtctatatctctctcaagttcttattgtaggtcatttttttttcagcacagctctaatttttaaatatttggtataacagcttctggcatgtgacctagttaatgttgaaaattaactgatgaaaacccttgtagatctgctaaacttctctataaattgctagaaatatacagagcaatgagatatagaaaacaccttagcttgttggttattaatagagctctaattttaactgtgaaatcatggagtttctttaaatgttttcctagagtgtttgttatcatgaacattagaaatagcattattccttttcttctaccacatgtcttgaacattcacatgggttaaagaagatggaaactgatactactgacaatcaagctgctttctgactttcataattttctttatattgtggatagcattttgaaggtgaccgtgattctgtaggaagagctgtaatcaatatttttcaaactctaagagtacagaggttagtaagatttcttttttttttactttttgttacgtcaagtagcttattaagaaaaagattcatgacttaaattcttaattctcagttgatacaaaggcttataatcatgtgttttaaaattttgatttcattttcgttccttgaaggttaaagaatggaaactggggataaaaattaatacactgcagctttgccaaggtctgtgatatggttgtaaccttttaaagactactaaagtcataatttgaaatttttactaaaataaaacatatgtgtctatggttttcaattggagtagtctttcttactttcccccttcccctctttggttctcctaaccagcttagaggacccaaagagagcttagggatagacaccagaatactctgtggaggtggaacaacttaacctcactgttttcccttccaagtataggaagagcaaatagagcatagtaactgtatctaaattctctacctgctcttagcaaaagcaaaatcccacagaatgattgcctgctgtctttacctattcttcaaggaaaacaggccacttttggagaccatagagcaccatttatctgtcaaatacttggaaacta

SEQ ID NO: 27162 - DNA, 1650 bp, Homo sapiens
gggccgcgacgcccagcctgccagtgagctgcgacgggcacaccccggagcgtcggcgactgcggacaggttagagtgggggcaggggcgggcgcgggagcagcccagggccagagagggagcccgagccaggccatctccaaccatgtccgacgaggcctcggccatcacttcctacgagaagtttctaacccccgaggagcccttcccactcctgggacctcctcgcggggtgggcacctgcccgagcgaggagccgggctgcctggacatcagcgacttcggctgccagctgtcctcctgccatcgcaccgacccgctccaccgcttccacaccaacaggtggaacctaacttcttgtggaacaagtgttgccagctcagaaggcagtgaggagctgttttcatctgtgtctgttggagatcaagatgattgctattccctgttagatgatcaggacttcacttcttttgatttatttcctgaggggagtgtctgcagtgatgtctcttcttctattagcacttactgggattggtcagatagcgagtttgaatggcagttaccaggcagtgacattgccagtgggagtgatgtactttctgatgtcatacccagtattccaagttcaccttgcctgcttcctaaaaagaaaaacaagcaccggaatttagatgaactcccttggagtgcaatgacaaatgatgagcaggtggaatatattgagtatctgagtcggaaagtgagtactgagatgggtcttcgggagcaacttgatattattaagatcattgatccttctgctcaaatctcccctacagacagtgagtttattattgaacttaactgtctcacagatgaaaaactgaagcaggtcagaaactatatcaaggaacatagccctcgccaacggcctgcaagagaggcctggaagagaagcaactttagttgtgcaagcaccagtggagtgagcggtgccagtgccagcgccagcagcagcagtgccagcatggtcagttctgcaagcagcagtgggtccagtgttggaaactctgcttcaaactccagtgccaacatgagtcgagcacacagtgacagcaacctgtctgcaagtgcagcagagcggattcgggattcaaaagtaaaacgtctaatcaatacaaaactttacctttcaatattaacattagtactccttcatataaatttcttgaagagttaaaatgatcctgctgtctagttgcctgtgggttttggtcttaattgaacaagcaggatgctctgctgttgaacaaagcactctaggctgagtgctttgaaatgctgttttgacccacaaccatattgcattcaatcttacctgatttttgtgtatgttttaagtaagataaattggtggaaataatgagttattctcaagattgcaatattgactgcaactcactactgagcgaatctcactacgttgctgatgttgctgtctattagctcctaagaatgttgtgtatgtcttttgtgtgtgttaaatgttttcttaatgttttaatcttaaatgtttcttcttagctaatttaaaaatctaatactttctataatttctgtctactcttttcacagttgagaaagttctgtataatattgtcgggcact

SEQ ID NO: 27163 - DNA, 3292 bp, Homo sapiens
gggccgcgacgcccagcctgccagtgagctgcgacgggcacaccccggagcgtcggcgactgcggacaggttagagtgggggcaggggcgggcgcgggagcagcccagggccagagagggagcccgagccaggccatctccaaccatgtccgacgaggcctcggccatcacttcctacgagaagtttctaacccccgaggagcccttcccactcctgggacctcctcgcggggtgggcacctgcccgagcgaggagccgggctgcctggacatcagcgacttcggctgccagctgtcctcctgccatcgcaccgacccgctccaccgcttccacaccaacaggtggaacctaacttcttgtggaacaagtgttgccagctcagaaggcagtgaggagctgttttcatctgtgtctgttggagatcaagatgattgctattccctgttagatgatcaggacttcacttcttttgatttatttcctgaggggagtgtctgcagtgatgtctcttcttctattagcacttactgggattggtcagatagcgagtttgaatggcagttaccaggcagtgacattgccagtgggagtgatgtactttctgatgtcatacccagtattccaagttcaccttgcctgcttcctaaaaagaaaaacaagcaccggaatttagatgaactcccttggagtgcaatgacaaatgatgagcaggtggaatatattgagtatctgagtcggaaagtgagtactgagatgggtcttcgggagcaacttgatattattaagatcattgatccttctgctcaaatctcccctacagacagtgagtttattattgaacttaactgtctcacagatgaaaaactgaagcaggtcagaaactatatcaaggaacatagccctcgccaacggcctgcaagagaggcctggaagagaagcaactttagttgtgcaagcaccagtggagtgagcggtgccagtgccagcgccagcagcagcagtgccagcatggtcagttctgcaagcagcagtgggtccagtgttggaaactctgcttcaaactccagtgccaacatgagtcgagcacacagtgacagcaacctgtctgcaagtgcagcagagcggattcgggattcaaaaaagcgatccaagcagcggaagttacagcagaaggccttccgcaagaggcagctgaaggagcagaggcaggcccggaaggagaggctcagtgggctcttccttaacgaagaggtgctgtccttgaaagtgactgaggaagaccatgaagcagatgttgatgttttgatgtaataagggtgaatttatcaacgttctttgtgagcattaaaatactccatccttatgggtttacatgcatcttgaccaaaattttggttagggctgtgctgatgtaccattaataatttaagccagtggttcttggcaggtgatcccaagacctgcagcttcagcatcacttgagaagttgttaggaatgcatactagtgggccccgcccccagacatagtgaatcagaaaccaacagggaggcgcctagcattgtttttttaacaagtgctgggttattctgatgcacagtctagtttaagaaccactactttgggtaaacgttttgactgtttaaagtttatggcggtgaagtgggcgtcttcaaagactagtacttacacagtttagaagatttcaaggtactgctgacagtagtttattatgtcagtatacatacatgtgtagagatcataatttagttcccttcttaatgttacaatttcttagtttacttttcctaaagggccatagcataattcttgattcctggtggaaatcttttctgaggtgtgggggtgggcaaggtgtggattgctgtttacgatagtgccttcattagttttagttctgtctgttttcattcattattgactcaaaggtattagaacaggcccttatctttttcctattagatttatttttgttttttactttatgtaagttcagaatccttttttaagtgatgactactgatgaaataatgttactagtagctgaattttagacttgatgctatgttgattaatatttaaatggtgaaagtaattaggcaaaataagcaattctgcttttctgttgctttcagaatttttaggctgtaaaattgtctcaggcaggaagtcagtctatatctctctcaagttcttattgtaggtcatttttttttcagcacagctctaatttttaaatatttggtataacagcttctggcatgtgacctagttaatgttgaaaattaactgatgaaaacccttgtagatctgctaaacttctctataaattgctagaaatatacagagcaatgagatatagaaaacaccttagcttgttggttattaatagagctctaattttaactgtgaaatcatggagtttctttaaatgttttcctagagtgtttgttatcatgaacattagaaatagcattattccttttcttctaccacatgtcttgaacattcacatgggttaaagaagatggaaactgatactactgacaatcaagctgctttctgactttcataattttctttatattgtggatagcattttgaaggtgaccgtgattctgtaggaagagctgtaatcaatatttttcaaactctaagagtacagaggttagtaagatttcttttttttttactttttgttacgtcaagtagcttattaagaaaaagattcatgacttaaattcttaattctcagttgatacaaaggcttataatcatgtgttttaaaattttgatttcattttcgttccttgaaggttaaagaatggaaactggggataaaaattaatacactgcagctttgccaaggtctgtgatatggttgtaaccttttaaagactactaaagtcataatttgaaatttttactaaaataaaacatatgtgtctatggttttcaattggagtagtctttcttactttcccccttcccctctttggttctcctaaccagcttagaggacccaaagagagcttagggatagacaccagaatactctgtggaggtggaacaacttaacctcactgttttcccttccaagtataggaagagcaaatagagcatagtaactgtatctaaattctctacctgctcttagcaaaagcaaaatcccacagaatgattgcctgctgtctttacctattcttcaaggaaaacaggccacttttggagaccatagagcaccatttatctgtcaaatacttggaaacta

SEQ ID NO: 27164 - DNA, 1854 bp, Homo sapiens
aaaaatgaaaaaaccatattgttgactaagggagtcaaattttatattctctcaatacttaaacttagcagggtactgagagaagtgctataagtccaatctacttaggtagtgtgatgatgatgatagaaagcagtcattatatataattggttgtattttatgtgtgtgtttgtatgcgtataatagtatgctgagaatccatataatggattaaacctaattaatgttaacattaatttattcattagcaagagtatgcctttagtataaggaagatccagggagagtggaggaatgggatggacatttcaaaatagaccaaagtgctgggattacaggcataagccgccgtgccaggccctttttatagacttttgaactaagaggtttcaaaccaaatcgcaactcttacttgatttacagaaatgggcctcctaacaaaattttcaaaattgtggtgggatttctttttataagggaagtttaatatggcattattttcagccagtgatttggaaggtctgttttcctataattactaaaataacctaaatcattttcagtattcaaaaactctatgaatttaagagcctgttgtgacaggactcttgattttatgacaagaaaaaaccatgttggaattcaggcattttgttaggtaccttaatcatcagtaattagtatatgattatttcatttcctacaaggactctatagttgtatgtattaagtgtgtatatatgttcatatgaacatgcaagatataggcaatagaaattaagtaatccaaaagaggattccgttattcactaaagtatcttccttttaaatttggatttataaaatcatagtgcagtaactttaaatgtagatagttcaaacattcttagcacctcaatctagtatgtttaattaaaatttgtataaatgtaaattagtgtaagagggtaaaataataatcaagttatttttcaaaagattgcaataagtttttggtctaaacttaaactttgttcattttgtacatactctgtgttaattctaattgcacctttgtgatgtgtatttatatacagtgtgcagaaaatgttcgtgaaattttgattacaattgtagattatgtatgatggcattgcttacgaatgttttgcttgtaaaaaaatttcaaggtgcaatcaaatgctactagtttttctgattttcaaaaatctatctatctaaaatattaagccttttccttcctgtgtagtacttactaaataactttttgtattcaggcatttgcatcaaattgctgaacaagatgaatagccacattaattcaatgattttaaaagactatttggggagggttgggtatataattttttagctctatttacatcccaaagtagaaagattaaatttatatttactagagctattcaaagaatacacttttctatattgtaaaaacaggacagcaaagtaaatcatacagaaaataaacatttatactattctgtaaaaaaggttttgcattttttctttagtataataacaccactttattaaccatttaatatgcaaaaaaccttttaaattatctgaagtaaatttgacattacttctgaaaacacacaactaaaaaattctatcattttgctcagttattactaacataaattgctttgaaatgagaatatgtcttctctttttttccccactgtttcttttaagagcagaaactcagccgggcatggtggctcacgcctgtaattccagcactttgggaggtcaaggcgggtgaatcacttgagtccaggagttctagaccagcccaggctacatggtgaaaccctgtctctacta

SEQ ID NO: 27165 - DNA, 851 bp, Homo sapiens
tgagcctgcagaggttgaggctgtagtgagtcaaaattacaccactgcactccagcctggcaatcagagtgagaccttgtctcaaaaacaaaaatacctagaaaatcaatctactctgtcttttaatgtgaaatgttcttatgatagctatctttcttagtttcctttttttctgaagcactaaacacaacctgtaggtcttatctctggggtctgggaaacagaaccttaatgttacaggtacaaaagcaaacagagtgattagttccccattttctggtagtgaacaactgacattttttcaatcttatgtaaaatgtgaataaaaataattttagaaaagttatctatttttattgttctgtaacacaaatagttaagaaaatgaatacttgttatgtaaatgaagcttcacagcaggacctccggccataactttgatcatgttgtatctcttaagcattttatataggaattctggtgtggctacccaaagcagaagggaaggcaatcaactaaaaatccctttctattggagttattttcatcatgtaaattacttcaggcttttcttgttagggcttcttgaatgcacattttgtcattatctgtataccaaaggtgagcttttttttttaatccatgtgattttatgagttgaaagctataaggttttttttaattaaaaatttccttctaaatggcaaattttgtgacagcatttaagacactcagtttctattcaaaagcaataagaaaacaagtatgtttagggttatgtttattataaggtcactgggactttataaaactgtcatctatcatactggcatatgaaatctggtcatagt

SEQ ID NO: 27166 - DNA, 1395 bp, Homo sapiens
acccattctttgggacttgatctagaatatctgcagacagaatgttacataaacaaattcttatgaaacacattcaaatgacattttgtatttagaaaaggactatcttttaaagaaaaagcagccttttagggccgattctggaataatatcctgttgtcactttgggaatgtcagaaggggaaacaatccccaggcacactaaaaattttttaaagttatttaaaaaaacatataaaatattaaaggacagtaaatctcagaggatgggcaatgtgtttctataataaggaaaggctaacagatgctctgggctgtctccattttctttcaaagaggtggtatgtatttgaagtaataaattgtcaaagtgattactgggtactattaaaatgataggtggatataaatggaagtaaacattatgtagtgataatatagaacctcacatagtaatcaagtataaaatttggcatgggtggagaaacaaagaatagggaagctgcaaaagatgaatttagagaagttttcatctatacaatcaattatttttacagacttttttttttttttttttgagacggagtctcgctgtccagcctggcaatcagagtgagaccttgtctcaaaaacaaaaatacctagaaaatcaatctactctgtcttttaatgtgaaatgttcttatgatagctatctttcttagtttcctttttttctgaagcactaaacacaacctgtaggtcttatctctggggtctgggaaacagaaccttaatgttacaggtacaaaagcaaacagagtgattagttccccattttctggtagtgaacaactgacattttttcaatcttatgtaaaatgtgaataaaaataattttagaaaagttatctatttttattgttctgtaacacaaatagttaagaaaatgaatacttgttatgtaaatgaagcttcacagcaggacctccggccataactttgatcatgttgtatctcttaagcattttatataggaattctggtgtggctacccaaagcagaagggaaggcaatcaactaaaaatccctttctattggagttattttcatcatgtaaattacttcaggcttttcttgttagggcttcttgaatgcacattttgtcattatctgtataccaaaggtgagcttttttttttaatccatgtgattttatgagttgaaagctataaggttttttttaattaaaaatttccttctaaatggcaaattttgtgacagcatttaagacactcagtttctattcaaaagcaataagaaaacaagtatgtttagggttatgtttattataaggtcactgggactttataaaactgtcatctatcatactggcatatgaaatctggtcatagt

SEQ ID NO: 27167 - DNA, 921 bp, Homo sapiens
acccattctttgggacttgatctagaatatctgcagacagaatgttacataaacaaattcttatgaaacacattcaaatgacattttgtatttagaaaaggactatcttttaaagaaaaagcagccttttagggccgattctggaataatatcctgttgtcactttgggaatgtcagaaggggaaacaatccccaggcacactaaaaattttttaaagttatttaaaaaaacatataaaatattaaaggacagtaaatctcagaggatgggcaatgtgtttctataataaggaaaggctaacagatgctctgggctgtctccattttctttcaaagaggtggtatgtatttgaagtaataaattgtcaaagtgattactgggtactattaaaatgataggtggatataaatggaagtaaacattatgtagtgataatatagaacctcacatagtaatcaagtataaaatttggcatgggtggagaaacaaagaatagggaagctgcaaaagatgaatttagagaagttttcatctatacaatcaattatttttacagacttttttttttttttttttgagacggagtctcgctgcactccagcctgggtgacaagagcaaaacttcgtctcaaaaaaaaaaagaagtttaaatatcagacaggaagacacatacgaacaatggcctttctagaaaagagaaaacttaatgttagtattaggcctaatgagactattgagtagcttgttgagtacatgaaacatacactcacatcaaatatttagaagctaataaacaccaattggaaaaaaatggttacaaaattttattgtataacaatgaaaataaaaattctaagcataggatgtatgaagaaaactacaaaatttctttgagagaaatataacttcattaaatgagg

SEQ ID NO: 27168 - DNA, 2351 bp, Homo sapiens
acccattctttgggacttgatctagaatatctgcagacagaatgttacataaacaaattcttatgaaacacattcaaatgacattttgtatttagaaaaggactatcttttaaagaaaaagcagccttttagggccgattctggaataatatcctgttgtcactttgggaatgtcagaaggggaaacaatccccaggcacactaaaaattttttaaagttatttaaaaaaacatataaaatattaaaggacagtaaatctcagaggatgggcaatgtgtttctataataaggaaaggctaacagatgctctgggctgtctccattttctttcaaagaggtggtatgtatttgaagtaataaattgtcaaagtgattactgggtactattaaaatgataggtggatataaatggaagtaaacattatgtagtgataatatagaacctcacatagtaatcaagtataaaatttggcatgggtggagaaacaaagaatagggaagctgcaaaagatgaatttagagaagttttcatctatacaatcaattatttttacagacttttttttttttttttttgagacggagtctcgctgtgtagcccaggctggagtgcaatggtgagatctcagctcactgcaacgcctctgcctcccaggttcaagcgattctcctgcctcagcctcccgtgtagctgggactacaggtgcatgccaccatgcccggctcattttttgtatttttagtagagacggggtttcaccgtgttagccaggatggtctcgatctcctgacctcgtgattcgcccgcctcggcctcccaaagtgctgggattacaggcataagccgccgtgccaggccctttttatagacttttgaactaagaggtttcaaaccaaatcgcaactcttacttgatttacagaaatgggcctcctaacaaaattttcaaaattgtggtgggatttctttttataagggaagtttaatatggcattattttcagccagtgatttggaaggtctgttttcctataattactaaaataacctaaatcattttcagtattcaaaaactctatgaatttaagagcctgttgtgacaggactcttgattttatgacaagaaaaaaccatgttggaattcaggcattttgttaggtaccttaatcatcagtaattagtatatgattatttcatttcctacaaggactctatagttgtatgtattaagtgtgtatatatgttcatatgaacatgcaagatataggcaatagaaattaagtaatccaaaagaggattccgttattcactaaagtatcttccttttaaatttggatttataaaatcatagtgcagtaactttaaatgtagatagttcaaacattcttagcacctcaatctagtatgtttaattaaaatttgtataaatgtaaattagtgtaagagggtaaaataataatcaagttatttttcaaaagattgcaataagtttttggtctaaacttaaactttgttcattttgtacatactctgtgttaattctaattgcacctttgtgatgtgtatttatatacagtgtgcagaaaatgttcgtgaaattttgattacaattgtagattatgtatgatggcattgcttacgaatgttttgcttgtaaaaaaatttcaaggtgcaatcaaatgctactagtttttctgattttcaaaaatctatctatctaaaatattaagccttttccttcctgtgtagtacttactaaataactttttgtattcaggcatttgcatcaaattgctgaacaagatgaatagccacattaattcaatgattttaaaagactatttggggagggttgggtatataattttttagctctatttacatcccaaagtagaaagattaaatttatatttactagagctattcaaagaatacacttttctatattgtaaaaacaggacagcaaagtaaatcatacagaaaataaacatttatactattctgtaaaaaaggttttgcattttttctttagtataataacaccactttattaaccatttaatatgcaaaaaaccttttaaattatctgaagtaaatttgacattacttctgaaaacacacaactaaaaaattctatcattttgctcagttattactaacataaattgctttgaaatgagaatatgtcttctctttttttccccactgtttcttttaagagcagaaactcagccgggcatggtggctcacgcctgtaattccagcactttgggaggtcaaggcgggtgaatcacttgagtccaggagttctagaccagcccaggctacatggtgaaaccctgtctctacta

SEQ ID NO: 27169 - DNA, 313 bp, Homo sapiens
tcaagtagcgacactgcttaaacaatctcacattaaacacaaacacatctgttcatgtaaggaaaacacagtattcaatttagcatctatctccttacatatgttaaatatctaatacagcatggtataatggaaagagaaataagcgctgattccagagacctacatcctgatcccagcactgtcgtaaaggtcttaaccttgagaaagaacacaatttctttgagcctcacttgcaccatgcatatataaaacaaggatatttacgtgcttcatccaagccacaaaattcttgtgaggtatataagattat

SEQ ID NO: 27170 - DNA, 310 bp, Homo sapiens
ctactactactaaattagcggccgctctgattctgttccagaaagcccttcccatctccaaaggagcgggccatgccccaagacactaatttcagtaattgcccactgacttcctcttttaatagagtcctcggtggcaggctcagtgcctgagtgaccaggaaggagaggggcctgcaggtcagatgtgtccctttccaaggcccacagagaggtctgttccaggcttggggaattctgagtgggcagaggaaatcctaaggcacataaggaatgtgtattagtctgttgtcacactgctataaagaac

SEQ ID NO: 27171 - DNA, 417 bp, Homo sapiens
gtcagaactaataagtatatctccctcgcagggtgactgtttcagaggtaacatatgcaacctcacacccacctggcacagagtaggccctgagcacatctcagcaaggtggctttgctgctcagaagccaatgccagtcttccctgcagctgcccttgtgatgtggatgcacaaagcagggtcaggccctgtcctctgagcttgcactgtctcttcctctctctctgtctgggctggagtgtaccacccctccatgacccccatcccatcaacagctcaggtcaaaacactgcttgccagtcaagaatttcactctcatatcaggctttcaaggagccctcacgccactgctttcttcctaggaagttttctaggaaactctttcagctggacaatctgaatggggtcatctttct

SEQ ID NO: 27172 - DNA, 333 bp, Homo sapiens
gggatcctgactcacatggtctttccagcaggtccagggctccatttagaatcactcccgggaaatcatggcagggaggtggcagtgacttctgttaggtcttgtggcagtgtcctttgttgattctcttggttaaaaccaagagttttggaccctgaactctgctgtgagagatctttattgaaaccgaatcatgaccccacaccctctccccaactgaaaagctttcagtggctccctattgtttatgggacaaagtccaaacttctaccttatgaggctggtcgtgagcacctcccctcaccctcatccaatcccaccatgtcatctctt

SEQ ID NO: 27173 - DNA, 304 bp, Homo sapiens
tacagctgctattaatgtctctcctcacctctcatcaacttcctctgaagaatagtctacatttgctttctccttttcgttgcctgtcattcagtcctcacccttttgcaatatgatttctaccctctgttctaatggaagtggtgttattataaattcagcttctaatcattcccagagatgttatttttgtctctagaatactttctgctttttgttttgtttgtttttcacaattagtttactccctcaatcttgaaattcccttggcttttgttataccatactcttcatgattttatta

SEQ ID NO: 27174 - DNA, 567 bp, Homo sapiens
gcaaaaccaaaactctgaacccattaaacacttactctccactccctccccactccatcctctggcaaccaccatactactgtctgtacctatcaatttggctatgttaggtaccttataaagggggaatcattcaatatttgttctattgtgactggcttattccacttagcataatgtcctcaaagttcattcatgctgtagcatgagtcagaatttcctttctttctagggctgagtaatattgatttgcctgtgtatactacattttgtttatccattcatcttttatggacatttgggttgctcccacgttttggctattatgaataatactgcaatgaacatgggtataaatagtgagctttaatattgtaattaagttttaatctttaatacgtatttgatagtccaactcagggattggcaaactatgaccctcaagtcagatctaacctgacatctgttttaataaataaagttttagataatagaacacaattggatttggtttgggaaggaaggaatgttgtttgcagagagtggagtttgcatacaagattgacc

SEQ ID NO: 27175 - DNA, 388 bp, Homo sapiens
gtaccctccactgaggctcagacacggtaacatctgcagaaccacagccaccttttcctattcctggtgacagctccatccctacatcctagctgccttcccagaagctgccttcccagaagccaccttggccccgggctgccgtgcttcccctaggaagttgttgcatttggaacactctcctgtgcaatagctgtctttttactgggcaattatttccttttttttctgaaaagaattctttgccaatacccaagccaactcaagcttctaggaatgaaagacgaagcagctccccctttcgtgagagtgctctggagcccttaatgaacagtcctggaggccggacgcagcagctcaagcctgcgcaacatagacctgtctctac

SEQ ID NO: 27176 - DNA, 384 bp, Homo sapiens
tgtcttaatgggaaattaaaattttaaaaaggaaaatcttgggaacttctttttgtatacatactttaacaaatcactttcccttaaaggtcttttaatttggggatataagagataactacttttcccctgcccccaccccctttttcttttctttctgctctagtctatatcctcaacttgttaaatatttatgtctttgattgattctgaagtaatgagagagatatattttttaatatcactgttactgtgtataaacttagggctggttattttattccccttttacagataaaatttctgtgtttataaaagctcagaataatggcaaaccatttttgatatttgaattttaacctttttttcgtcagtctcttgtga

SEQ ID NO: 27177 - DNA, 624 bp, Homo sapiens
attgctgtattctgggataaaagaaagtctgatgcagggaaaggggaagttggaaaaactggaaaaagaaaaaagaagaaaagaaaaaaaggactggaaagacattggtgaatagaaagatgaaaagggtgaagaaaaaaatgatgatagtcaatagggtggttttaaaagaggcttttgttttattaatttgtttttgtgtgagtgtgtgtgtatgtgtttgttttttgcctaaaagtatttaactccgcattacaccactgatttcaaagaaaaaaagctgaaatgtaagatcatatgatttgtttttaaactgaacactgtatactgtctttttatttttgcaaaattaatgtagtatccagtgtgtctttagataaccctgtccttaatgatattttcaatagccactaaccttgcctggtactgtttcggggtttaaactagaacagaaatttaaggcaggctttattagtgcatagtacaaatcaattacatatatatggagatattatttttccctcttcaattgtttttcgtgcagcttacccaatataattgttctgttagttgtacactactctgtgatagcaaataataataataaaataattatgatgatat

SEQ ID NO: 27178 - DNA, 527 bp, Homo sapiens
tgagatggagtcctgctctgtcaccaggctggagtgcggcggcatgatcttggctcactgcagcctctgcctcctgggttcaagcaattctcctgtcttagcctcccaagtagctgggactacaggtgcccaccactatgcccagctaatttttgtatttttagtagagatggggtttcaccatgttggccaggatggtctcgatctcttgacctcgtgatccgcccgccttggcctcccaaagtgctgggattacaggcgtgacactgtgcctggccggccttgcttttttatatactgaccttccccaaacgatgtggctctccctgaggttgaagatcaggcttactcttgcatctccatggcctgcacacactgggagttgataaatgcaagggtctgttatttctgcatgaatgaatggattcactttccttgctataccatatactcttctaaaagttaccaggctttctggaacttatattaagaaattcagataccagcaataatatccaggtaactca

SEQ ID NO: 27179 - DNA, 5030 bp, Homo sapiens
tggagtgacgtcaggatcttggcacatccagtcctagggtttccctctgtctctggccagccctgagccccgtagccgtgagttctgcccaggccctgtgagctcaccagagccacagactcacagcccagaggtggcttcttccttcaggaactgaagaacccccatgaacaccaacatctccaggttctgagaacagaacctgggaaattgatgacttcctcatgatgaccgatactcaggatggccctagcgagagctcccagatcatgaggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgagccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacccgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacgggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacgagcttcatctggttcctgaaccctctcaagtcggctcgctacttcttgtggcacacgtatcgctggctgctcctcaaactgttgctgctcctgctgctgctcctcctcctcgccctgttcctctactctgtgcctggctacctggtcaagaaaatcctcggggcctgagcccagtggcctcctggccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaaggccgccagctcccgccagccgctccccagccctgccgcatttcctttcagtggcttggactctttcccatctcccctggggagcctgaggagcccagcgtccacttttcatgccttgggccgagcctgcctcctgcttgcgggggccgcctgtcctcactgccccaggctgcggcttgcccagtcccgcccctctgacccctgcctgtgggctggggagccttggatggggtggggacctggaatgggtctttcttgccccacctggctgaggcgccacccttcttcaggcccaggctccagaggaagactcctgaaaccctccccaggttttccaagtacaggattgaagctttagtgaaattaaccaaggaccatgggtcagtgcccagggctttaaaaagaatgaacgagcaaaaggtatccccgccgtgacccctgcagatagcaccggtatttgatccgcagcaggggccagaccctgcccacaagtcccagcgcggatgtttctgccactgctgggctccacttggctcctctcacttcccagggggtcgcctgtcctgcctgtgggtttccatggcttcccagagttccctctgccccagccagcgcctccaggcccagctgaggagctgtgagaagcagcagaggggactccccatcccgggcacaccctgtcttcccacccctgcccccttgcccttccagccctttcagctgcaggtgggagctggcccgtcaagtgctgcccctgcctgtgtctgggtttctgttggctgtttttcttttcttggagtggtgatttttctctaaataaaagaagtcaagcactga

SEQ ID NO: 27180 - DNA, 7157 bp, Homo sapiens
atcggaggggggtcgggaggaggaggaggaggcagcggcagagaagagagaggcgtgtgagccgtgctccaccggctagctccttcccgctgctcctgcctggcagtgccaggcagcccacaccagcatggccttgctcatccacctcaagacagtctcggagctgcggggcaggggcgaccggatcgccaaagtgactttccgagggcaatccttctactctcgggtcctggagaactgtgaggatgtggctgactttgatgagacatttcggtggccggtggccagcagcatcgacagaaatgagatgctggagattcaggttttcaactacagcaaagtcttcagcaacaagctcatcgggaccttccgcatggtgctgcagaaggtggtagaggagagccatgtggaggtgactgacacgctgattgatgacaacaatgctatcatcaagaccagcctgtgcgtggaggtccggtatcaggccactgacggcacagtgggctcctgggacgatggggacttcctgggagatgagtctcttcaagaggaagagaaggacagccaagagacggatggactgctcccaggctcccggcccagctcccggcccccaggagagaagagcttccggagagccgggaggagcgtgttctccgccatgaagctcggcaaaaaccggtctcacaaggaggagccccaaagaccagatgaaccggcggtgctggagatggaagaccttgaccatctggccattcggctaggagatggactggatcccgactcggtgtctctagcctcagtcacagctctcaccactaatgtctccaacaagcgatctaagccagacattaagatggagccaagtgctgggcggcccatggattaccaggtcagcatcacggtgatcgaggcccggcagctggtgggcttgaacatggaccctgtggtgtgcgtggaggtgggtgacgacaagaagtacacatccatgaaggagtccactaactgcccctattacaacgagtacttcgtcttcgacttccatgtctctccggatgtcatgtttgacaagatcatcaagatttcggtgattcactccaagaacctgctgcgcagtggcaccctggtgggctccttcaaaatggacgtgggaaccgtgtactcgcagccagagcaccagttccatcacaagtgggccatcctgtctgaccccgatgacatctcctcggggctgaagggctacgtgaagtgtgacgttgccgtggtgggcaaaggggacaacatcaagacgccccacaaggccaatgagaccgacgaagatgacattgaggggaacttgctgctccccgagggggtgccccccgaacgccagtgggcccggttctatgtgaaaatttaccgagcagaggggctgccccgtatgaacacaagcctcatggccaatgtaaagaaggctttcatcggtgaaaacaaggacctcgtggacccctacgtgcaagtcttctttgctggccagaagggcaagacttcagtgcagaagagcagctatgagcccctgtggaatgagcaggtcgtctttacagacctcttccccccactctgcaaacgcatgaaggtgcagatccgagactcggacaaggtcaacgacgtggccatcggcacccacttcattgacctgcgcaagatttctaatgacggagacaaaggcttcctgcccacactgggcccagcctgggtgaacatgtacggctccacacgtaactacacgctgctggatgagcatcaggacctgaacgagggcctgggggagggtgtgtccttccgggcccggctcctgctgggcctggctgtggagatcgtagacacctccaaccctgagctcaccagctccacagaggtgcaggtggagcaggccacgcccatctcggagagctgtgcaggtaaaatggaagaattctttctctttggagccttcctggaggcctcaatgatcgaccggagaaacggagacaagcccatcacctttgaggtcaccataggcaactatgggaacgaagttgatggcctgtcccggccccagcggcctcggccccggaaggagccgggggatgaggaagaagtagacctgattcagaacgcaagtgatgacgaggccggtgatgccggggacctggcctcagtctcctccactccaccaatgcggccccaggtcaccgacaggaactacttccatctgccctacctggagcgaaagccctgcatctacatcaagagctggtggccggaccagcgccgccgcctctacaatgccaacatcatggaccacattgccgacaagctggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgagccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacccgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacggtcaggcttctccggcgctgccgtgtgctgtgcaatgggggctcctcctctcactccacaggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacgagcttcatctggttcctgaaccctctcaagtcggctcgctacttcttgtggcacacgtatcgctggctgctcctcaaactgttgctgctcctgctgctgctcctcctcctcgccctgttcctctactctgtgcctggctacctggtcaagaaaatcctcggggcctgagcccagtggcctcctggccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaaggccgccagctcccgccagccgctccccagccctgccgcatttcctttcagtggcttggactctttcccatctcccctggggagcctgaggagcccagcgtccacttttcatgccttgggccgagcctgcctcctgcttgcgggggccgcctgtcctcactgccccaggctgcggcttgcccagtcccgcccctctgacccctgcctgtgggctggggagccttggatggggtggggacctggaatgggtctttcttgccccacctggctgaggcgccacccttcttcaggcccaggctccagaggaagactcctgaaaccctccccaggttttccaagtacaggattgaagctttagtgaaattaaccaaggaccatgggtcagtgcccagggctttaaaaagaatgaacgagcaaaaggtatccccgccgtgacccctgcagatagcaccggtatttgatccgcagcaggggccagaccctgcccacaagtcccagcgcggatgtttctgccactgctgggctccacttggctcctctcacttcccagggggtcgcctgtcctgcctgtgggtttccatggcttcccagagttccctctgccccagccagcgcctccaggcccagctgaggagctgtgagaagcagcagaggggactccccatcccgggcacaccctgtcttcccacccctgcccccttgcccttccagccctttcagctgcaggtgggagctggcccgtcaagtgctgcccctgcctgtgtctgggtttctgttggctgtttttcttttcttggagtggtgatttttctctaaataaaagaagtcaagcactga

SEQ ID NO: 27181 - DNA, 5184 bp, Homo sapiens
  misc_feature (286)..(286): n is a, c, g, or t
tggagtgacgtcaggatcttggcacatccagtcctagggtttccctctgtctctggccagccctgagccccgtagccgtgagttctgcccaggccctgtgagctcaccagagccacagactcacagcccagaggtggcttcttccttcaggaactgaagaacccccatgaacaccaacatctccaggttctgagaacagaacctgggaaattgatgacttcctcatgatgaccgatactcaggatggccctagcgagagctcccagatcatgaggtccctcactcncctgatcaacagggaggaggcatttggggaggctggggaggcggggctgtggcccagcatcacccacactcctgattcacaggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgagccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacccgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacggtcaggcttctccggcgctgccgtgtgctgtgcaatgggggctcctcctctcactccacaggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacgagcttcatctggttcctgaaccctctcaagtcggctcgctacttcttgtggcacacgtatcgctggctgctcctcaaactgttgctgctcctgctgctgctcctcctcctcgccctgttcctctactctgtgcctggctacctggtcaagaaaatcctcggggcctgagcccagtggcctcctggccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaaggccgccagctcccgccagccgctccccagccctgccgcatttcctttcagtggcttggactctttcccatctcccctggggagcctgaggagcccagcgtccacttttcatgccttgggccgagcctgcctcctgcttgcgggggccgcctgtcctcactgccccaggctgcggcttgcccagtcccgcccctctgacccctgcctgtgggctggggagccttggatggggtggggacctggaatgggtctttcttgccccacctggctgaggcgccacccttcttcaggcccaggctccagaggaagactcctgaaaccctccccaggttttccaagtacaggattgaagctttagtgaaattaaccaaggaccatgggtcagtgcccagggctttaaaaagaatgaacgagcaaaaggtatccccgccgtgacccctgcagatagcaccggtatttgatccgcagcaggggccagaccctgcccacaagtcccagcgcggatgtttctgccactgctgggctccacttggctcctctcacttcccagggggtcgcctgtcctgcctgtgggtttccatggcttcccagagttccctctgccccagccagcgcctccaggcccagctgaggagctgtgagaagcagcagaggggactccccatcccgggcacaccctgtcttcccacccctgcccccttgcccttccagccctttcagctgcaggtgggagctggcccgtcaagtgctgcccctgcctgtgtctgggtttctgttggctgtttttcttttcttggagtggtgatttttctctaaataaaagaagtcaagcactga

SEQ ID NO: 27182 - DNA, 4832 bp, Homo sapiens
tggagtgacgtcaggatcttggcacatccagtcctagggtttccctctgtctctggccagccctgagccccgtagccgtgagttctgcccaggccctgtgagctcaccagagccacagactcacagcccagaggtggcttcttccttcaggaactgaagaacccccatgaacaccaacatctccaggttctgagaacagaacctgggaaattgatgacttcctcatgatgaccgatactcaggatggccctagcgagagctcccagatcatgaggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgagccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacccgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacgggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaaggccgccagctcccgccagccgctccccagccctgccgcatttcctttcagtggcttggactctttcccatctcccctggggagcctgaggagcccagcgtccacttttcatgccttgggccgagcctgcctcctgcttgcgggggccgcctgtcctcactgccccaggctgcggcttgcccagtcccgcccctctgacccctgcctgtgggctggggagccttggatggggtggggacctggaatgggtctttcttgccccacctggctgaggcgccacccttcttcaggcccaggctccagaggaagactcctgaaaccctccccaggttttccaagtacaggattgaagctttagtgaaattaaccaaggaccatgggtcagtgcccagggctttaaaaagaatgaacgagcaaaaggtatccccgccgtgacccctgcagatagcaccggtatttgatccgcagcaggggccagaccctgcccacaagtcccagcgcggatgtttctgccactgctgggctccacttggctcctctcacttcccagggggtcgcctgtcctgcctgtgggtttccatggcttcccagagttccctctgccccagccagcgcctccaggcccagctgaggagctgtgagaagcagcagaggggactccccatcccgggcacaccctgtcttcccacccctgcccccttgcccttccagccctttcagctgcaggtgggagctggcccgtcaagtgctgcccctgcctgtgtctgggtttctgttggctgtttttcttttcttggagtggtgatttttctctaaataaaagaagtcaagcactga

SEQ ID NO: 27183 - DNA, 2767 bp, Homo sapiens
ccagactgggaggcaccagggagatcatttggtctagtctttatcttttctagaggaagaagtcaacgcccagagaggggtagccacttgcctagggtcacacagcaagcctcctgaggggtccagtgctcctgcccctgcccttcactgtcataggaccctcaggcagcctggcaggggcactgaagatgagcagggcatgggagcctgctcaggcagcccttctccccattccaggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacgagcttcatctggttcctgaaccctctcaagtcggctcgctacttcttgtggcacacgtatcgctggctgctcctcaaactgttgctgctcctgctgctgctcctcctcctcgccctgttcctctactctgtgcctggctacctggtcaagaaaatcctcggggcctgagcccagtggcctcctggccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaaggccgccagctcccgccagccgctccccagccctgccgcatttcctttcagtggcttggactctttcccatctcccctggggagcctgaggagcccagcgtccacttttcatgccttgggccgagcctgcctcctgcttgcgggggccgcctgtcctcactgccccaggctgcggcttgcccagtcccgcccctctgacccctgcctgtgggctggggagccttggatggggtggggacctggaatgggtctttcttgccccacctggctgaggcgccacccttcttcaggcccaggctccagaggaagactcctgaaaccctccccaggttttccaagtacaggattgaagctttagtgaaattaaccaaggaccatgggtcagtgcccagggctttaaaaagaatgaacgagcaaaaggtatccccgccgtgacccctgcagatagcaccggtatttgatccgcagcaggggccagaccctgcccacaagtcccagcgcggatgtttctgccactgctgggctccacttggctcctctcacttcccagggggtcgcctgtcctgcctgtgggtttccatggcttcccagagttccctctgccccagccagcgcctccaggcccagctgaggagctgtgagaagcagcagaggggactccccatcccgggcacaccctgtcttcccacccctgcccccttgcccttccagccctttcagctgcaggtgggagctggcccgtcaagtgctgcccctgcctgtgtctgggtttctgttggctgtttttcttttcttggagtggtgatttttctctaaataaaagaagtcaagcactga

SEQ ID NO: 27184 - DNA, 550 bp, Homo sapiens
gattaatgtaaactttgtgtctctgtcctcaagacctgactttcttctttctcagaagtttcacgtatgctctagagctcttttcactgtttctagtgtttgttctcagagcatgagcttcaccatgtatttagtttaacttaatcactaaaagaataaaatgtacattgtctgcacactgttgccccttcccagaagttattttttattgttttagaatagatactcacatatcctatgtaaaatgtttgttcccaacagagggacctttctacccagtccctagaccccactcagaagaaacagcttcactcctgatacctcagatacacaggaatgtggttataaattttcctcctattgccttgtaattataagttagataacctgagacagagtttggaactagtgctttcttgcttctaagcagggacttagacagaagccatgggaatgtgagtctggcttacttttgctatgatttcctgctcttggtcattttcttgggccagaggcatgagagaagccatgaaagcccagcttttctttt

SEQ ID NO: 27185 - DNA, 466 bp, Homo sapiens
cctgatacctggaccccactcccagatatatattttttaaggctcctaggtgattttaaatgtgcagcccaggttgaaaattattgccttatagacacgtgcccagtttccctgtgttttttttttcttaaaaaaaaaaacaaaccctttttgttatatcacatttactattctctcttttttcttttctttttctcttttttggggggcagggttgggggaagattgtctatatacctgtatcatttccggttaccatactgaccagaagaaatgagaagtaccaaattctaaccagcatgcttagataaaaggattcaaatggaaggtttctacatgccttcttgggttattgaatacttcctgtgatttttaatttctctgtaaaagataactctttttttggcatcctccctccccacttcatttctttcagcatgggtgcttatcaaatatctttaattaa

SEQ ID NO: 27186 - DNA, 758 bp, Homo sapiens
gggaactgggactgggatgtggcccatgaaggggcttcagggagtgactggcaaagtcctatttcttgacctgtgttgtacttaccagggtgtttgcgtcaaaatactttatcagctacacatttattcatataatattctacttttatttttcaatgaaaaggttaacgtacatacataaatctgatcatgtcactgccctgttacacctttcagtggcttcacagtacttgtaaaaaaaagtccaagctcctttatatagtagacaaggcctggcagcatctggctctctacccaaagcctcaacacttgctagtttcctccctacactaaattttcagttcctcaaaagcactctgctttcttttatctccaggcctttgtacagcagctacttgtgcttgaacagtcaagcacggctcctttttccccttcacgtggctggttcctatctgtccttcaggactcagcaggaaagccttccctgacactccaatgttgggcaaagtattcctagatcttcccattacacactgtagtttcccagtcacagcacttatcccactactagtattaatatgctaatagtattagtatttatatcttccatagaccaacaactccaggcaaaagagatacataacacgtcttgaaatttttgtatctccaatgcctaataaaatacccagaacagagcaagtatacaataaacttatattggccgggcgtgttgggcgataaatcatgtaatcccagca

SEQ ID NO: 27187 - DNA, 377 bp, Homo sapiens
ttttttttttttgagacaagatcttgctgtgttgtccaaggtagagtacagtggtgcaatcatagctcactgtaaccttgaactcctaggctcaagcagtcctcctgcttagcctctcaaatagctgggaatacaggcatgcaccaccacacctggctgatttttaaatttttttgtagatggagatcttgccatgtttcccaggctggtctagaactccaggcctcacgcaatcctcccgcgtccttccaaggtgatgggattacaggcttgagccactgggccccgcgttctcattcttcagaaccctactgcaacatcatgccccctgggaagttttcccacctgctctgttgttctgcacttagtgttccctt

SEQ ID NO: 27188 - DNA, 448 bp, Homo sapiens
gccaaaaaggaaatgaccatgctgtggtattagagacaaactagaggaggagagcattttagatagagtgtgcagcaaaggcctctccgaggatgtgaaatttaagcgtaggtggaggataaggagtcagtcatctgaagggtagtgacaggaaggttccagctgtagagccgggcacggtgactcaacgcctgtaatcccagcattttgggaggctgaggcgggcagatgacgaagtcaagagatcaagaccatcctggccaacatggtgaaaccctgtctctactaaaaatacaaaaattagctgggtgtggtggcacacgcctgtagtcccagctacctgggaggctgaggcaggagaatcgcttgaacccgggaggtggaggttacagtgagccaagatcacgccactgcactccagcctggagacaaagcaagactctctcaa

SEQ ID NO: 27189 - DNA, 740 bp, Homo sapiens
ctctagaggtcccccctagtgttagaagtttcaatagcgaaggacacgtgaattctatgcagcgaaagtttccagacacgttagcctaagaatttcgagtcatgcaaaaaataaagtcccagagtcgcagggttaagcaaaatcagagtccagggccccagtttcccaggtggcagggcacctagcagtcgattctcccctaagaactggcatcaaggagtccagctcctcccgtaactaacgtgtggcccaggcgagctgctgagtgctaataatagcagcaaacaccacaagcgtgccaggttctgctttcagcactttacatattttaactggtgaggcaggtgctcttggtaccaccccactttagtaaggagaaagagtcatgccattgggaagtagcagaggatgcaaactcaggccttcaactctagagtctggatctaaaccggtgcttcaaaacctggtggggttttttaaagtccatttctacgcctcacagactaatactttatcaacctggctcaaatatcacagcattttcacattgctatacaagtttcttttctttttcttttttctttttttttttttgagacagagtcttgctctgtcgccaggctggggtgtagtggtgcgatctcagctcaccgcaacctccaactcccgggttcaaatgattctcctgcctcagcctccgagtagctgggactacaggcatgcaccaccgcaccgggctg

SEQ ID NO: 27190 - DNA, 438 bp, Homo sapiens
tctctccctccatctgcctcccattatagattgtatgttcttgtttttctacatgtgtggtaattttttgttggatgctagacatggtgaattttatgttgttggatgctggattttgttgtcttcctttaaatagtttgtgctttgtcctggggcatggttacttggaatgagttcagtccttctgaggctcactcttctgctatgttagggcaggtgtagagcagcatgtagtgagcactcattcggccctgctcccggggcaaggccttctgaggattttttcagtcctgctcctgtggtgatgcctttttaagattctccgaatgctgtgtgctttaggaggtctcaccaccgaacacacacagcattaataaactaggtaataatcacctcataatctatctggtgggaacacagatgattcctggccctggg

SEQ ID NO: 27191 - DNA, 813 bp, Homo sapiens
gatcatagtgcatggcttatagagcagttttgaggatttcatgaacaaaaaaacaaaggtaaagcacttagccttctgcctggcatgagtaaaccctcaggaaactgtagttattatttagtagccaggaaaatacagaacacttaatctgttggctccctggtgtttctcgaactgtcagcaaacacttccacatcaccagccagcagagccattcatcaaacacctttgcctttgtctgtcaggcctcccacttcaacaagtgtccctgggtttaagtcagtaacctcctaggcacggaaagttgcctcacgcatgtgacatgcgagcacgtctctaaaggggcagaggatctggcaaaaacatagactcgcaacttgtctgtttcctgagacacccacaattggcctcgtggaagtggttgacttcttcccatagctgcctgtgtcttacttcatcgcctcctccaagcccagggccagccctgcctggctgggggatcatgacagtctttgttcccatatgggcaaagtcttttgaaaagagggaaagatcattagttagctgtcagcctccagcgtggttaggtcatgagtaattcttctagagagccagagcactggcaattcatttggtcgagaacgttttatctacttgaacggcgtagcgaggaaataaatggaacaagttatatcaaaatctctgtcaactgaacaattccttaccaatccaacaaggagtatgacgacgatgccacttttcctacctttgagaggtcatgcacagacaccgcacatgcacacaccacattat

SEQ ID NO: 27192 - DNA, 1800 bp, Homo sapiens
cagtgagccgaaatcgcgccactgcactccagcctgggtgacagagcaagattccgtgggcttggtggaggggcaggattccgggcaggagccttgcctctcaggtggcgggctctgcgaccctgtgagatggacgggacggaaggcagtgtcgggcagcccggccccactgagcggtcccaccgaagcagcgtgtcctccgtgggagcccgagcggctgacgtgctggtatacctggcagatgacacggtggtgcccctggctgtggagaacctgccctcgctccgtgcccatgagctgcactgcgccgtccgcgaggtcctgaagcttccggacatcgccctggatgtcttcgcgctctggctggtctcccctctgctggaggtgcagctgaaacccaagaaccagccctacaagctgggacgccagtggccggagctgctgctgcgcttcaccagtgccccggacgacgacgtggccatggatgagcctttcctgcagttccgaaggaacgtgttcttcccaaaggggcgggagctccagatccccgacgaggaggtcctgcggctgctctatgaggaggccaagggcaacgtgctggctgcacggtacctgtgcgacgttgaggactgcgaggctctgggcgccctggtgtgccgcgtgcagctcgtgacctaccagcccgactggccggcagcctgcgacctgagggagaagctggactccttcctccctgcccacctctgtaagcggggccagggtctctttgctgccctccggggccgtggggccagggccgggccgggtgagcagagcctgctgaacgcctaccgcaaggtgcaggaggtcagcagcgacggcgggtgtgaggccgccctgggcacccactaccgcgcctacctcctcaagtgccacaagctgcccttctatgggtgtgccttcttccacggtgaggttgacaagccagcccaaggctttttgcaccggggtgggcgcaaatcagtttctgtggccatcagcctggaaggtgtgcacgtcgtggacagcagagagaagcacgtcctgctgggcctgtgcttccaggagctgtcgtgggaccacacctcccctgaggaggaggagcccatcctgtggctggagttcgacagggacagcggggtcacacctgtcaacaagctcctcaagatctactccaagcaggccgaactgatgagcagcctcattgagtactgcatcgaactgagccaggcggcggagcccgcaggcccccaggacagtgcaactggctcgccctcagacctcagctcctcgccagctcctgttcagcgccccaagctgcggaggcagggcagtgtggtgtccagccggatccagcatctctccaccatcgcctatgtggaggacggcaaggggatcaggcgagtgaagacgaagagcaccacgtccttcttcagccagcagctgtccttgggccaggggagctacaccgtggtgcagcccagcgacagcctggagcagggctgaggacgctgcaccccgcaggaggagggcaactgggggccctggcccggcattgtcctcctgaggagcaggggctggctaacagtctcatgggtcaccacatggggagggctgcctcagcagatttctcagaccacggagaagtgacttttgcgcccggggccatgcccgggctgtgcaaagctggccagggcctcccacagggcccctctgcagcctgccctcccttccccccctttccccggatgctgggccctgctgctatctcaggaccatccg

SEQ ID NO: 27193 - DNA, 486 bp, Homo sapiens
acctagccattgacgcaggaaacaggtgcaaagatgcatgactcaagcctgtacctcctcattatgggatatttccaaccaaagggctgtctgtactcaggcctctatacccccatacccctaccccatacccaggctgttcccttcttcgtccccctttagcctcttgtcttccctatttctttcaatgcccttgacttcccagcctactcacaatcatgggcactgaattgcagagtctaaaaaccaatggctttggaaggggaacattatagtgatgttgaaaaatacattcgtttgcattcctagtgggccccagagtggcttaatccttaaacctcccagaagcatgcattctggaattgatgcttcttgacccaggcagaaggaaagctagccagatgagtcatgtgggcataggggtgttcccaacctccaaagccctggttccctggctttggacttctctccacccccaaggcccct

SEQ ID NO: 27194 - DNA, 95 bp, Homo sapiens
cccctgaagtttggcaagtgaagtgaagtgaaaacgggtttgggtcccagggaacgcacagtgaacttaataaatttggtcgacgtgcactttta

SEQ ID NO: 27195 - DNA, 356 bp, Homo sapiens
tggtgctcatattggtgtagtgaaggaaaaaataatttttcctctactcttgtgagttctcagctgggagccctgtaacaaaacataggttaacaagagaaaaacaaatggaagtttattaacatgcatatttcatatatacatgggagaaaattcagggaaagagtaattctcaaaaagatttcttagaactctggcttatatagcatcttcaacaaagaacagtacacttttagagaagtgacaagacaaaggaaaaagaccttcagtctttagcgatggcgaattgtaggaaggcaaatacatggggaactaatggcagataaaggctagttagtgcagtttgttatgtagat

SEQ ID NO: 27196 - DNA, 396 bp, Homo sapiens
ataggcatgccacttccaagagttctggaaaagccctggggctcccatgaattgtgtcccctgagctgattatgccaggaagtgaggaagctccctcatattgatgaggacagagccgtcacttttgagaggtgatgggtgtgttcattacccttgactcttggagcctaggggcatggtcagcctcacctgcaggatgggtgggatgcagagggtaagccagcctgcaggaagagccactgctcagacaatagtgggctcatgcctgcaatcccaacagtgtgggaagcttaggggaggcttgcttgaagccaggtgttcgaggttacagtgattgtgccatgcactgcagcctgggtggagtgacattgggataaacaattatattttagatac

SEQ ID NO: 27197 - DNA, 499 bp, Homo sapiens
atcttggatatgccactaaccaccagttctatgaccctgggttagttatttaatttctattattcgatttcctcatctgtaaaatgggtataatcatccttactgcttcctgagtggtcaggtggataaaatgagacatcactccatatgcaaaagtctagccagtgcttggcacagagaaggaactgattaaatgtgagttcttgtccctttccctagtgcaccataatgtaatgtgatatttcaaattttaatttaggcaattacttaagtagtaattgctattagtatttacatagctgctttgatccaagaagctcaaagggctttactaaatttagcattttaatagatgtttcatttgcattctgttgattctgtttacccacaccaaaacctggaattttctaaagcaagacaattagacagggaaacaagacagtatcttcatatgtaccggtatcccaggcctgagttttgtctgtttccctaagaagtc

SEQ ID NO: 27198 - DNA, 342 bp, Homo sapiens
tcagtccagcattagatctatctgattccaatttaacacaggcagcctggcagagctttcttcgtgggccccttgaaagtgggctctgctcccctccctttcctggaatgggagcttgtaaaataaagaagaatggatgggctactgtcaaagacaatccttgttcaaagctgtaagaatattttcatttccattaaagccaagaatttttcctaccctttcagtcctttagatagcagtattgtggagtgacattgtcagggtctgcacacagctcaagccacagtgaatgggccaggctgaggactccagagggaaggggtgaaagggactgactgcagg

SEQ ID NO: 27199 - DNA, 972 bp, Homo sapiens
gaaagtttattcagctgcttctttggttttggaaactgcatttgagctttgaatattttaagccctgaaaaaatattttaagcctttttatcacctaaggtcaagtctacttatttcattccttgcagagaccagggattctttgagacttgcagtgaaggtggctcaacacatttttcctaggggagaggggagtcaccctactaatgactttcattcctacatttaatgattttaaaattgttttgtgatcactgctttagttctgacttatgcagattgaaattttcatgaatttattttccttttctgcatataccctagtaatgcatggtccttatgcaattagtatatgccaaggcttgcaggagcatttttattttatgaaatgaaatttaaatttaaaaaaaattttgatcttaaattacatcttataaattttacttatcaaaaataagaaaactcaaattgctcccttttcgatcacatagatgcttcaggtgtatttcttacagacagattcaaaatactggtggccttagttccaaaataccaaaagaaggatttttttcaataataagttatagcttttgatttattacatttttaggtatctttcttatagccagtcttaaattacaatgtaagtgatagtttttggttaaaaattgttttgttaaaacttttatgaggataactttaaactgagaagaccaatatctaaaagttggagaattataactttctatttggttaataaaactatagttttgtgactatatcttaggcaatatcctttttaatttcattttccagagttaccaattaatctttaactgctaaagaagttggcttgctgtacgtgaatataaactaatgcaagtggattgctaaaagccacttcagtactcagattgctttgggattaagtgacaatacagtttttaaagtaccaggttttctgttgacata

SEQ ID NO: 27200 - DNA, 209 bp, Homo sapiens
taatagtgagttttatgggttctatgcatagttttaaaatcaaaaatctaaagtatttctgtctccttctatctttatgtgcacatgtatatgttctatgttgtatcacatatatgtatatgtccatacctatgtttatatattgtttatacatggtatcaaattaatgcaaaaataaatgagtactcatcaattaagtaaataatccc

SEQ ID NO: 27201 - DNA, 476 bp, Homo sapiens
ggcctttctttcctttatctgttatcccaaagtcacatttccagccctgtttccaaaccaaaccccatgcttggactactctttctcgaggccaattttttctcttcctctcattatttgaacaactcctgagaattcatttccttgaagaaaaacatttagcaaattccacatcataaattaccatgaccctcacatacctgtgtaccagccactcaccggatccctgggctacagaagtgatgattcagccctttgtcctgaatgagctcatggtcttacatggaaggaaaggcatgcagaaggaggttgaccttgcctttctctggcatacactcacattcatttccttgatgctcttgcttccccactatactgtaagcttctcaaggacaaggattttatctgttttgtttaccactgtataatttgtaccttaaaagagtatcctcagtaaacatttgacgaacaaatga

SEQ ID NO: 27202 - DNA, 1415 bp, Homo sapiens
  misc_feature (1154)..(1159): n is a, c, g, or t
  misc_feature (1161)..(1161): n is a, c, g, or t
  misc_feature (1182)..(1184): n is a, c, g, or t
  misc_feature (1199)..(1200): n is a, c, g, or t
  misc_feature (1203)..(1203): n is a, c, g, or t
  misc_feature (1206)..(1210): n is a, c, g, or t
  misc_feature (1231)..(1233): n is a, c, g, or t
  misc_feature (1236)..(1237): n is a, c, g, or t
  misc_feature (1239)..(1239): n is a, c, g, or t
  misc_feature (1251)..(1251): n is a, c, g, or t
  misc_feature (1281)..(1282): n is a, c, g, or t
  misc_feature (1285)..(1285): n is a, c, g, or t
  misc_feature (1294)..(1295): n is a, c, g, or t
  misc_feature (1298)..(1298): n is a, c, g, or t
  misc_feature (1301)..(1303): n is a, c, g, or t
  misc_feature (1310)..(1310): n is a, c, g, or t
  misc_feature (1319)..(1319): n is a, c, g, or t
  misc_feature (1370)..(1370): n is a, c, g, or t
attcactgtttcctagcaaccaggaaaaagcatgtgttcctgatgtctgtgagcaccagtctgagatgcgcggatgcttcagcatgcctccagaagcagagaaagaacaaaagcactggaaccggtctccggttgcctctagactcagagaagctgggtctaagtgtagtgttagctgcagatacctgctcagctggctaagcctttaacatggaaagaaggctcataaagaaggaaatgaaaaagctcttgggagattatattggcatcagacttcgggaaaatgaatttgacccaaaaggaagacggcaactcacctttctagatgatatggcacactatgacttggccatcagtgttgctttgcaatggctggatccctcagaagacttaacttggctggagtgggaggaactgaaaataccactccatggcagacccatatatccaaatcgtagagaacgagaagctatgattttatcatcttatgctggaatcttaatgaacagtatcccgattgaggaagtctttaaaatttatggggctgattcttctgccgattctggtaccatcaaggttccccgagtttcatctctccgcctctccttgcacccctttgccatgttaacagcacccaaagcagcagcatacgcccgcaaacagggtcacttagaaaattggaattgtaccatggaacttcataatagattctctgggagcagacgagaagcatcatcttaaaaccacagctcttgccagtacatttttctttacaactgtttttggtacaactgcactgaagtgttatttttgatgttgagctttcttcttttagaagcatattgcatggctacattttcttaaaaaaaaaaaactgtgaccttatgctacttcattgtgactggaagactgctggagaattcagaaagtatatagtatttctgtgttagagcaagctggctttgtagcacattttacaaatgtgtggcattgaatattgcacagtgatggagtgggaggcagatttccaaagagttaatccaaaataaaattaatctgtcattgattgcctttactgtgttctcatatgaaaagaatgtttaaatcatttcaataaagcattaaaaaaatgaaaaaaaaaaaaaaaaaaaaannnnnngnggggggggggttttttttttnnnaaaaaaaaaaaaaannttnttnnnnnaaaaaaaaaaaaaaaaaaaannnaanntnaaaatttttatnaaaattaattttttttttttaaaaaagttnnttnatttttttnnatnttnnntgaaaantttttattntttttttttttttttttttttttttaatttttttagggtaattttttattnttttttttttaattaaattttttttttttttttttattttttaaa

SEQ ID NO: 27203 - DNA, 1529 bp, Homo sapiens
  misc_feature (1268)..(1273): n is a, c, g, or t
  misc_feature (1275)..(1275): n is a, c, g, or t
  misc_feature (1296)..(1298): n is a, c, g, or t
  misc_feature (1313)..(1314): n is a, c, g, or t
  misc_feature (1317)..(1317): n is a, c, g, or t
  misc_feature (1320)..(1324): n is a, c, g, or t
  misc_feature (1345)..(1347): n is a, c, g, or t
  misc_feature (1350)..(1351): n is a, c, g, or t
  misc_feature (1353)..(1353): n is a, c, g, or t
  misc_feature (1365)..(1365): n is a, c, g, or t
  misc_feature (1395)..(1396): n is a, c, g, or t
  misc_feature (1399)..(1399): n is a, c, g, or t
  misc_feature (1408)..(1409): n is a, c, g, or t
  misc_feature (1412)..(1412): n is a, c, g, or t
  misc_feature (1415)..(1417): n is a, c, g, or t
  misc_feature (1424)..(1424): n is a, c, g, or t
  misc_feature (1433)..(1433): n is a, c, g, or t
  misc_feature (1484)..(1484): n is a, c, g, or t
attcactgtttcctagcaaccaggaaaaagcatgtgttcctgatgtctgtgagcaccagtctgagatgcgcggatgcttcagcatgcctccagaagcagagaaagaacaaaagcactggaaccggtctccggttgcctctagactcagagaagctgggtctaagtgtagtgttagctgcagatacctgctcagctggctaagcctttaacatggaaagaaggctcataaagaaggaaatgaaaaagctcttgggagattatattggcatcagacttcgggaaaatgaatttgacccaaaaggaagacggcaactcacctttctagatgatatggcacactatgacttggccatcagtgttgctttgcaatggctggatccctcagaagacttaacttggctggagtgggaggaactgaaaataccactccatggcagacccatatatccaaatcgtagagaacgagaagctatgattttatcatcttatgctggaatcttaatgaacagtatcccgattgaggaagtctttaaaatttatggggctgattcttctgccgattctggtaccatcaaggttccccgagtttcatctctccgcctctccttgcacccctttgccatgttaacagcacccaaagcagcagcatacgcccgcaaacaggtagagacggggtttcaccgtggtctcgatctcctgacctcgcgatccgcccgccttggcctcccaaagcgctgggattacaggcttgagccaccgcgcccggcccaactcttgggtcacttagaaaattggaattgtaccatggaacttcataatagattctctgggagcagacgagaagcatcatcttaaaaccacagctcttgccagtacatttttctttacaactgtttttggtacaactgcactgaagtgttatttttgatgttgagctttcttcttttagaagcatattgcatggctacattttcttaaaaaaaaaaaactgtgaccttatgctacttcattgtgactggaagactgctggagaattcagaaagtatatagtatttctgtgttagagcaagctggctttgtagcacattttacaaatgtgtggcattgaatattgcacagtgatggagtgggaggcagatttccaaagagttaatccaaaataaaattaatctgtcattgattgcctttactgtgttctcatatgaaaagaatgtttaaatcatttcaataaagcattaaaaaaatgaaaaaaaaaaaaaaaaaaaaannnnnngnggggggggggttttttttttnnnaaaaaaaaaaaaaannttnttnnnnnaaaaaaaaaaaaaaaaaaaannnaanntnaaaatttttatnaaaattaattttttttttttaaaaaagttnnttnatttttttnnatnttnnntgaaaantttttattntttttttttttttttttttttttttaatttttttagggtaattttttattnttttttttttaattaaattttttttttttttttttattttttaaa

SEQ ID NO: 27204 - DNA, 1534 bp, Homo sapiens
  misc_feature (1273)..(1278): n is a, c, g, or t
  misc_feature (1280)..(1280): n is a, c, g, or t
  misc_feature (1301)..(1303): n is a, c, g, or t
  misc_feature (1318)..(1319): n is a, c, g, or t
  misc_feature (1322)..(1322): n is a, c, g, or t
  misc_feature (1325)..(1329): n is a, c, g, or t
  misc_feature (1350)..(1352): n is a, c, g, or t
  misc_feature (1355)..(1356): n is a, c, g, or t
  misc_feature (1358)..(1358): n is a, c, g, or t
  misc_feature (1370)..(1370): n is a, c, g, or t
  misc_feature (1400)..(1401): n is a, c, g, or t
  misc_feature (1404)..(1404): n is a, c, g, or t
  misc_feature (1413)..(1414): n is a, c, g, or t
  misc_feature (1417)..(1417): n is a, c, g, or t
  misc_feature (1420)..(1422): n is a, c, g, or t
  misc_feature (1429)..(1429): n is a, c, g, or t
  misc_feature (1438)..(1438): n is a, c, g, or t
  misc_feature (1489)..(1489): n is a, c, g, or t
attcactgtttcctagcaaccaggaaaaagcatgtgttcctgatgtctgtgagcaccagtctgagatgcgcggatgcttcagcatgcctccagaagcagagaaagaacaaaagcactggaaccggtctccggttgcctctagactcagagaagctgggtctaagtgtagtgttagctgcagatacctgctcagctggctaagcctttaacatggaaagaaggctcataaagaaggaaatgaaaaagctcttgggagattatattggcatcagacttcgggaaaatgaatttgacccaaaaggaagacggcaactcacctttctagatgatatggcacactatgacttggccatcagtgttgctttgcaatggctggatccctcagaagacttaacttggctggagtgggaggaactgaaaataccactccatggcagacccatatatccaaatcgtagagaacgagaagctatgattttatcatcttatgctggaatcttaatgaacagtatcccgattgaggaagtctttaaaatttatggggctgattcttctgccgattctggtaccatcaaggttccccgagtttcatctctccgcctctccttgcacccctttgccatgttaacagcacccaaagcagcagcatacgcccgcaaacagggtgtcaagtcaagaaaggtaacaacaaataaaaatgccaccagcatctctgcaaaggaagcaaatgccacagaatggaaatcatcacaaaggttttcagacacacagccaaagcacaaagtcacttagaaaattggaattgtaccatggaacttcataatagattctctgggagcagacgagaagcatcatcttaaaaccacagctcttgccagtacatttttctttacaactgtttttggtacaactgcactgaagtgttatttttgatgttgagctttcttcttttagaagcatattgcatggctacattttcttaaaaaaaaaaaactgtgaccttatgctacttcattgtgactggaagactgctggagaattcagaaagtatatagtatttctgtgttagagcaagctggctttgtagcacattttacaaatgtgtggcattgaatattgcacagtgatggagtgggaggcagatttccaaagagttaatccaaaataaaattaatctgtcattgattgcctttactgtgttctcatatgaaaagaatgtttaaatcatttcaataaagcattaaaaaaatgaaaaaaaaaaaaaaaaaaaaannnnnngnggggggggggttttttttttnnnaaaaaaaaaaaaaannttnttnnnnnaaaaaaaaaaaaaaaaaaaannnaanntnaaaatttttatnaaaattaattttttttttttaaaaaagttnnttnatttttttnnatnttnnntgaaaantttttattntttttttttttttttttttttttttaatttttttagggtaattttttattnttttttttttaattaaattttttttttttttttttattttttaaa

SEQ ID NO: 27205 - DNA, 1613 bp, Homo sapiens
  misc_feature (1352)..(1357): n is a, c, g, or t
  misc_feature (1359)..(1359): n is a, c, g, or t
  misc_feature (1380)..(1382): n is a, c, g, or t
  misc_feature (1397)..(1398): n is a, c, g, or t
  misc_feature (1401)..(1401): n is a, c, g, or t
  misc_feature (1404)..(1408): n is a, c, g, or t
  misc_feature (1429)..(1431): n is a, c, g, or t
  misc_feature (1434)..(1435): n is a, c, g, or t
  misc_feature (1437)..(1437): n is a, c, g, or t
  misc_feature (1449)..(1449): n is a, c, g, or t
  misc_feature (1479)..(1480): n is a, c, g, or t
  misc_feature (1483)..(1483): n is a, c, g, or t
  misc_feature (1492)..(1493): n is a, c, g, or t
  misc_feature (1496)..(1496): n is a, c, g, or t
  misc_feature (1499)..(1501): n is a, c, g, or t
  misc_feature (1508)..(1508): n is a, c, g, or t
  misc_feature (1517)..(1517): n is a, c, g, or t
  misc_feature (1568)..(1568): n is a, c, g, or t
attcactgtttcctagcaaccaggaaaaagcatgtgttcctgatgtctgtgagcaccagtctgagatgcgcggatgcttcagcatgcctccagaagcagagaaagaacaaaagcactggaaccggtctccggttggtgagcgattctcaaaggggaatttgttaagagcaggcacttaatagaacagcccgagagacctgtaccacgattgcagcctctagactcagagaagctgggtctaagtgtagtgttagctgcagatacctgctcagctggctaagcctttaacatggaaagaaggctcataaagaaggaaatgaaaaagctcttgggagattatattggcatcagacttcgggaaaatgaatttgacccaaaaggaagacggcaactcacctttctagatgatatggcacactatgacttggccatcagtgttgctttgcaatggctggatccctcagaagacttaacttggctggagtgggaggaactgaaaataccactccatggcagacccatatatccaaatcgtagagaacgagaagctatgattttatcatcttatgctggaatcttaatgaacagtatcccgattgaggaagtctttaaaatttatggggctgattcttctgccgattctggtaccatcaaggttccccgagtttcatctctccgcctctccttgcacccctttgccatgttaacagcacccaaagcagcagcatacgcccgcaaacagggtgtcaagtcaagaaaggtaacaacaaataaaaatgccaccagcatctctgcaaaggaagcaaatgccacagaatggaaatcatcacaaaggttttcagacacacagccaaagcacaaagtcacttagaaaattggaattgtaccatggaacttcataatagattctctgggagcagacgagaagcatcatcttaaaaccacagctcttgccagtacatttttctttacaactgtttttggtacaactgcactgaagtgttatttttgatgttgagctttcttcttttagaagcatattgcatggctacattttcttaaaaaaaaaaaactgtgaccttatgctacttcattgtgactggaagactgctggagaattcagaaagtatatagtatttctgtgttagagcaagctggctttgtagcacattttacaaatgtgtggcattgaatattgcacagtgatggagtgggaggcagatttccaaagagttaatccaaaataaaattaatctgtcattgattgcctttactgtgttctcatatgaaaagaatgtttaaatcatttcaataaagcattaaaaaaatgaaaaaaaaaaaaaaaaaaaaannnnnngnggggggggggttttttttttnnnaaaaaaaaaaaaaannttnttnnnnnaaaaaaaaaaaaaaaaaaaannnaanntnaaaatttttatnaaaattaattttttttttttaaaaaagttnnttnatttttttnnatnttnnntgaaaantttttattntttttttttttttttttttttttttaatttttttagggtaattttttattnttttttttttaattaaattttttttttttttttttattttttaaa

SEQ ID NO: 27206 - DNA, 1242 bp, Homo sapiens
tgcagccctatatgcctgaaatgcctcccccaggtccctcgctgtaactggctgacatctactcaactgaaaaggctcatcttgaggattactctccaggaagcattctgttatcccctcaggccaggagctgaaatttactggaatcattttaagaagagaagaaacagtgactcatcctcctggaaagaaatttcaagggataaagcaccatggatctaacttatattcccgaagacctatccagttgtccaaaatttgtaaataaatcctgtcctcccaccaaccgctcttttcatgtccaggtgataatgtattcggttatgactggagccatgattatcactattcggaaacttggttataatggtttccatatcgcatttcaaacagcttcactctcccacaaactttctgatcctctccatggcaaccacggactttctgctgggttttgtcattatgccatacagcataatgcgatcagtggagagttgctggtactttggggatggcttttgtaaattccacacaagctttgacatgatgctcagactgacctccattttccacctctgttccattgctattgaccgattttatgccgtgtgttaccctttacattacacaaccaaaatgacgaactccaccataaagcaactgctggcattttgctggtcagttcctgctcttttttcttttggtttagttctatctgaggccgatgtttccggtatgcagagctataagatacttgttgcttgcttcaatttctgtgcccttactttcaacaaattctgggggacaatattgttcactacatgtttctttacccctggctccatcatggttggtatttatggcaaaatctttatcgtttccaaacagcatgctcgagtcatcagccatgtgcctgaaaacacaaagggggcagtgaaaaaacacctatccaagaaaaaggacaggaaagcagcgaagacactgggtatagtaatgggggtgtttctggcttgctggttgccttgttttcttgctgttctgattgacccatacctagactactccactcccatactaatattggatcttttagtgtggctccggtacttcaactctacttgcaaccctcttattcatggcttttttaatccatggtttcagaaagcattcaagtacatagtgtcaggaaaaatatttagctcccattcagaaactgcaaatttgtttcctgaagcacattaa

SEQ ID NO: 27207 - DNA, 329 bp, Homo sapiens
tgcagccctatatgcctgaaatgcctcccccaggtccctcgctgtaactggctgacatctactcaactgaaaaggctcatcttgaggattactctccaggaagcattctgttatcccctcaggccaggagctgaaatttactggaatcattttaagaagagaagaaacagtgactcatcctcctggaaagaaatttcaagggataaagcaccatggatctaacttatattcccgaagacctatccagttgtccaaaatttgtaaataaatcctgtaccggacgaagagtggatacggatagtagaggatgacatcgggcgggtggaccg

SEQ ID NO: 27208 - DNA, 1166 bp, Homo sapiens
ctcagtatcttaccagatgtactttgaagcatcagcaactaaaaatgataggagctgaaatttactggaatcattttaagaagagaagaaacagtgactcatcctcctggaaagaaatttcaagggataaagcaccatggatctaacttatattcccgaagacctatccagttgtccaaaatttgtaaataaatcctgtcctcccaccaaccgctcttttcatgtccaggtgataatgtattcggttatgactggagccatgattatcactattcggaaacttggttataatggtttccatatcgcatttcaaacagcttcactctcccacaaactttctgatcctctccatggcaaccacggactttctgctgggttttgtcattatgccatacagcataatgcgatcagtggagagttgctggtactttggggatggcttttgtaaattccacacaagctttgacatgatgctcagactgacctccattttccacctctgttccattgctattgaccgattttatgccgtgtgttaccctttacattacacaaccaaaatgacgaactccaccataaagcaactgctggcattttgctggtcagttcctgctcttttttcttttggtttagttctatctgaggccgatgtttccggtatgcagagctataagatacttgttgcttgcttcaatttctgtgcccttactttcaacaaattctgggggacaatattgttcactacatgtttctttacccctggctccatcatggttggtatttatggcaaaatctttatcgtttccaaacagcatgctcgagtcatcagccatgtgcctgaaaacacaaagggggcagtgaaaaaacacctatccaagaaaaaggacaggaaagcagcgaagacactgggtatagtaatgggggtgtttctggcttgctggttgccttgttttcttgctgttctgattgacccatacctagactactccactcccatactaatattggatcttttagtgtggctccggtacttcaactctacttgcaaccctcttattcatggcttttttaatccatggtttcagaaagcattcaagtacatagtgtcaggaaaaatatttagctcccattcagaaactgcaaatttgtttcctgaagcacattaa

SEQ ID NO: 27209 - DNA, 380 bp, Homo sapiens
cacagacaaccacaggtaagaactggcattatgtgaggtcgtgaaactgctcagcctcaacaatttctccttgtcactacatagggtcccagtgcacagggcttgggcctttgtcttagtcccttttcctaagtcatgagtggatccctggcctgcacattgttcctttatcactgtccttatgacatttctgttttctgtgctgccttgttccagcctgtccctctgtacaggaaatggaattttgtcttatgagtcatcttggtgtttgagccttttctcctacgggaacacttcccagtgctaaccgttggtctgcctcactcctgagcaatcagccagttcctgaatttctctgtgttctgaattgccccttagat

SEQ ID NO: 27210 - DNA, 551 bp, Homo sapiens
  misc_feature (214)..(214): n is a, c, g, or t
accataataggaatttccatacctcctattgggaaagacagttatcccctgtaagagataattccatgcaattatccataatagtatttccataacactattatgaaaaatagtagagttcctataaatcaaaaactattttaaaataaaaaaaaaatttttaaatgtttaatgtccccctaacaggtggagagaaggtgaaaaagaccaaganaccctcaaggtttcaggttctagtaatgacgagaactctgctcaggaacggaaggctggctttgtaccgcacagctctaccccatcaacaggaggccaaagactcaccatgcctctggtctgttccactgaccttccttttctacttgctgcttatccacaaaagcagaacatttcattcactagtcaagcccttgtctccgactcttgagttatcagatgggctgttgttgagccaacttttattggaagatgctacagatgaaaagacaagaccttcactaagggtcccttccaaaggtaaaagtgaaaagattcaaaataactcaaagggttta

SEQ ID NO: 27211 - DNA, 511 bp, Homo sapiens
agttcatccaaaacagttaaacaattaaagcagcaagtacctagtgcgacaggctctgctgggagcagaatgaagacagtctaaccaaaattgtaactctccctttcagaactccctaatcatttaaaaggtaggctcttgagcaaattgcttagtctttctctacttcagtttcctcatctataaaacaggtagggtaatagtgcttatctcatctacggtttgtaagcattaagccagttcatgtaaaatgtattagcagtgcctggcatggagtgagcactcaataaatgttagttttaatcagcatgggtaatatggcaagacccagtctcttaaaaaaaaaaaaacaaaactttaaaaattagctgaacgtggtggggcatacccatggtcctagatacttgggaggctcaggtggtaagatcgcttaagcccaagaggtggaggctgcagtgagccatgttcataccactgtactccagcttgggtgacagagtgaaaccctatc

SEQ ID NO: 27212 - DNA, 964 bp, Homo sapiens
tgcttttttcacttaatgttatcttggtaaatgtttatgtgctttgctgtaactgcagaaccaaaaatcaactgtttttggcacagtggttaagacaaagaaaggttttcatggggttatatttcagaagaggagacaggacagataatgaataagtaatatgatttcatacagtcatgagtacaatggaaaaataatgagatcagggatagacagtgattcagagatactttatgtaaatggctgtctgtaaaggaaacgtttgtgcaaagactgaacaaagtaaggaagtgagtctatgaaagatggtgaaggatgtttaagacagaacagcaagtgagaagtctctggaattaggaatcagccttttagagtgacaaaagaaagaaactttgggttgtagcagcataatgggaattgaagttagggggtaagggaggagccacagtataaaggaatgtctaggcaagtagtcagcaaactatgtcccatggagccaaatttagcccatgacctgcaaggtaaggatgatttttaaatttaagaggttgtaattaagagggaaaaaaatgacaacaaaggtcttcatgtggcccataaagcttaaaatatttactgtttgaccttttgtagaaaaagtagattaagttttattgcagcaatctgaatgagagtatagtgtggtctgtgtgtgtcaaacaggctgtagtggggtttggcacaatggaagtcaggaaaccaagtacagcctatttcattaaccctggtaagagatcagagatcatggcttggttgagagaaatgaaagcagtgagaaatgattagattaagagtaaatttttaaagttggtgtcaataagaactgctgagcaattgaattgcatatgccagaacacatggactattctccatttttagtttcaaaaggaatgtttacctatcatttttaaatctgtaggcatct

SEQ ID NO: 27213 - DNA, 371 bp, Homo sapiens
acacatgggtatcattaagtgtgcattttctatttagacagggacattgaaacagttcagaaacatctgtcaccagcatgatgtgttgagaagcaaaggaaatggaaatgggtgtctgttttctcaaaagcattagaatctgtaaacataaacatcctttttaaagatctgccaatttagaatgagtttatgggcttaatgcaatttttaaaaacggtgacggcctacataatcatgttaaactagaatattttccaaattttcagaggaaaaaaaaaacccatattatgtgtttatttatagccttatctcagtcttggaggaaaaaacatattgtagcatgtttcattttgcagagattggggtaatct

SEQ ID NO: 27214 - DNA, 616 bp, Homo sapiens
tcttccctgactaggcaaagatattttacctttgaagtaggttttaattgtttccattttataaaacctataaattgagggtcagagaaattaaataatgcaaaacacccagctagctaatgaggtataaagttttaaagtatattgttggttctaaagctacctggtttagatggttataaatagtgctattacaatagaaaaaatataactttcacatgaaaggtagttaattaaagatatgtttaagattattaagatgcttttattttttatgtaatgaatatggctataaaaggtataaatataatcatatgcaaagctaaaaagagttaagattttacttgagggaatagttttattttaaaagtctgttgaaggttaagacattctatagtcaaccatctaccttgttgaacttgcctagattccctttcatttaagtttattcatatataataggtgctatataaagtttattcatgtggagagctgggcacagaggctgacgcctgtaatcgcagccacttgggagtctcagccaggaggatcacttgaggttaggagttcaagatagcaagggcaacttagcaagaccctgtctcataaagattaa

SEQ ID NO: 27215 - DNA, 367 bp, Homo sapiens
ggaaacaaaaagaacatactgaaaacctgaaaactagaaaatacaataaaagaacaaggaagtcaatggatagatttaatagcagataaatcacagatgaagagagtatcaatgaactggaagatcagttcagagaataaccaggatgaatcactgaagagatagacaaacaaaaaatacaaatgaggggaaagtgacattaaagacacaatgagaaagctgatatgcaagtacctgtagttatagaaagaatgaaaaaagggaaaagagaatgtactatttgtatagttaagggctgagaagtttccaaatgtgatgaataacatcaggccacaaattcaagaagtgccaaataggataaaaacaa

SEQ ID NO: 27216 - DNA, 648 bp, Homo sapiens
ctgtaggattagagcatggagcggttaactggagaagagactggtaaagctgaccagcgttagcctctaaaggaccatatgtgccaagtttaaacaattctgtaggtgtcaggaacaagcagaagaatgtgtgagatttggcaaggggagtgggtcaggactctagagaatgtgtggtgaataaatactggctggagctagagctggtaaacagaaccctcagatggtaggatgttgtctctgggagttaagaatcagacctggtttgggagcagattaacctaccatgcacctaggcacttttccaagtgctggagtacagtggtgaattactgctcccatggagctttcatccagaaagggtagacagatgaaacaacatacaggcacaaaagggcacatacacactctcaaaaccagaatgccgcgttgcagataaaatgttccaaggcagcactctccaagttaagcgttcagagcagtctggtgtctgcactgaatatttccctacaatatcgcagggaaccttcttatagtccgcatctcaggcatttactgcgaagtttttacaagtaaaatgacgaatacagtatttgttcttgatgtatataatactgaatgcactctacaaaaagtgtttcaaataag

SEQ ID NO: 27217 - DNA, 528 bp, Homo sapiens
aataatgtttgaagtgattaatctgctcattaccctgatttaattatgatacaatgcaatacatatactgacacatcaaattgtgtcccataaatatatgcaattatgtgtcaattaaaaataaaaataaagccaggcacagtggtgcatgcctgtagtcttggctactcaggaggctgaagttcgagagtcaattgagcccaggagtttgagtccagcctgagtaacatagtgagaccccaactctaaaaataaaataaataaaatcattttaaaatttaataaataaggagcagggcaagatgggcaaataggaacagttctggtctgcagctcccagcgagaccaatgcagaaggcaggatatttctgcatttccaactgagatacacagttcatctcaccggaactggttagagggaaagggcagcccactgagggtaggcagaagcagcgtggggtgtcacctcatctgggaagtgcaaggggctggggacctccctcccttagccaagggaagccctgaggg

SEQ ID NO: 27218 - DNA, 441 bp, Homo sapiens
caagctttccttaataagcctgtcaaatcttcttttattctagttgatggtagtgccacacttactggacaaaagccttaaagtcatgctttactcccattttctcatatctcagatgcttactgttaggaagtcctgttagtaccaccttttgggcatctaaaattgaaccacttctcatacctcctacctccattgctatcacctcagtccaagtcaccatcagtgcttcctaatcctacacccagttttaacccttgccccttataatatattctcaacatagtaatgagggagattttaaaatgtaaataagattatgacacttcaggccaggtgcggtggatcacacctgtaatcacagcactttcggaggccgaagcgggcggatcacaaggtcacgagttagagaccagcctggccgacatggtgaaaccccgt

SEQ ID NO: 27219 - DNA, 174 bp, Homo sapiens
cagtgtctacttataaacatgttttttgaactactgtttttgtgacaacatgcctttttcccagaaaatctcaggttaacattaaataggcactggatgtttatctgatcttgtttatagaaacacaagaaaattttaaccttgtatatactttactcaattaactaggtaaga

SEQ ID NO: 27220 - DNA, 267 bp, Homo sapiens
ctgtattttttgcacatatttgttgtgaacctaaaacttctctaaaaaaaaaacagagtccactttaaaaaattacaatgggaaacaatagataagctaaaatagtaaaataaaattaaccaataaaattaactgagttaaaatcattgagttttaaaacaatgtaatgtaatatgtaatgtaatgtaagtacattggaactaatgtaagtgacctaaattgtgttttatcgtggtatgaaatcaataaatatctgatattggtaaa

SEQ ID NO: 27221 - DNA, 350 bp, Homo sapiens
taaaaacatttctgtagagaatttaactggtattttaatagaagttttattatatctgtatatcagtttgtgtaatgctgatatttaacaatattaatcatgcctatttatgaattagaaatatctttttgtttgaatattatttattttctaactttttttagattctaatgtacagatctttcacctttttggttacattcatttctaagtatagttactgctgcaattattgtagatgggattggtttttggttttattttcagatactttattgttagtgtatagaaatgttactgaattttttatgttgattttgtgcaagtttaataaatttgtttattctaat

SEQ ID NO: 27222 - DNA, 1956 bp, Homo sapiens
ttaaaattcattagggttggaaggaatggagtaagagcacttttctgcagggatgaaccatgggggtgggcacctgcaccgagggtcccttgcctaccctaggccactgcacacctctatgccttgcagtggggaagcccatcgaggtacagaagacgctgcatccctcggaggaggaggtgaaccagctgcaccagcgttatatcaaagagctgtgcaacctcttcgaggcccacaaacttaagttcaacatccctgctgaccagcacttggagttctgctgagcccaaagggcagggccaacattagggagcccagcaggaggtgctgtgctgagaagacttcctggaggtgtttgttgaacatatctgcagagccttcccagactcctgcaaatccaacccatatcaggctgtaagtcagagcaggcaatgcagaagaggagaccagaccaaggggtcagctggggctaggacagtgagggctgctagaggggctgggcctctctttgcacatggacactgggcccctctctatattgagtggtctgttaacattcattggtggctgattccaaaagatgagagccaaagctgcacggactcgagtcctaggctgcacacctcacaagcatctcttctactgcattctgttggtcgaagcaagtcacaacccagcagattcaaggagtaaggaataggatccccctctggatgggaggagcagcaatgtcatattacaaaagggtgtggacacatgcagggattcttactgccgtctttgcaaacaatccaccaaaacttaaaaactaaaagcctgaagcacaagcactctccaccccaggcacacacaccctggaattccctgtgtgaccatggtaccaccactgtgtgtcccgaggatcccagctcagctttgcatcgctgccctatctccctctcgctctcccctgttgatccctcatgcacagccacagcgagctgtctaaaacacaaagctgaccgcgccatttcctactcagcatccttccatgaccctccattgctcctaggatagggtttggaccagtctgaatccagaggatcaggatccagcaggaaccagaggataatttgaggagggtttaaaaaggaaccattttttgaggtgtgtgcactgtttccaccctgaggcctggaaggatgaatggaagcagcagttcctgaaccaggaagactcatgtgtgggggccattgctggtcaaggggcacgaacaggtctggtgaccctgcaagggaggagccaggagcaagcattcccacttcaccttcctccattcagtctgctgccaagttccccactgcctgagcccaactagaagctggagggaaggagggcctgtggctgcagtccaggcatgtaggcctcctgggaaagggagaatggcaaagacaggcagagtggatctggaggggtcaacggaagacggaacatgtccacttccaggcccgagcttctcagcctgccgtttgccactctccagcatctggcccagcctgtccatcctcatctctcttcctcccttactccgtgctcccatcactcggaaccatttgcatttctttgtctcagctatattgtctcacctctgagtttttgcccatgatgttggatgccatggaatgccatatcctccccattatctcccccttgtctggataattcctactcatcctacaatactgattttatctgtgcaaagaagtcttccccagtgcctctggttgacaggggtttcctctggcttctccagactttctgttcctccaccacagcccttagcaccctggggaggaggtgttgctgtccaggtaaatgctgcgccaatgcccctgcctctagtgcactccctccagcctacccacaaacaggacctgcatcctgtctcacaaataaaactgaactcttgaaatggtg

SEQ ID NO: 27223 - DNA, 661 bp, Homo sapiens
aagagggttaggataggtggtgggaatagaggctgacagcagttttcagatgtccgtgtgttcatgcacgcagtatggcccaggtaagttcaaaaccttattcttaggctatttcgatcaaccctgccaggcaattttaaattcttggtgatgtagggcagggacactgtggatggctgaggaaactctgggctctgctggctaaccagcttcgctccactctgcagaggctgtctcatcttttgtgatctgcaaattcttgctttggtcttcatgtgaactctcagggaatttgagcagttcagtctgttaccagtgttgtgagcctacctggtcattttagctgttgcttttgtaacgtaggcttttggttgttcctcagttagaattgtgggactttcctgaaccttctgttcttgtttcttccttgaaagtaactgaatcctgggtattacacaggatttgccatagcggatcaagcaattggtctatcaagtatgctgtcttgtccccggcagtggctaatgctgcttcttcttgtcaggcaaacaggagatttcacaatttagcactgagatctaaagatgtaaccaggtctcctagtttacccttcagctttgacgcagactacctaatttcctaaggtcttagcatccacctg

SEQ ID NO: 27224 - DNA, 706 bp, Homo sapiens
ggccaatatacctgacaaacatagaagcaaatgtcctaaacaaaatactagcaaaccaagttcaacagtacattaaaaatgtcatccaccataatcaagtggaattcatcccaggatgcaggaatgatttattggaagtaaagcaatatatgtgatacaccacattaacagaaaaaaaggacaaaaccacatgatcatcctaacggatgcagaagaagcattcaacaaaattcaacacctcttcataataaaaactctcaacaaattttgtagacatacctcaacacaataatggcaatatatgacagacccacagctaacgtcgtactcagtggagaagcttttcctctaagatcaggaaaaaaacaagaattcccacttttactgcttctattcaacatgtgctagaattccccatcagagcaatttggcaagataaagaaataaaaagcacccaaattggaaaagatgaagtccaattatctttatttgcatataacatatcatatatagggaaaacccagatagctagattagatagatagatagatagatagatagatagatagataggtagatagataaatgatagatagataaatagagtctgttagaactaatacagaaattcagtaatgttgcaggttaaaaaatcaacacatgaaaatcagtaggtttttaatacattagtactgaactatctgaa

SEQ ID NO: 27225 - DNA, 1117 bp, Homo sapiens
cgtgacgcgtgggtcgacccacgcgtccggacaaggaggaggaggaggaggaggtctggctagctgtccctaacgtcatttcctggtctcaactcttttaagaccctgacatactctgagattggagtgaagatttctgtgacatgctggggtatctctgcattagccagattggacatatgtaaagggacatcagtatatctggatcatcagattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggaccctctttgcaagttcagtgcttaacctgaccgaactggctgcccttcggcctgaccttgggaaactgaaaaagattctgtattttcacgagaaccagttgatatatcctgtcaagaaatgtcaggagagggatttccaatatggatacaaccaaattctttcatgccttggcgagcatgaaagatggtagatattcacacatcaagatatataaatatgtgattcattttgttatctctgggggagaacatatagtagctcgattctgatccaagagaccaggttcagaaacacctaaaaaccatatgtaaacaataagttaccacaagtaccgaattgacacacattatcgcctcctaataacacccatataacaaatactgatacaaaaatggataatactcagaggaccaactaaaagagaaaagagagtagacctatcgaacataatgccacgaattggatgacgtggatacaacatgggacaccgcagatgaaagcagataaaatgagagagtgagagaggataaactacgagaatacaatcggatctattaggtacgactagaacacagcaactaggtgcacccgctacggcagcagcaccgaacgatcccgaacgacctactaaata

SEQ ID NO: 27226 - DNA, 880 bp, Homo sapiens
  misc_feature (847)..(847): n is a, c, g, or t
gcggccgcgggggaggggcacggcgtcagcgcgtcgccggctgggccgcgccggtggccaggagggagagacaaggaggaggaggaggaggagatctctgcattagccagattggacatatgtgaagggacatcagtatatctggatcatcggtatctctgcattagccagattggacatatgtaaagggacatcagtatatctggatcatcagattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggaccctctttgcaagttcagtgcttaacctgaccgaactggctgcccttcggcctgaccttgggaaactgaaaaagattctgtattttcacgagaaccagttgatatatcctgtcaagaaatgtcaggagagggatttccaatatggatacaaccaaattctttcatgcctggtggctgatgtggttgtattcaactcagtttttaatatggaatcatttctcacttccatgggaaaatttatgaagctgattcctgatcacagacccaaggatctggaaagcatcatcagacccaagtgccaagttatttactttcccatcaggtttcctgatgtgagcagattcatgcccaagcacaaaacaanccatttaaagaagatgtcggcttaaaggacatg

SEQ ID NO: 27227 - DNA, 822 bp, Homo sapiens
  misc_feature (789)..(789): n is a, c, g, or t
gcggccgcgggggaggggcacggcgtcagcgcgtcgccggctgggccgcgccggtggccaggagggagagacaaggaggaggaggaggaggagggtatctctgcattagccagattggacatatgtaaagggacatcagtatatctggatcatcagattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggaccctctttgcaagttcagtgcttaacctgaccgaactggctgcccttcggcctgaccttgggaaactgaaaaagattctgtattttcacgagaaccagttgatatatcctgtcaagaaatgtcaggagagggatttccaatatggatacaaccaaattctttcatgcctggtggctgatgtggttgtattcaactcagtttttaatatggaatcatttctcacttccatgggaaaatttatgaagctgattcctgatcacagacccaaggatctggaaagcatcatcagacccaagtgccaagttatttactttcccatcaggtttcctgatgtgagcagattcatgcccaagcacaaaacaanccatttaaagaagatgtcggcttaaaggacatg

SEQ ID NO: 27228 - DNA, 3173 bp, Homo sapiens
acgaaacgctgttcatttacttgttgtcaggtttatattctacaagcagagcttgtatcgtaacattatcattcaatctaggtatatgtattttgaagtgtagagataatgaggtagtgatactgtcttctagaatagctactctgtcttcatctctgaaattcacaggtctggctagctgtccctaacgtcatttcctggtctcaactcttttaagaccctgacatactctgagattggagtgaagatttctgtgacatgctgggtgggtataggctgctgtctcatgtcttggtcacatcttattgtttattttttcatatcatgtatcacaaattgaaatattgctgatatacttgtttgtcaccctgcatccttctcccattccccaaagtaaagcttcagcagaatagggctttgttgacctgttcactgctgagtcctcagcactgagtgcagtgcgtggtaaatgcccagaaggtgattgtctaaatatgttattttttgagaatatatacgacatgattattatttgaaacaggacaccacaaaaggtaatttttcccttcttctacttgatttctgtcttttcagcctttttcttataccccaccccttttttttggtggcatctcagttcaggatgttctctgtggctgtgaatgctttcccatcttgttcacagttggtacctggaaggttctctaaccttgtttctttctgatgtagcctattctgactctgggattactatttaaagtaattcttttaagagatatgtttggctaattctgtaatttttttgttatgtagactgtttgggagccacatttcctattgatttgatcacaccttattttttccttgtcataaatggtcctttttggatgagttactgtgtgagttctgaccctgtcagaattgatattcttaggaatcctgactttaatatacacagaacaggaaaagtttccttgtcataaatggtcctttttggatgagttactgtgtgagttctgaccctgtcagaattgatattcttaggaatcctgactttaatatacacagaacaggaaaagtcatgataggcacccttgggtatatatggtaacatgttagttctcttcaagactgtgcatggcttacagggatcacaggactgtgtgagttaagcaacagtttaaacctgatgtattgctctcccagaaagtagtattcttaaggtatttaccccagatctgcaagtgtctgtgtttctctgggagggaacccccaaacctggaatgctcatccatatgcattccaacctgcctctgagatgttaggcaagcctcagcagaggttcttgacagttttttggactatagaccttttggcaaatctgacaaactattgaccttctcccagagatacttatttacataaacccacaaattttacatatatcattcaggagtgcatagattcctgaaggccatccagtgaccaaggttaaacacctctaatctgaatagtaataataataataattattattattactgagttacagatgatttggaaaatctctggagagactgaaaatctcttattaattaagaataaccttagaagcactcagaaaatttctgttcttgcacgttcttctcccatcttggaatatccaagagccagactagatcatccgaatcagctcttgaccagctcaagattgagaattcaggctgggtttattttgaagttactaactatgtcttttgtgatcttacaggtatctctgcattagccagattggacatatgtaaagggacatcagtatatctggatcatcagattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggcaatcagaaattacaaattaggaaacaggagagatgagaatggaatgttaaccttttggtatgaagcaggtcaacattgaaaatgcaagaagcctggatccagcttcctgaaaagaagctccttggtgactctttttcttccggcatcagttgattatttctagtatccaaccctttttactttctctaaatctctctgaggaacatcctggagtttcttttctggctttcgttgtaactagttcctggcctacctgaggggatgaatagcattatggtatagggtaggtgctgcagaccatatggagaccagcaggatacaagagtgtgagatgcctagggaaagcctccctttgtcaagttaaaggagagaggtttccatttggaggcagctgaaatagagaaagaagtattgagcacaaatttacaaatcaaaataacagtcttccagggataggatagagcatggaccaacatgatacagtgtcaacctgcattttcatgggtgaaggatggatggactatagtaatcaaaacagaaacatagcatcctctggaaatagtgaccacagagacagagatctttgtattagtaatgacaggtaacgtttataaagtgcctcactgattgcttatgtgtgtgtcatctcatttgatcctgatagcaacccaaaatggtggataagcgtgaagaatctccttttacggatcaggttcagaaaaatgatttgaccaagttacccactaggaaattttagagtcaaaacttgaaccctaggcttctaatataggaaatggctttgtttctcaaacaggatgcattcctcacttctttcctcctcgctgtcatgaaaatatatccaggaactgtacgagcactggataaacggtggtgaacaacatagccctgttccctacctttgtggaacttagtctgcacttcttaggactgtgctgattagtatggggttattgggcacacttgaaatggggctagtctgaactagatgtattataattgtaaaatatatcctaaatttaaaagatttcaaataaagaatgtaaaacatta

SEQ ID NO: 27229 - DNA, 2737 bp, Homo sapiens
acgaaacgctgttcatttacttgttgtcaggtttatattctacaagcagagcttgtatcgtaacattatcattcaatctaggtatatgtattttgaagtgtagagataatgaggtagtgatactgtcttctagaatagctactctgtcttcatctctgaaattcacaggtctggctagctgtccctaacgtcatttcctggtctcaactcttttaagaccctgacatactctgagattggagtgaagatttctgtgacatgctgggtgggtataggctgctgtctcatgtcttggtcacatcttattgtttattttttcatatcatgtatcacaaattgaaatattgctgatatacttgtttgtcaccctgcatccttctcccattccccaaagtaaagcttcagcagaatagggctttgttgacctgttcactgctgagtcctcagcactgagtgcagtgcgtggtaaatgcccagaaggtgattgtctaaatatgttattttttgagaatatatacgacatgattattatttgaaacaggacaccacaaaaggtaatttttcccttcttctacttgatttctgtcttttcagcctttttcttataccccaccccttttttttggtggcatctcagttcaggatgttctctgtggctgtgaatgctttcccatcttgttcacagttggtacctggaaggttctctaaccttgtttctttctgatgtagcctattctgactctgggattactatttaaagtaattcttttaagagatatgtttggctaattctgtaatttttttgttatgtagactgtttgggagccacatttcctattgatttgatcacaccttattttttccttgtcataaatggtcctttttggatgagttactgtgtgagttctgaccctgtcagaattgatattcttaggaatcctgactttaatatacacagaacaggaaaagtttccttgtcataaatggtcctttttggatgagttactgtgtgagttctgaccctgtcagaattgatattcttaggaatcctgactttaatatacacagaacaggaaaagtcatgataggcacccttgggtatatatggtaacatgttagttctcttcaagactgtgcatggcttacagggatcacaggactgtgtgagttaagcaacagtttaaacctgatgtattgctctcccagaaagtagtattcttaaggtatttaccccagatctgcaagtgtctgtgtttctctgggagggaacccccaaacctggaatgctcatccatatgcattccaacctgcctctgagatgttaggcaagcctcagcagaggttcttgacagttttttggactatagaccttttggcaaatctgacaaactattgaccttctcccagagatacttatttacataaacccacaaattttacatatatcattcaggagtgcatagattcctgaaggccatccagtgaccaaggttaaacacctctaatctgaatagtaataataataataattattattattactgagttacagatgatttggaaaatctctggagagactgaaaatctcttattaattaagaataaccttagaagcactcagaaaatttctgttcttgcacgttcttctcccatcttggaatatccaagagccagactagatcatccgaatcagctcttgaccagctcaagattgagaattcaggctgggtttattttgaagttactaactatgtcttttgtgatcttacaggtatctctgcattagccagattggacatatgtaaagggacatcagtatatctggatcatcagattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggaccctctttgcaagttcagtgcttaacctgaccgaactggctgcccttcggcctgaccttgggaaactgaaaaagattctgtattttcacgagaaccagttgatatatcctgtcaagaaatgtcaggagagggatttccaatatggatacaaccaaattctttcatgccttggcgagcatgaaagatggtagatattcacacatcaagatatataaatatgtgattcattttgttatctctgggggagaacatatagtagctcgattctgatccaagagaccaggttcagaaacacctaaaaaccatatgtaaacaataagttaccacaagtaccgaattgacacacattatcgcctcctaataacacccatataacaaatactgatacaaaaatggataatactcagaggaccaactaaaagagaaaagagagtagacctatcgaacataatgccacgaattggatgacgtggatacaacatgggacaccgcagatgaaagcagataaaatgagagagtgagagaggataaactacgagaatacaatcggatctattaggtacgactagaacacagcaactaggtgcacccgctacggcagcagcaccgaacgatcccgaacgacctactaaata

SEQ ID NO: 27230 - DNA, 1496 bp, Homo sapiens
gcggccgcgggggaggggcacggcgtcagcgcgtcgccggctgggccgcgccggtggccaggagggagagacaaggaggaggaggaggaggagggtatctctgcattagccagattggacatatgtaaagggacatcagtatatctggatcatcagattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggcaatcagaaattacaaattaggaaacaggagagatgagaatggaatgttaaccttttggtatgaagcaggtcaacattgaaaatgcaagaagcctggatccagcttcctgaaaagaagctccttggtgactctttttcttccggcatcagttgattatttctagtatccaaccctttttactttctctaaatctctctgaggaacatcctggagtttcttttctggctttcgttgtaactagttcctggcctacctgaggggatgaatagcattatggtatagggtaggtgctgcagaccatatggagaccagcaggatacaagagtgtgagatgcctagggaaagcctccctttgtcaagttaaaggagagaggtttccatttggaggcagctgaaatagagaaagaagtattgagcacaaatttacaaatcaaaataacagtcttccagggataggatagagcatggaccaacatgatacagtgtcaacctgcattttcatgggtgaaggatggatggactatagtaatcaaaacagaaacatagcatcctctggaaatagtgaccacagagacagagatctttgtattagtaatgacaggtaacgtttataaagtgcctcactgattgcttatgtgtgtgtcatctcatttgatcctgatagcaacccaaaatggtggataagcgtgaagaatctccttttacggatcaggttcagaaaaatgatttgaccaagttacccactaggaaattttagagtcaaaacttgaaccctaggcttctaatataggaaatggctttgtttctcaaacaggatgcattcctcacttctttcctcctcgctgtcatgaaaatatatccaggaactgtacgagcactggataaacggtggtgaacaacatagccctgttccctacctttgtggaacttagtctgcacttcttaggactgtgctgattagtatggggttattgggcacacttgaaatggggctagtctgaactagatgtattataattgtaaaatatatcctaaatttaaaagatttcaaataaagaatgtaaaacatta

SEQ ID NO: 27231 - DNA, 1891 bp, Homo sapiens
ctgcgccgccgtccgcaccgcgctcggaatggggcgtcacgccgtggcattttgtgccttctgcaaactggtcgtgttcgaattgcgtttttttggtgcctacatgtcgtgcgtgctggttttctgcggcccggcgctccgcttcttcctcgcgcaggctgagaggacgggtgggggcacgtcgccctcgcgcgggagaagggaggccgggcgtccgggttggcctgagttggctggggtgcttcgccgaccaccaggctgcccggcgcttggccccttgcagtgcgagccccaggccttcctgacggaaagcttcgcttctggctcctagtcgccctcagttaccagacctccccagcgccccactcctctctgccagccgagtgtgaagaccctcactgtgccccccaccccggaatccctcgtctgaggattaagcacataacttcccattttcatcgggatccagacaatcccattctgtccagggtatctctgcattagccagattggacatatgtaaagggacatcagtatatctggatcatcagattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggcaatcagaaattacaaattaggaaacaggagagatgagaatggaatgttaaccttttggtatgaagcaggtcaacattgaaaatgcaagaagcctggatccagcttcctgaaaagaagctccttggtgactctttttcttccggcatcagttgattatttctagtatccaaccctttttactttctctaaatctctctgaggaacatcctggagtttcttttctggctttcgttgtaactagttcctggcctacctgaggggatgaatagcattatggtatagggtaggtgctgcagaccatatggagaccagcaggatacaagagtgtgagatgcctagggaaagcctccctttgtcaagttaaaggagagaggtttccatttggaggcagctgaaatagagaaagaagtattgagcacaaatttacaaatcaaaataacagtcttccagggataggatagagcatggaccaacatgatacagtgtcaacctgcattttcatgggtgaaggatggatggactatagtaatcaaaacagaaacatagcatcctctggaaatagtgaccacagagacagagatctttgtattagtaatgacaggtaacgtttataaagtgcctcactgattgcttatgtgtgtgtcatctcatttgatcctgatagcaacccaaaatggtggataagcgtgaagaatctccttttacggatcaggttcagaaaaatgatttgaccaagttacccactaggaaattttagagtcaaaacttgaaccctaggcttctaatataggaaatggctttgtttctcaaacaggatgcattcctcacttctttcctcctcgctgtcatgaaaatatatccaggaactgtacgagcactggataaacggtggtgaacaacatagccctgttccctacctttgtggaacttagtctgcacttcttaggactgtgctgattagtatggggttattgggcacacttgaaatggggctagtctgaactagatgtattataattgtaaaatatatcctaaatttaaaagatttcaaataaagaatgtaaaacatta

SEQ ID NO: 27232 - DNA, 3207 bp, Homo sapiens
acgaaacgctgttcatttacttgttgtcaggtttatattctacaagcagagcttgtatcgtaacattatcattcaatctaggtatatgtattttgaagtgtagagataatgaggtagtgatactgtcttctagaatagctactctgtcttcatctctgaaattcacaggtctggctagctgtccctaacgtcatttcctggtctcaactcttttaagaccctgacatactctgagattggagtgaagatttctgtgacatgctgggtgggtataggctgctgtctcatgtcttggtcacatcttattgtttattttttcatatcatgtatcacaaattgaaatattgctgatatacttgtttgtcaccctgcatccttctcccattccccaaagtaaagcttcagcagaatagggctttgttgacctgttcactgctgagtcctcagcactgagtgcagtgcgtggtaaatgcccagaaggtgattgtctaaatatgttattttttgagaatatatacgacatgattattatttgaaacaggacaccacaaaaggtaatttttcccttcttctacttgatttctgtcttttcagcctttttcttataccccaccccttttttttggtggcatctcagttcaggatgttctctgtggctgtgaatgctttcccatcttgttcacagttggtacctggaaggttctctaaccttgtttctttctgatgtagcctattctgactctgggattactatttaaagtaattcttttaagagatatgtttggctaattctgtaatttttttgttatgtagactgtttgggagccacatttcctattgatttgatcacaccttattttttccttgtcataaatggtcctttttggatgagttactgtgtgagttctgaccctgtcagaattgatattcttaggaatcctgactttaatatacacagaacaggaaaagtttccttgtcataaatggtcctttttggatgagttactgtgtgagttctgaccctgtcagaattgatattcttaggaatcctgactttaatatacacagaacaggaaaagtcatgataggcacccttgggtatatatggtaacatgttagttctcttcaagactgtgcatggcttacagggatcacaggactgtgtgagttaagcaacagtttaaacctgatgtattgctctcccagaaagtagtattcttaaggtatttaccccagatctgcaagtgtctgtgtttctctgggagggaacccccaaacctggaatgctcatccatatgcattccaacctgcctctgagatgttaggcaagcctcagcagaggttcttgacagttttttggactatagaccttttggcaaatctgacaaactattgaccttctcccagagatacttatttacataaacccacaaattttacatatatcattcaggagtgcatagattcctgaaggccatccagtgaccaaggttaaacacctctaatctgaatagtaataataataataattattattattactgagttacagatgatttggaaaatctctggagagactgaaaatctcttattaattaagaataaccttagaagcactcagaaaatttctgttcttgcacgttcttctcccatcttggaatatccaagagccagactagatcatccgaatcagctcttgaccagctcaagattgagaattcaggctgggtttattttgaagttactaactatgtcttttgtgatcttacaggtatctctgcattagccagattggacatatgtaaagggacatcagtatatctggatcatcagattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggcaatcagaaattacaaattaggaaacaggagagatgagaatggaatgttaaccttttggtatgaagcaggtcaacattgaaaatgcaagaagcctggatccagcttcctgaaaagaagctccttggtgactctttttcttccggcatcagttgattatttctagtatccaaccctttttactttctctaaatctctctgaggaacatcctggagtttcttttctggctttcgttgtaactagttcctggcctacctgaggggatgaatagcattatggtatagggtaggtgctgcagaccatatggagaccagcaggatacaagagtgtgagatgcctagggaaagcctccctttgtcaagttaaaggagagaggtttccatttggaggcagctgaaatagagaaagaagtattgagcacaaatttacaaatcaaaataacagtcttccagggataggatagagcatggaccaacatgatacagtgtcaacctgcattttcatgggtgaaggatggatggactatagtaatcaaaacagaaacatagcatcctctggaaatagtgaccacagagacagagatctttgtattagtaatgacaggtaacgtttataaagtgcctcactgattgcttatgtgtgtgtcatctcatttgatcctgatagcaacccaaaatggtggataagcgtgaagaatctccttttacggatcaggttcagaaaaatgatttgaccaagttacccactaggaaattttagagtcaaaacttgaaccctaggcttctaatataggaaatggctttgtttctcaaacaggatgcattcctcacttctttcctcctcgctgtcatgaaaatatatccaggaactgtacgagcactggataaacggtggtgaacaacatagccctgttccctacctttgtggaacttagtctgcacttcttaggactgtgctgattagtatggggttattgggcacacttgaaatggggctagtctgaactagatgtattataattgtaaaatatatcctaaatttaacgaaattctatatttctgttggattactgcaatacttaagaagaattcacaccaacatgtcaat

SEQ ID NO: 27233 - DNA, 2823 bp, Homo sapiens
  misc_feature (2790)..(2790): n is a, c, g, or t
acgaaacgctgttcatttacttgttgtcaggtttatattctacaagcagagcttgtatcgtaacattatcattcaatctaggtatatgtattttgaagtgtagagataatgaggtagtgatactgtcttctagaatagctactctgtcttcatctctgaaattcacaggtctggctagctgtccctaacgtcatttcctggtctcaactcttttaagaccctgacatactctgagattggagtgaagatttctgtgacatgctgggtgggtataggctgctgtctcatgtcttggtcacatcttattgtttattttttcatatcatgtatcacaaattgaaatattgctgatatacttgtttgtcaccctgcatccttctcccattccccaaagtaaagcttcagcagaatagggctttgttgacctgttcactgctgagtcctcagcactgagtgcagtgcgtggtaaatgcccagaaggtgattgtctaaatatgttattttttgagaatatatacgacatgattattatttgaaacaggacaccacaaaaggtaatttttcccttcttctacttgatttctgtcttttcagcctttttcttataccccaccccttttttttggtggcatctcagttcaggatgttctctgtggctgtgaatgctttcccatcttgttcacagttggtacctggaaggttctctaaccttgtttctttctgatgtagcctattctgactctgggattactatttaaagtaattcttttaagagatatgtttggctaattctgtaatttttttgttatgtagactgtttgggagccacatttcctattgatttgatcacaccttattttttccttgtcataaatggtcctttttggatgagttactgtgtgagttctgaccctgtcagaattgatattcttaggaatcctgactttaatatacacagaacaggaaaagtttccttgtcataaatggtcctttttggatgagttactgtgtgagttctgaccctgtcagaattgatattcttaggaatcctgactttaatatacacagaacaggaaaagtcatgataggcacccttgggtatatatggtaacatgttagttctcttcaagactgtgcatggcttacagggatcacaggactgtgtgagttaagcaacagtttaaacctgatgtattgctctcccagaaagtagtattcttaaggtatttaccccagatctgcaagtgtctgtgtttctctgggagggaacccccaaacctggaatgctcatccatatgcattccaacctgcctctgagatgttaggcaagcctcagcagaggttcttgacagttttttggactatagaccttttggcaaatctgacaaactattgaccttctcccagagatacttatttacataaacccacaaattttacatatatcattcaggagtgcatagattcctgaaggccatccagtgaccaaggttaaacacctctaatctgaatagtaataataataataattattattattactgagttacagatgatttggaaaatctctggagagactgaaaatctcttattaattaagaataaccttagaagcactcagaaaatttctgttcttgcacgttcttctcccatcttggaatatccaagagccagactagatcatccgaatcagctcttgaccagctcaagattgagaattcaggctgggtttattttgaagttactaactatgtcttttgtgatcttacaggtatctctgcattagccagattggacatatgtaaagggacatcagtatatctggatcatcagattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggcaatcagaaattacaaattaggaaacaggagagatgagaatggaatgttaaccttttggtatgaagcaggtcaacattgaaaatgcaagaagcctggatccagcttcctgaaaagaagctccttggaccctctttgcaagttcagtgcttaacctgaccgaactggctgcccttcggcctgaccttgggaaactgaaaaagattctgtattttcacgagaaccagttgatatatcctgtcaagaaatgtcaggagagggatttccaatatggatacaaccaaattctttcatgcctggtggctgatgtggttgtattcaactcagtttttaatatggaatcatttctcacttccatgggaaaatttatgaagctgattcctgatcacagacccaaggatctggaaagcatcatcagacccaagtgccaagttatttactttcccatcaggtttcctgatgtgagcagtaaacactgggctactcatataaaacttatttgaagagtgaggaataagagtttccagcatttgaaactcagaacctggtggctgtagcaacactcctgttctgcctcttcctgtggctatcaggtgaatccttctttttatccctgagtcctgttgggatagctggctgacgtcatgaggcgtgggctgatgttctgattcatgcccaagcacaaaacaanccatttaaagaagatgtcggcttaaaggacatg

SEQ ID NO: 27234 - DNA, 343 bp, Homo sapiens
ctgtgtcgtttatacccttcctgcaaagaaatggcattggagagcccggacatctgctttatatttctctcagaccattcccatcagtgagcattacaggtaattagagctcaggatgcattttcagcgttttttaaaaagtacctgttatgaggatgttgcttctccatcagtatctttgagaatttctccaactatggaattggttattatgactatagtagatatttctttagagagagcagagcagtggagtatactcatcctctaaggacacctggtcagtaggaaagaagcttcatttagaaccaaccatatgtgttttctcattgtcttgtgattt

SEQ ID NO: 27235 - DNA, 2437 bp, Homo sapiens
acgaaacgctgttcatttacttgttgtcaggtttatattctacaagcagagcttgtatcgtaacattatcattcaatctaggtatatgtattttgaagtgtagagataatgaggtagtgatactgtcttctagaatagctactctgtcttcatctctgaaattcacaggtctggctagctgtccctaacgtcatttcctggtctcaactcttttaagaccctgacatactctgagattggagtgaagatttctgtgacatgctgggtgggtataggctgctgtctcatgtcttggtcacatcttattgtttattttttcatatcatgtatcacaaattgaaatattgctgatatacttgtttgtcaccctgcatccttctcccattccccaaagtaaagcttcagcagaatagggctttgttgacctgttcactgctgagtcctcagcactgagtgcagtgcgtggtaaatgcccagaaggtgattgtctaaatatgttattttttgagaatatatacgacatgattattatttgaaacaggacaccacaaaaggtaatttttcccttcttctacttgatttctgtcttttcagcctttttcttataccccaccccttttttttggtggcatctcagttcaggatgttctctgtggctgtgaatgctttcccatcttgttcacagttggtacctggaaggttctctaaccttgtttctttctgatgtagcctattctgactctgggattactatttaaagtaattcttttaagagatatgtttggctaattctgtaatttttttgttatgtagactgtttgggagccacatttcctattgatttgatcacaccttattttttccttgtcataaatggtcctttttggatgagttactgtgtgagttctgaccctgtcagaattgatattcttaggaatcctgactttaatatacacagaacaggaaaagtttccttgtcataaatggtcctttttggatgagttactgtgtgagttctgaccctgtcagaattgatattcttaggaatcctgactttaatatacacagaacaggaaaagtcatgataggcacccttgggtatatatggtaacatgttagttctcttcaagactgtgcatggcttacagggatcacaggactgtgtgagttaagcaacagtttaaacctgatgtattgctctcccagaaagtagtattcttaaggtatttaccccagatctgcaagtgtctgtgtttctctgggagggaacccccaaacctggaatgctcatccatatgcattccaacctgcctctgagatgttaggcaagcctcagcagaggttcttgacagttttttggactatagaccttttggcaaatctgacaaactattgaccttctcccagagatacttatttacataaacccacaaattttacatatatcattcaggagtgcatagattcctgaaggccatccagtgaccaaggttaaacacctctaatctgaatagtaataataataataattattattattactgagttacagatgatttggaaaatctctggagagactgaaaatctcttattaattaagaataaccttagaagcactcagaaaatttctgttcttgcacgttcttctcccatcttggaatatccaagagccagactagatcatccgaatcagctcttgaccagctcaagattgagaattcaggctgggtttattttgaagttactaactatgtcttttgtgatcttacaggtatctctgcattagccagattggacatatgtaaagggacatcagtatatctggatcatcaggtaagcagatgggacttcatttttatatctccatcaattccgtcctgtggcaatatgcgggcattttctatcatgtcttgtttactgcagtgtgggtcagtaagatgattgatatttctaaagagaaggaagcagccttttttaagtttcaccagattatttccctgctgcttaaagtcagatttcttcatttttatctcattattatttcatgtattcatacatctatagtagataataattctctacttttcttttaatgtatattctttggagagttgtggacagctctcatattgttccttggttgtcagccaagttatagacatttaactcctttaatctttctttgtaattgagttagcttggctgccttttccagattttcccctcgttttatggtaccattaataaacagaaaatcagtctattgcctggcttcttctacacctttcattctttttgttttctgtttttgcctcatattccttgttgaactaaggccagccagacatcattctctggactactttggcactacatgaatgccttgcctgcaactatcagtgtcccatgcagtaataccatcagcagtatgtcctag

SEQ ID NO: 27236 - DNA, 317 bp, Homo sapiens
tacaaaaaaatttttggagagacaggttcttactatgttgcccatgtagttctcaaactctgggcttcaagcgatccccccacctcggcctctcaaagtgttgggattacaggcatgagcctctgtgcctggccaatatactattttctatatagagttaatgcataagagcattcgaagatcttttgccatccttaacaaaacttaactatattttggttgctcctttatgtctcatcattatctgttctttcagcagctcttacaattgtagttcctttgccatggtaaagtttcatgtttaatttttttaagat

SEQ ID NO: 27237 - DNA, 453 bp, Homo sapiens
cattttgaagctgtgaaccctccctgccattgcatcatttcttggtaaataggatgccctttccacttgacaaggaagagacttggaccagatccgtgaactccagagcccctggcttttccaattagcatgttgctagtttctctcattgaactaaatcatgagggatccttaaatactacaggagacaggaaaagcaaccttctatctctttctccattttatccacaacagtctgagaatcactcattcttctcaaatgacttcttccagtgttctcgacttacccctttttcggcatctgcctttgactgaccctcccctttcccatctacaggctcagtggagtcagtgctaggaactagggagcacccaccgcccactgccacatactccctcctagctcaggagccggattggactagagccagacccagcactgggctgcctcca

SEQ ID NO: 27238 - DNA, 497 bp, Homo sapiens
acattgaatcctctgttatgttaattctggcaatctctatgtcttctgggtcctaccatcaaacctctgaaagcaattcaaatattttgccactccctttgaccgtttattttttaaatctgagattagaattgtggaacacatagtggattgatataaagaggaaaatcaagcaccaggaataaagattataaaagagttagctccttgaaggttgttggtaatagaccaatcatgccaacataaaaaaaattaaatactactttaatgaaatttcatacttttaataaattactttcatcttgttagttctgatctagaatatctttgtatttaacataaatgagataaaattataaagagattcatcctctattttccattataacatgcataaagtaaaatttcaaaaatttaaataaatgtgtcagaatattcatggaaagtattcagctgtgagattatgtacttatttgaataaagtgtctttttacaat

SEQ ID NO: 27239 - DNA, 477 bp, Homo sapiens
ttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccactacgcccggctaattttttgtatttttagtagaggcggggtttcaccgttttagccgggatggtctcgatctcctgacctcgtgatccgcccgcctcggcctcccaaagtgctgggattacaggcgtcagccaccgcgcccggcctccagcccttcttaaaacaagcctgggggcaggttcaggaggatctactccttggctgcccaaggacaccagaggaccctggtggttccaacacttacctatgtttactaccatgaggcactgctgcacttcgggtgattcatgaagagaaaaacaggagcaacaatgtttcagggctcgaagggtgt

SEQ ID NO: 27240 - DNA, 220 bp, Homo sapiens
cctgaccctcatcagttctctccattactctttgtccttccttttgtaaatctcaggtatttcccttactgttctcctttttactttcccaataggtctttgaaagtgtgagtcttggctgggcgcagtggctcacgcctgtaatcccagcactttgggaggccgaggtgggcggatcacctgaggtcaggagttcgagaccagcctgaccaacatggag

SEQ ID NO: 27241 - DNA, 286 bp, Homo sapiens
gcgtcgaccttctacaagggctgacccctctaactaaacattatgacagagggtgtgtgtgtgtagaagtgtacagagaatattcagtcatccaccatgtatttattgatttccaactcccaggcctgtactgggccctcttcaaaggggaagaattcacagattagcagatgacatatgcatgaaataaataccacacagaatgggggtataatgatggaattagtaaatttgctatgggggccactaacttttttggggtagaggagggaactcaggaagtctt

SEQ ID NO: 27242 - DNA, 402 bp, Homo sapiens
atgacctacctgcctcagcctcccaaagtgctgggattacaggcatgagccatcatgcctggccatattttaattttttccctaacttatactgtgttgaaaatttcaaacccatagaaatgttgactgggcatggtggctcacacctgtaatcccaacactttgggaggccgagacgggaagattgcttgagccaagaaatttgagatcagcctgggcaatatagggagaccccgtctctacaagaagtttaaaaattagctgggcctggtgtcacatccctatagtcccagctactcaaaaactgaggtgggaggatcgcttgatcgcccgagacagaggcagcagtgagctgcaattgtgccactgcactcctgcctgggcaacagagcaagacaatgt

SEQ ID NO: 27243 - DNA, 408 bp, Homo sapiens
tctttcttttgggggaagaatgagagatgcacatttcgttagtaaattgtgaacaacttgaaacaaacccaaatccaattgtgaatttaagaagtagagttaaaatgaaaggtagccattcaaatactatgccttgctgccttcacttattaagttaggattttcttccttttagccctttagggatacagtagtttaaaagagcagtagccacatatgaaaggatcagatttagcttagagggaattccttagaccagccctgctgttaagacttgacattcaatattgtttgatcacattccaaaatatagcttagctaatggcaacatttgtaaacatataaattgcaaaagaagctttcttgtgtacatacatttttaaaagcttgaaattgatgtgaactttt

SEQ ID NO: 27244 - DNA, 352 bp, Homo sapiens
gatgatggcctatgaattggtccttccatgtggattatacaggcaactgcctaccctgtgtgatgtttggagaaaatgatgggtcttgggccacacacgcacacaaaaatccctgccctaaagtttaatgcttctaaacccatagcttcatcccttgtgtttaatgatttgttcaataagaatagcccaggggtaagggaggcttaactctttaaatgtcagtagtcatttacaccttagtaagattaaaggacacaagaaaagttttggatgagaacaaaagaaaggcaatatgagggttcctaaggaaaggggaggccaggcgcagtggctcagaccagcctgaccaaca

SEQ ID NO: 27245 - DNA, 596 bp, Homo sapiens
gaatctcctagaaggaagatggaagatgtaataaatagtcatttttcagttttctcactgcattgctcaaatactacatcctacttcaaaaacgtataaaaaaatttaggagacatacgaattagaagataaacgcgaagataaatagcactctagacctaagttgtccaatatggtagccacttgccacatgtgactatgtatatttaaaataattaaaattaataaaatttaaaattccattcctcatcacacttttaaggggttatgtaggagaagaatacaacttacaattactcttacttcacggtggctggctgccatgttggactgcacagatacggaacattgtcatcgttgtggaaagttatattagatattgctgttccatacgccaataatgatagtgaaattgagcatataaatgaagtcagactttgattcttgagatgatcatatcctgtatgaattttctcagacttaagaattgaatgcagaagacgttttgacaaagaaaatatggtatttttatccagttagtcattcaacaggaatatttcacaacatgaacctgaaccatccctttttgctttaaa

SEQ ID NO: 27246 - DNA, 239 bp, Homo sapiens
ttctgttcttcatctattttggtgcaagtccttatggttttagttagtgtagcttatactgatgctccttgacttatgatgggattacgtcctgataagcccattgtatgttgaaaatgttgcagccgggtgcagtggctcatgcctgtaatcccgacactttgggatgccagggtgggaggatcacttgagtccaggagttcgagatcagcctgggcaacataaggagaccctctccc

SEQ ID NO: 27247 - DNA, 390 bp, Homo sapiens
gtaaccacttggcttacacctagcttacatttaagcctgtggaaagactgagagagatttcacatgtaggtggtggaatatggaaatgcagattgatagtctccttggagttatgggtctttgaagtttagcagtctttttgttgttcaaaaatacactatgacattaaaaagacgtgggtcttctgaccctgatgtcttattgtgtattagggcttcaggtgttacagttcattttaactgaggttgaacgtaatacacaaaaatgtggattgttttatagtttataaaagaacagttattttaggtacctttttgtttcatgttccactcttagagttccttattagctggcttgattttattttttcagctacgtgcttttagatta

SEQ ID NO: 27248 - DNA, 414 bp, Homo sapiens
tgttaatcttctcaaaaaatcctcaaggacataaacctttttgaaacagtaggaagccattaaagcagagtaggcttggaattgaaaggctggggatacagaaagaacagctgaaatgaggagggaaaaacaaccctagaaatgttttagaagagactttaaaaactatgttgaaggcagtaaagaagagaaatgattaaaaatcagtcaaatacatgataaaagagaaactggagacgcccttctggaatgaaaaggaacaggataaagataaaaactacgtgacaggctggacacagtagttctctcctgtaatcccagcactttcggaggccagagtgggaggatctcttgaaaccaggagtctgagaccaacctgggcaacatagcaagactctgtctctgtaagaaaat

SEQ ID NO: 27249 - DNA, 345 bp, Homo sapiens
ttatgttttatgatgtgcaaactgttactttttatgttaaaaatctttaaaaatatatgtgacatggtgctttttaggagcattacatagggccaaaatctgccatgttttatattgaaccgtctatgtaattccatgcatagttagagaaaatcatataggatggaataataatactgactgaaaatgtttctttctggtggcatttgtgagtgagtcaatgaaataggtttgaaaaatctttttaactctgtatgtattcaggagaacaataggtagtttgagaaaatagacccactcaggcaataaaatgctatattagccttgcaaatgttgctcttccac

SEQ ID NO: 27250 - DNA, 330 bp, Homo sapiens
aactgaatgataatagtgacacaacctatcaaaacctctgggatacggaaaaggcggtgctaagaggaaagttcatagcattaaatgtctacactaaaaagcctgaaagagcacaaataggcaatctaaggtcacgcctcaaggaactagagaaactagaacaaagcaaacacaaacccagcattagaaaagaaataacaaagatcagagcagaactgaattaaattaaatatatatatttatatacaaaaaataaataaaacaaaaagctggttctttgagaaaataaataaaaccgttagaccattagtgagttaaccaataaaagaa

SEQ ID NO: 27251 - DNA, 631 bp, Homo sapiens
attgaactttattgaattctattttcttttccttttccttttttatttttttagaccaggtctcatgttgttgcccaggctggaatgcagtggtgggatcaccactcacagcagcctcgaactcctgggctcgagccatcttcccacttcatcatgtcacctacctccccagtagctgggaccacaggtgtgccaccatccctggctaatttttaatttttttgtagaaatgatgtctcactatgccgcccaggcagatctccaactcctgggctcaagtgatcctcccacctcagcctcccaaagtgctgggattgtaggagtgagccaccacaccggctcctattgaattggtatttctgtgcctaatgggatatgtttgctctttaaatctctaaatgtgtaaattatattaatagattttccaatgttaaaccattcttgcattcttgggataaattcaacttggtcataatctagtttttaaatacataactggtttctgattgctaatattttagtaagatctttgcaactacattaacgaaacagattgacttgtaattttttttttttcttttttgagatggagttttgctcttgttgcccagcagcctggagtgcaatggcg

SEQ ID NO: 27252 - DNA, 416 bp, Homo sapiens
gatattcttaaaggacttaatccctatcttaattgacattttatggtaagtactgctgaaccaggtattcaaataaagtgtcttcatacaggtgatattcattattgaactgatattattacaaagtaaaacattgccacctttctactactcttggttttttttccagaatttttgttgctagatcagaggtatgtgagaaagagagtgggaagaggtgaagtcagagaaagagagtgggaagaggtgaaatcagagaaatagctgggggcacaaactgtgttgagttttttaggactttgtttaggactttaacctacatgcagagtgaagtgggaagccattgttgggtttaagaaatgctatgaactgaccttgcattttaacaaaacaaattgagtgaagggcagcgagtc

SEQ ID NO: 27253 - DNA, 355 bp, Homo sapiens
tttttccggtgacttttgttgtccatttaagtaggggtgtgtacatgtggtgtgtttttgtttcttgtgtttttttatgctagcatgttttgggtgcctgaagtggataaaagggagtgaaattgaagggcacctgctgatggaacaggccctgaactgagagccaggaaatctgtataccctttagtgctctacacaccagccagacgtgaaaccttggggaagtcaagtgaccttttctaagatacagtttccttatccatggaagacagcttagttcagctccacagtcccaaaaagctccctgcactttctttttctccatttgtttcttcttcttcttttttttttttta

SEQ ID NO: 27254 - DNA, 450 bp, Homo sapiens
ctaatttttttttttctttttctgagacagagttttgctctgttgcccaggctagagtacagtggtacaatcatggctcactgcaggtcctcgcaggctcaagcaatcctcccaccttagcctcccaggtagctgtgactacagccacacaccactacacccagctaatttttttattttttgtagagatggagtctcaccatgttgacaggctggtctccaactcctgggctcaagaaatcctcctaccttggcctctaaactgctgggattacaggtgtgagccaccacacctggccaagatctaagttcttcttaatttttctcctctgaagagaaagttcaagttctaaacctttagttatttctaatataattcttccacagcctcccataatatcctgaaattgtcatcctttctgtgagatgataaagtcttccttgatttga

SEQ ID NO: 27255 - DNA, 5523 bp, Homo sapiens
gcggcgggagcgcggcttcccaggcccgccgctccgcagggctgctggcgttgctgctgttgagaggcggcggcggcggcgcaggcgggcgggaaggatggtgtttctgcgactggagcggcaggtgcggaccgggagccggaccgaggtttggcagaagcaacgtgtgctcgggagcaaccggcgcgggtgccactgaggcagcggagggaggcaggatcgactgacgggcgaacggacggacggacggaaggcgactcgagggccggccccggagccgcgccgtgggcgagatgccggggccgccggcgttgcggcggaggctgctgctgctgctgctggtcctcctgatcgccggcagtgctggggccgcgccacttccgcaaacaggtgcaggggaggcgccacctgctgcagaagtttcctcatcttttgtgatcctgtgtgtgtgcagtttaataatattaatagtgttaattgcaaactgtgtatcctgctgtaaggacccagaaatagactttaaggaatttgaagataattttgatgatgagatagatttcacaccaccagcagaagacactccctctgttcagtccccagcagaggtcttcacactttcagtaccaaatatttcactcccagctccctcgcaattccagccttctgtagagggattgaagtctcaagttgcccgccacagtctaaactacatacaggaaattggaaatggctggtttggaaaggttctcttgggagagatttacacgggcactagcgtagcaagagtcatcgtgaaggagttaaaagcaagtgccaacccaaaggaacaagatacttttttgaaaaatggagaaccttactacattcttcagcatccaaatattcttcagtgtgttggacagtgcgtagaagcgattccctacctcctggtgtttgagttctgtgacttgggtgacctgaaggcgtatctgcgcagcgagcaggagcacatgcggggggactcacagaccatgctgctgcagaggatggcgtgcgaggtcgccgcggggctggccgccatgcacaagctgcacttcctgcacagtgatttagccctgcggaattgttttctcacctccgacttaaatgtgaaagtgggagattacggaataggattcagcaggtacaaggaggattatattgaaacagatgataaaaaagttttccctctgcgatggactgctccagaattagtaaccagctttcaagacagactgctaactgcagatcagactaagtatagtaatatctggtctctgggtgtgacactttgggagctttttgacaatgccgcacagccgtattcaaacctttccaacttagatgtcctcaaccaagtcattagagagagagacacaaaactcccgaagccccagctggagcagccctactctgatagatggtatgaagtcttacagttctgttggctgtcaccagaaaagagacccgcggctgaagatgtgcacaggctgctgacttacctgcggctgcagagccagcgggactcagaggtcgactttgaacagcagtggaacgctctgaagccgaacacaaacagcagagactcctccaacaatgctgcattcccaattctcgaccactttgccagggaccggctgggtcgtgaaatggaggaagtcctcaccgtgaccgaaaccagccagggcctgagcttcgagtatgtctgggaggccgctaagcacgaccactttgacgagcgcagccggggccacctggacgaaggcttgtcctacacgagcatcttctatccggttgaagtttttgagagttcgctttcagatcctgggcccggaaagcaagatgacagcggccaggatgtccccctgagggtccctggagtggttcctgtttttgatgcccacaacctttctgttggaagcgactattatatccagttagaagaaaaaagtggtagtaacttggagcttgattacccaccagcgctgctcacaaccgacatggataatccagaaaggactggccctgaactgtcccagctcacggcgctcaggagcgttgaacttgaggagtccagtacagatgaggacttcttccaaagcagtacagaccccaaagactctagcttaccaggggacttacacgtgaccagtggccccgagagccctttcaacaatatatttaatgatgtggacaaatcggaagatttgcccagtcaccaaaaaatattcgacttaatggaattaaacggagttcaagccgactttaaacctgccactttaagttccagtttggataaccccaaagagtcagtcataacaggccactttgagaaagaaaagccccgtaagatttttgacagtgagcctctctgcctatcagataatcttatgcaccaagataattttgatccattgaatgttcaagaattgtcagaaaactttttatttcttcaagagaaaaacttactaaaaggctcattgtccagcaaagaacacataaatgatcttcagacagaacttaagaatgctggttttactgaagctatgttagaaacgtcatgtagaaactctttagatactgagcttcagtttgctgaaaataagccaggcatgtctttgttgcaggaaaacgtaagcacaaagggtgacgatacagatgtcatgctcacaggtgacactttgagcacctcattgcagtcttccccagaagtgcaggtacctcctacctccttcgaaacagaagaaacgccccgtcgggtacccccagactcactcccaacacagggagaaacccagcccacgtgtttagatgttattgtcccggaggactgtctccaccaggacatcagtccagacgctgtgactgtcccggttgaaattctctcaactgatgccagaacccacagcctggataacaggtcccaggactctcctggcgagagtgaggagaccctgcgactcaccgaaagtgactctgttcttgctgatgacatccttgccagcagggtgagtgtagggagtagtctcccggaactgggacaggaattgcacaataaaccattttcggaagaccatcacagtcatcgccggctagagaaaaacttagaggctgtggagactttaaatcagctcaattctaaagacgcagcaaaagaagcaggcttggtgtctgccctctcctcggactcaaccagtcaggacagcctcctggaggacagcttgtcagcacccttcccagcctctgagccgtccctggaaaccccggactctctggagtcagtggatgtccacgaagcgctactggactctttaggatctcacactccccagaaactagtgccccccgataagccggcagacagtggctacgaaacagagaacttggagtctcccgagtggaccttgcatcccgctcccgagggcaccgcagactcagaaccagccaccacgggcgatggcggccacagcggtctgcctcccaacccggtcattgtcatctcagatgccggcgatggtcacagaggcacagaagtgacccctgagacgttcacagctggctcccagggttcataccgagactctgcgtacttctcagacaatgactctgagcccgagaaaaggtctgaggaggtcccgggaacctccccatccgccttggtgttggtacaggagcagcccctacccgagccagtcctccccgagcaaagtcctgctgcccaggatagctgcctggaagccagaaagagccagccagatgaaagttgtctgtctgctttgcacaactccagtgacctggaattaagagccacgccggagccagcacagactggtgttccccagcaggtgcatcccacggaagacgaggccagcagtccctggagtgtgctgaatgcagaacttagcagcggcgatgacttcgagacacaggacgatcgcccctgcaccctcgcttccacggggaccaacacgaacgaactccttgcctacaccaattctgcgctggacaagtccctgtccagccactccgagggcccgaagttgaaggagccggacatcgaagggaagtacctggggaaactcggggtgtcagggatgctcgacctctcagaggacgggatggatgcagacgaggaggacgaaaacagcgacgactcggacgaggacctgcgggccttcaacctgcatagcctcagctccgagtcggaggacgagaccgagcaccccgtgcccatcatcctcagcaacgaggacggaaggcacctgcggagtctgttgaagcccacagcggccaatgcccccgacccactgcccgaggactggaagaaggaaaagaaggcagtcacgtttttcgatgatgtcacagtctacctgtttgaccaggagaccccaaccaaagagctggggccctgtggaggagaggcgtgcggcccggacctgagcggcccagccccagcctcaggctctccctacctgagcaggtgcatcaactccgaaagctccaccgacgaagaaggtggtggctttgagtgggatgatgacttctccccagatccttttatgtcaaagacaacaagtaacctgctcagctccaagccttctctcccgccaacattgccagcttttccctcacacacctgaccgactcggacatcgagcagggcggaagcagcgaagacggagaaaaggactaggtggctgccaacgcgcacgctcgggtccgaggctgctcccctggagcggcgcccctgcgccctcagcccgagcagcgacatccactcgccatttgctgacatgagattgggaggaagaatccagaggtgaagagggagacggctcttagctgcgttcaaggcggggccctcgggagcccaggtgcagagcgaggccgtgtccaggagccggcgtccctcagtgccccgtgcacccgcggccgcggcctcccaggcagtgctcatgcgctggccgtcgggggaggcaggggcacagcctccatgtgcgcgcgcgtgtggagctgtgtgcaccgcatgtgtgctttccacaggggcgtctctgcgtccacgcctgcacatcccggcgcacgtgtgggcaccacagaggacacgtgaggggaatggtcaccagtgagccatatttattatttctagagaaatcacgaactgctttctgtaattgcactgtggataaatgttccgagagtctccattgttgtacaggatcttcagttattcgaggggaatgaggcaggtcaagccgatgctagccactagtttgattttttttctgttttatagtttgcgctgcatggtacttgtgaagcttaaatattttgagtgttctactgtgtctaggattgttgggattgtacatatggtactctttcataaatgataaatgattctgaatgttagtgttttatgttcatataggaaatattttcattgagtccaaaataccactgttttgttgatggacttgaatgcatttgtctcttcttgatgaagcg

SEQ ID NO: 27256 - DNA, 1150 bp, Homo sapiens
taggcttcatttgtgccgattagataacacctgctatctgccagtctgtcggggcagatgtgtggatcccagctgacttcttctgcaccctgacccttagcgcccagcgggcatttgagcctagcagatgtgggagagtcaggcaggggctgcttccgaaggaaaggacaggaagggcggctcaggcggtgctgggctcaaaacacccgcttccgttcctgtggtgcagcgcacatgccatccacgccatgcctgtctgatcattttaaaaacccagctttgtcgtctcgcttcctctctcctcaacaggaagcagcgaagacggagaaaaggactaggtggctgccaacgcgcacgctcgggtccgaggctgctcccctggagcggcgcccctgcgccctcagcccgagcagcgacatccactcgccatttgctgacatgagattgggaggaagaatccagaggtgaagagggagacggctcttagctgcgttcaaggcggggccctcgggagcccaggtgcagagcgaggccgtgtccaggagccggcgtccctcagtgccccgtgcacccgcggccgcggcctcccaggcagtgctcatgcgctggccgtcgggggaggcaggggcacagcctccatgtgcgcgcgcgtgtggagctgtgtgcaccgcatgtgtgctttccacaggggcgtctctgcgtccacgcctgcacatcccggcgcacgtgtgggcaccacagaggacacgtgaggggaatggtcaccagtgagccatatttattatttctagagaaatcacgaactgctttctgtaattgcactgtggataaatgttccgagagtctccattgttgtacaggatcttcagttattcgaggggaatgaggcaggtcaagccgatgctagccactagtttgattttttttctgttttatagtttgcgctgcatggtacttgtgaagcttaaatattttgagtgttctactgtgtctaggattgttgggattgtacatatggtactctttcataaatgataaatgattctgaatgttagtgttttatgttcatataggaaatattttcattgagtccaaaataccactgttttgttgatggacttgaatgcatttgtctcttcttgatgaagcg

SEQ ID NO: 27257 - DNA, 5617 bp, Homo sapiens
gcggcgggagcgcggcttcccaggcccgccgctccgcagggctgctggcgttgctgctgttgagaggcggcggcggcggcgcaggcgggcgggaaggatggtgtttctgcgactggagcggcaggtgcggaccgggagccggaccgaggtttggcagaagcaacgtgtgctcgggagcaaccggcgcgggtgccactgaggcagcggagggaggcaggatcgactgacgggcgaacggacggacggacggaaggcgactcgagggccggccccggagccgcgccgtgggcgagatgccggggccgccggcgttgcggcggaggctgctgctgctgctgctggtcctcctgatcgccggcagtgctggggccgcgccacttccgcaaacaggtgcaggggaggcgccacctgctgcagaagtttcctcatcttttgtgatcctgtgtgtgtgcagtttaataatattaatagtgttaattgcaaactgtgtatcctgctgtaaggacccagaaatagactttaaggaatttgaagataattttgatgatgagatagatttcacaccaccagcagaagacactccctctgttcagtccccagcagaggtcttcacactttcagtaccaaatatttcactcccagctccctcgcaattccagccttctgtagagggattgaagtctcaagttgcccgccacagtctaaactacatacaggaaattggaaatggctggtttggaaaggttctcttgggagagatttacacgggcactagcgtagcaagagtcatcgtgaaggagttaaaagcaagtgccaacccaaaggaacaagatacttttttgaaaaatggagaaccttactacattcttcagcatccaaatattcttcagtgtgttggacagtgcgtagaagcgattccctacctcctggtgtttgagttctgtgacttgggtgacctgaaggcgtatctgcgcagcgagcaggagcacatgcggggggactcacagaccatgctgctgcagaggatggcgtgcgaggtcgccgcggggctggccgccatgcacaagctgcacttcctgcacagtgatttagccctgcggaattgttttctcacctccgacttaaatgtgaaagtgggagattacggaataggattcagcaggtacaaggaggattatattgaaacagatgataaaaaagttttccctctgcgatggactgctccagaattagtaaccagctttcaagacagactgctaactgcagatcagactaagtatagtaatatctggtctctgggtgtgacactttgggagctttttgacaatgccgcacagccgtattcaaacctttccaacttagatgtcctcaaccaagtcattagagagagagacacaaaactcccgaagccccagctggagcagccctactctgatagatggtatgaagtcttacagttctgttggctgtcaccagaaaagagacccgcggctgaagatgtgcacaggctgctgacttacctgcggctgcagagccagcgggactcagaggtcgactttgaacagcagtggaacgctctgaagccgaacacaaacagcagagactcctccaacaatgctgcattcccaattctcgaccactttgccagggaccggctgggtcgtgaaatggaggaagtcctcaccgtgaccgaaaccagccagggcctgagcttcgagtatgtctgggaggccgctaagcacgaccactttgacgagcgcagccggggccacctggacgaaggcttgtcctacacgagcatcttctatccggttgaagtttttgagagttcgctttcagatcctgggcccggaaagcaagatgacagcggccaggatgtccccctgagggtccctggagtggttcctgtttttgatgcccacaacctttctgttggaagcgactattatatccagttagaagaaaaaagtggtagtaacttggagcttgattacccaccagcgctgctcacaaccgacatggataatccagaaaggactggccctgaactgtcccagctcacggcgctcaggagcgttgaacttgaggagtccagtacagatgaggacttcttccaaagcagtacagaccccaaagactctagcttaccaggggacttacacgtgaccagtggccccgagagccctttcaacaatatatttaatgatgtggacaaatcggaagatttgcccagtcaccaaaaaatattcgacttaatggaattaaacggagttcaagccgactttaaacctgccactttaagttccagtttggataaccccaaagagtcagtcataacaggccactttgagaaagaaaagccccgtaagatttttgacagtgagcctctctgcctatcagataatcttatgcaccaagataattttgatccattgaatgttcaagaattgtcagaaaactttttatttcttcaagagaaaaacttactaaaaggctcattgtccagcaaagaacacataaatgatcttcagacagaacttaagaatgctggttttactgaagctatgttagaaacgtcatgtagaaactctttagatactgagcttcagtttgctgaaaataagccaggcatgtctttgttgcaggaaaacgtaagcacaaagggtgacgatacagatgtcatgctcacaggtgacactttgagcacctcattgcagtcttccccagaagtgcaggtacctcctacctccttcgaaacagaagaaacgccccgtcgggtacccccagactcactcccaacacagggagaaacccagcccacgtgtttagatgttattgtcccggaggactgtctccaccaggacatcagtccagacgctgtgactgtcccggttgaaattctctcaactgatgccagaacccacagcctggataacaggtcccaggactctcctggcgagagtgaggagaccctgcgactcaccgaaagtgactctgttcttgctgatgacatccttgccagcagggtgagtgtagggagtagtctcccggaactgggacaggaattgcacaataaaccattttcggaagaccatcacagtcatcgccggctagagaaaaacttagaggctgtggagactttaaatcagctcaattctaaagacgcagcaaaagaagcaggcttggtgtctgccctctcctcggactcaaccagtcaggacagcctcctggaggacagcttgtcagcacccttcccagcctctgagccgtccctggaaaccccggactctctggagtcagtggatgtccacgaagcgctactggactctttaggatctcacactccccagaaactagtgccccccgataagccggcagacagtggctacgaaacagagaacttggagtctcccgagtggaccttgcatcccgctcccgagggcaccgcagactcagaaccagccaccacgggcgatggcggccacagcggtctgcctcccaacccggtcattgtcatctcagatgccggcgatggtcacagaggcacagaagtgacccctgagacgttcacagctggctcccagggttcataccgagactctgcgtacttctcagacaatgactctgagcccgagaaaaggtctgaggaggtcccgggaacctccccatccgccttggtgttggtacaggagcagcccctacccgagccagtcctccccgagcaaagtcctgctgcccaggatagctgcctggaagccagaaagagccagccagatgaaagttgtctgtctgctttgcacaactccagtgacctggaattaagagccacgccggagccagcacagactggtgttccccagcaggtgcatcccacggaagacgaggccagcagtccctggagtgtgctgaatgcagaacttagcagcggcgatgacttcgagacacaggacgatcgcccctgcaccctcgcttccacggggaccaacacgaacgaactccttgcctacaccaattctgcgctggacaagtccctgtccagccactccgagggcccgaagttgaaggagccggacatcgaagggaagtacctggggaaactcggggtgtcagggatgctcgacctctcagaggacgggatggatgcagacgaggaggacgaaaacagcgacgactcggacgaggacctgcgggccttcaacctgcatagcctcagctccgagtcggaggacgagaccgagcaccccgtgcccatcatcctcagcaacgaggacggaaggcacctgcggagtctgttgaagcccacagcggccaatgcccccgacccactgcccgaggactggaagaaggaaaagaaggcagtcacgtttttcgatgatgtcacagtctacctgtttgaccaggagaccccaaccaaagagctggggccctgtggaggagaggcgtgcggcccggacctgagcggcccagccccagcctcaggctctccctacctgagcaggtgcatcaactccgaaagctccaccgacgaagaaggtggtggctttgagtgggatgatgacttctccccagatccttttatgtcaaagacaacaagtaacctgctcagctccaagccttctctccaaacatccaagtacttttctccgccgccaccggcccggagcacggagcagagctggccgcactcggcgccttactcccggttctccatctctcccgccaacattgccagcttttccctcacacacctgaccgactcggacatcgagcagggcggaagcagcgaagacggagaaaaggactaggtggctgccaacgcgcacgctcgggtccgaggctgctcccctggagcggcgcccctgcgccctcagcccgagcagcgacatccactcgccatttgctgacatgagattgggaggaagaatccagaggtgaagagggagacggctcttagctgcgttcaaggcggggccctcgggagcccaggtgcagagcgaggccgtgtccaggagccggcgtccctcagtgccccgtgcacccgcggccgcggcctcccaggcagtgctcatgcgctggccgtcgggggaggcaggggcacagcctccatgtgcgcgcgcgtgtggagctgtgtgcaccgcatgtgtgctttccacaggggcgtctctgcgtccacgcctgcacatcccggcgcacgtgtgggcaccacagaggacacgtgaggggaatggtcaccagtgagccatatttattatttctagagaaatcacgaactgctttctgtaattgcactgtggataaatgttccgagagtctccattgttgtacaggatcttcagttattcgaggggaatgaggcaggtcaagccgatgctagccactagtttgattttttttctgttttatagtttgcgctgcatggtacttgtgaagcttaaatattttgagtgttctactgtgtctaggattgttgggattgtacatatggtactctttcataaatgataaatgattctgaatgttagtgttttatgttcatataggaaatattttcattgagtccaaaataccactgttttgttgatggacttgaatgcatttgtctcttcttgatgaagcg

SEQ ID NO: 27258 - DNA, 134 bp, Homo sapiens
agagagagagacacaaaactcccgaagccccagctggagcagccctactctgatagatggttggtagcctcacattccgcctgttctgtttcgtcttcactgtgaggtgtccccaaaacacaaaaaaattcgtg

SEQ ID NO: 27259 - DNA, 688 bp, Homo sapiens
agaccgagttcgtctattttcacttctttgcccctcgcgcaaccctcagtttcctcttcatgcctctactcctatgcagtttgacctctcagtgtgcagctggtgatagatggaaacccttgttcataagctttgtggcactgtcggcaggatgaggggacttctggatcctcactggtcactgtggcagagtggttggtgttgtctgctccctagacaggaacccactgaagaatctgacattttttgatatgctggcattcattgttacagcccatcatcccagccatcaatccaggacatggggtccgtgcccacggtgggaaggaggaggaggaagctggctttgttctgacgttgggcttcttctgctccaccagtactttctgtgggggaaataggtaaagaaatggctgttcagatgagaagatgtgtcagtaaacttttgctacagtgatgctgcaaaacaaatcactggtgactttcagtggcacacagcaataaacatttatttagctcagggattgacaatctttttttttttttaaagggccaaatagtaaatattttaggtgtttcaggccatacagtctctgaactctgaacttgtagcacaacagtagccttagatgctatgcaaatggaggagcatgactgtgttccaataaaactttatttatggacacta

SEQ ID NO: 27260 - DNA, 753 bp, Homo sapiens
agaccgagttcgtctattttcacttctttgcccctcgcgcaaccctcagtttcctcttcatgcctctactcctatgcagtttgacctctcagtgtgcagctggtgatagatggaaacccttgttcataagctttgtggcactgtcggcaggatgaggggacttctggatcctcactggtcactgtggcagagtggttggtgttgtctgctccctagacaggaacccactgaagaatctgacattttttgatatgctggcattcattgttacagcccatcatcccagccatcaatccaggacatggggtccgtgcccacggtgggaaggaggaggaggaagctggctttgttctgacgttgggcttcttctgctccaccagtactttctgtgggggaaataggtaaagaaatggctgttcagatgagaagatgtgtcagtaaacttttgctacagtgatgctgcaaaacaaatcactggtgactttcagtggcacacagcaataaacatttatttagctcagggattgacaatctttttttttttttaaagggccaaatagtaaatattttaggtgtttcaggccatacagtctctgaactctgaacttgtagcacaacagtagccttagatgctatgcaaatggaggagcatgactgtgttccaataaaactttatttatggacactaaaattggaatttcatggaatttttatatgttaagaaatattatactttgatttttttcaaccacg

SEQ ID NO: 27261 - DNA, 498 bp, Homo sapiens
ttcatatgtctaagatatgagagtaaaaaaagatcatgagaaaatatttctgtaaacattgtggccatcttgttcttttgactaggtagttttgtatcattctagagaataaaagaataaaactgtcagtacatattttctagtaaaaatgtgaattgaagaaacatataaggaattaagttgtttataacagtgtcatctcataataaaaccaaaacacttttaaaatgcaagtacatatacttaagtaaacacatttgcactttctttttccactttattaaataaataaaaaaaaatccctaaatacagtattatgacaccacctactgggaatttagaagacagcaatcaagttatctaagtataactatctttttttcaactgcaagcaaaatatatcaataaagtgatcaaaagaatggccaatatatacacactggtgacagcatagagacatttaacaaaattattagtcaattttcatgttagggaagc

SEQ ID NO: 27262 - DNA, 431 bp, Homo sapiens
ccaaaaaaaaaagaaaagaaaaaagaaaaaaaaatattattcaatagccaggagttgcagggagttagaatgaggagtcagtatttaatgggtacagagtttcatttggggaagatgaaaaatttctagatggttacacaaccatgtgagtgtactcagtcccacagagcagtacattaaaaaatgcctaaaatggccgggtgtggtgactcacacctgtaatcccaacactttgggaggccaaggtgagcagatcacttgaggtcaggaattcgagaccagcctggccaacatggtgaaaccccgtctttactaaaaatacaaaaattagccaggcgtggtggcgggcacctgtagtcccagctactcgggaggctgaggctggagaatcgcttgaacccaggaggtggaggttgcagtgaacctagatt

SEQ ID NO: 27263 - DNA, 4327 bp, Homo sapiens
  misc_feature (737)..(737): n is a, c, g, or t
  misc_feature (775)..(775): n is a, c, g, or t
  misc_feature (839)..(839): n is a, c, g, or t
  misc_feature (893)..(893): n is a, c, g, or t
  misc_feature (943)..(943): n is a, c, g, or t
agatccttccttctctcctccttcttcattctacaccacccccaacacatatccctgcaccccgcccattctttgctctctctcctttcttacacttaactccttcttgctccacagcctaacatgctgattaacaggaccccaaaggtttgggtgggtattaggggccttctcaacaaaagcagcacactcttgagcttgttcttccttttgttgccatctcagataaaaaggccccatgagggaggagacagataagtatagacttggtattctgataactctgtgttacatgggatcagatgtaaatgagttgtaccctgtggtgtttcatgctctgctgtgttgtcttctcatggtgagcttttctgtgcccttatttcatccagctctggtttctgtgtttcatgttatttctcctagcctctgtaaactctgcagcatactaataatgctctggctttctgattaaagataaatggcttactatcatcacccctggcttgagggccagctcacatgtaatcccttataggattccaaagttgttaaataaatgcagttctttttgtcattttgaagcattcaaaaatttttcaagaaaagctatgatcatataaatagaaattttatccagaatgttacagtgtagcatttgtgaataaatgtgtaggtgctgtatttgctcagactctagtttgggttgtgttttcttttccctttttttttttgagacngggtctctctctgtcatctgggctgcagtgcagtggtntaatcacagctcactgcaacctctactcccaggctcaagcaatcctcctgagtagctgggactngagacatgcgccacaacgcccagctaatttttaggtttttctttcacatagacngggtctcactctgttggccaggctggtttcgaactcctggactcaagcanttccccccacctcagcctcctaaagtgctgggattacaggcctgagccaccatacccagcaagttatattttctttttccttatatagagtaaaataagggtgagtgaccgagaggttgatgcatagctagatcaccagtttaaatgccttcccacacacccctttcctcctgttccctccacctacaggttgtagatgagcatgagagtgtggagcagagttggcgagtgcaagtcgagcccatcaacctggacagctgtctccgtgctttcaccagtgaggaagagctaggggaagatgagatatactactgttccaagtgtaagacccactgctttagcaacaaagaagctggatctctggaggcttccacccttcctgattattcaccttaagcgatttcaatttgtaaatgatcagtggataaaatcacagaaaattgtcaaatttcctcgggaaagttttgatccgagtgcttttttggtaccacgagacccggctctctgccagcatcaaccactcacaccccagggggatgagctctccaagcccaggattctggcaagagaggtgaagaaagtggatgtgcagagtttggctggggaagaggacatgctcctgagcaaaagcccatcctcactcagcgctaacatcagcagcagcccaaaaggttctccttcttcatcaagaaaaagtggaaccagctgtccctccagcaaaaacagcagccctaatagctgcccacggactttggggaggagcaaagggaggctccggctgccccagattggcagcaaaaataaactgtcaagtagtaagaagaacttggatgccagcaaagagaatggggctgggcagatctgtgagctggctgatgccttgagctgagggcatatgcgggggggcagccaaccagagctggtcactcctcaggaccacgaggtagctttgggcaatggattcctttatgagcatgaagcatatggcaatggctacagcaatggtcagcttggaaaccacagtgaagaagacagcactgatgaccaaagagaagacactcatattaagcctatttataatctatatgcaatttcatgccattcaggaattctgagtgggggccattacgtcacttatgccaaaaacccaaactgcaagtggtactgctacaatggcagcatctgtgaggaacatcaccctgatgaaattgacaccgactctgcctacattcttttctatgagcagcagaggatagactacgcacaatttctgccaaagattgatggcaaaaagatggcagacacaagcagtatggatgaagactttgagtctgattacgaaaagtactgtgtgttacagtaaagctaccactctggctgctagatagcttggtggggagggagatgactccttgtagctgatacttggcaaaagtgtcactgagaggcaagctaaatgtagttattttatcctgttagaatacaaattctaattaaaatagttaactttaagagtagtagtaattttattttgaagtctcatgcaagttgtctgatagagaactttcaggcagatcccaccattagcctgtaaacaaaaagtttggcaccagccacctgggaccaaataagaattcaattgtgcttgtccagatatgaacaaatatgtagtgagtatagagtttatcaataatcataacaaatattaaagatttccttggagtcaaagtaaaaaacaaaaaattgtaatgttgtctagggatgacatgatatgctacctcctttttcctgaagttttattccattctgttgacaagatggagaaagcaagatcatgaaggtgtgcaaatgattcttacggcatgggcgaggatttttcaatttattttttaaagtttccataccctttctttgtctttcttgctttttgtttttgccgttgtgtttatgtttgagatacaaccagtcattggtggcaggggcatagagtggtcagtctgaaagggaggctctcttaagagctatgtgccttccacccagagggagacccagtagaaagaaaaacatcctgggaaatccagctaccatggccctcccagtggaggcatcttacatttaggatacttcaggtatcctcagaaatgtattctgcaccccccggccccgcccatgctgagggaaggggagcagttgccaatatttgcaccatcttcacatgcacatgttgcaacaagagcttctgggaaggtaagcggcatcggagctagatcacgtttcacaattagtggtggttcttttccatgtttgttttgcactttaaaaaagagagaacacatgcaaatgaacttgcttgtgtgtatttgatggctccaagggctataaattacaaacaaaacacatcccagacattaggagttcataagtatatttaatgaaattggtggttttaggaagtcaactttagttttgctttgtttgcatgtccactaatttttttattttgatattagtcttttttaaaaaattttacagtagtcattgaaagttatgtttctttgtttacttcattttttcctctaaatattcaagactgggacaaaagtataaatattatttatttcaggtagaatttttttggtgtagttttttaatatatacttgaaggaaatgtttcaccttatttttggtctttgtttattcatttagaccctgcaagttgattctcattaattgtcagattccactacactttcttcctcataggtagtaattaccagtgtaactaagcatttgtgttctgatatctgaggccagtaactattaatatctagttctcagagcatttggaaaggttatcttaaatggctacctaaattgaaatccttttcagaaaaaatataattgcaaataggtaggagtggcctaaattatctaatgtaataaagtcagacaaaatgcatactttatagttcaagattttcggtatataaaatctgtcctttcctacctggacatgtcccattaaaaagtggaagattttaaataatttctttacagatgttttatttaagcaggtagcacaatctactaatgttgtttgatctgtgtttgttatactggttgtaattaatttttttaattcatgaactagcggaaaatttattaaattaactattaaccacattcaccttgtaaatgactgtataaaacttgttgacaatgcactgactttagaaagatgttaatgtgcataaatagagtgtaaataaaatagtgttgatgtactgaaatatgaactgtataaaaagtattagtaattgtatatggggtgtacctgtttatctgtaactgttatccaaacaaattaaatactgtggatgcctt

SEQ ID NO: 27264 - DNA, 3272 bp, Homo sapiens
ggcattatgcaaatgagaagctttccttctcttcacctcatctcctgatctgcacaaaagtgactgtaggacccagtgttgtagatgagcatgagagtgtggagcagagttggcgagtgcaagtcgagcccatcaacctggacagctgtctccgtgctttcaccagtgaggaagagctaggggaagatgagatatactactgttccaagtgtaagacccactgctttagcaacaaagaagctggatctctggaggcttccacccttcctgattattcaccttaagcgatttcaatttgtaaatgatcagtggataaaatcacagaaaattgtcaaatttcctcgggaaagttttgatccgagtgcttttttggtaccacgagacccggctctctgccagcatcaaccactcacaccccagggggatgagctctccaagcccaggattctggcaagagaggtgaagaaagtggatgtgcagagtttggctggggaagaggacatgctcctgagcaaaagcccatcctcactcagcgctaacatcagcagcagcccaaaaggttctccttcttcatcaagaaaaagtggaaccagctgtccctccagcaaaaacagcagccctaatagctgcccacggactttggggaggagcaaagggaggctccggctgccccagattggcagcaaaaataaactgtcaagtagtaagaagaacttggatgccagcaaagagaatggggctgggcagatctgtgagctggctgatgccttgagctgagggcatatgcgggggggcagccaaccagagctggtcactcctcaggaccacgaggtagctttgggcaatggattcctttatgagcatgaagcatatggcaatggctacagcaatggtcagcttggaaaccacagtgaagaagacagcactgatgaccaaagagaagacactcatattaagcctatttataatctatatgcaatttcatgccattcaggaattctgagtgggggccattacgtcacttatgccaaaaacccaaactgcaagtggtactgctacaatggcagcatctgtgaggaacatcaccctgatgaaattgacaccgactctgcctacattcttttctatgagcagcagaggatagactacgcacaatttctgccaaagattgatggcaaaaagatggcagacacaagcagtatggatgaagactttgagtctgattacgaaaagtactgtgtgttacagtaaagctaccactctggctgctagatagcttggtggggagggagatgactccttgtagctgatacttggcaaaagtgtcactgagaggcaagctaaatgtagttattttatcctgttagaatacaaattctaattaaaatagttaactttaagagtagtagtaattttattttgaagtctcatgcaagttgtctgatagagaactttcaggcagatcccaccattagcctgtaaacaaaaagtttggcaccagccacctgggaccaaataagaattcaattgtgcttgtccagatatgaacaaatatgtagtgagtatagagtttatcaataatcataacaaatattaaagatttccttggagtcaaagtaaaaaacaaaaaattgtaatgttgtctagggatgacatgatatgctacctcctttttcctgaagttttattccattctgttgacaagatggagaaagcaagatcatgaaggtgtgcaaatgattcttacggcatgggcgaggatttttcaatttattttttaaagtttccataccctttctttgtctttcttgctttttgtttttgccgttgtgtttatgtttgagatacaaccagtcattggtggcaggggcatagagtggtcagtctgaaagggaggctctcttaagagctatgtgccttccacccagagggagacccagtagaaagaaaaacatcctgggaaatccagctaccatggccctcccagtggaggcatcttacatttaggatacttcaggtatcctcagaaatgtattctgcaccccccggccccgcccatgctgagggaaggggagcagttgccaatatttgcaccatcttcacatgcacatgttgcaacaagagcttctgggaaggtaagcggcatcggagctagatcacgtttcacaattagtggtggttcttttccatgtttgttttgcactttaaaaaagagagaacacatgcaaatgaacttgcttgtgtgtatttgatggctccaagggctataaattacaaacaaaacacatcccagacattaggagttcataagtatatttaatgaaattggtggttttaggaagtcaactttagttttgctttgtttgcatgtccactaatttttttattttgatattagtcttttttaaaaaattttacagtagtcattgaaagttatgtttctttgtttacttcattttttcctctaaatattcaagactgggacaaaagtataaatattatttatttcaggtagaatttttttggtgtagttttttaatatatacttgaaggaaatgtttcaccttatttttggtctttgtttattcatttagaccctgcaagttgattctcattaattgtcagattccactacactttcttcctcataggtagtaattaccagtgtaactaagcatttgtgttctgatatctgaggccagtaactattaatatctagttctcagagcatttggaaaggttatcttaaatggctacctaaattgaaatccttttcagaaaaaatataattgcaaataggtaggagtggcctaaattatctaatgtaataaagtcagacaaaatgcatactttatagttcaagattttcggtatataaaatctgtcctttcctacctggacatgtcccattaaaaagtggaagattttaaataatttctttacagatgttttatttaagcaggtagcacaatctactaatgttgtttgatctgtgtttgttatactggttgtaattaatttttttaattcatgaactagcggaaaatttattaaattaactattaaccacattcaccttgtaaatgactgtataaaacttgttgacaatgcactgactttagaaagatgttaatgtgcataaatagagtgtaaataaaatagtgttgatgtactgaaatatgaactgtataaaaagtattagtaattgtatatggggtgtacctgtttatctgtaactgttatccaaacaaattaaatactgtggatgcctt

SEQ ID NO: 27265 - DNA, 3317 bp, Homo sapiens
ggcattatgcaaatgagaagctttccttctcttcacctcatctcctgatctgcacaaaagtgactgtaggacccagtgttgtagatgagcatgagagtgtggagcagagttggcgagtgcaagtcgagcccatcaacctggacagctgtctccgtgctttcaccagtgaggaagagctaggggaagatgagatatactactgttccaagtgtaagacccactgctttagcaacaaagaagctggatctctggaggcttccacccttcctgattattcaccttaagcgatttcaatttgtaaatgatcagtggataaaatcacagaaaattgtcaaatttcctcgggaaagttttgatccgagtgcttttttggtaccacgagacccggctctctgccagcatcaaccactcacaccccagggggatgagctctccaagcccaggattctggcaagagaggtgaagaaagtggatgtgcagagtttggctggggaagaggacatgctcctgagcaaaagcccatcctcactcagcgctaacatcagcagcagcccaaaaggttctccttcttcatcaagaaaaagtggaaccagctgtccctccagcaaaaacagcagccctaatagctgcccacggactttggggaggagcaaagggaggctccggctgccccagattggcagcaaaaataaactgtcaagtagtaagaagaacttggatgccagcaaagagaatggggctgggcagatctgtgagctggctgatgccttgagctgagggcatatgcgggggggcagccaaccagagctggtcactcctcaggaccacgaggtagctttgggcaatggattcctttatgagcatgaagcatatggcaatggctacagcaatggtcagcttggaaaccacagtgaagaagacagcactgatgaccaaagagaagacactcatattaagcctatttataatctatatgcaatttcatgccattcaggaattctgagtgggggccattacgtcacttatgccaaaaacccaaactgcaagtggtactgctacaatggcagcatctgtgaggaacatcaccctgatgaaattgacaccgactctgcctacattcttttctatgagcagcagaggatagactacgcacaatttctgccaaagattgatggcaaaaagatggcagacacaagcagtatggatgaagactttgagtctgattacgaaaagtactgtgtgttacagtaaagctaccactctggctgctagatagcttggtggggagggagatgactccttgtagctgatacttggcaaaagtgtcactgagaggcaagctaaatgtagttattttatcctgttagaatacaaattctaattaaaatagttaactttaagagtagtagtaattttattttgaagtctcatgcaagttgtctgatagagaactttcaggcagatcccaccattagcctgtaaacaaaaagtttggcaccagccacctgggaccaaataagaattcaattgtgcttgtccagatatgaacaaatatgtagtgagtatagagtttatcaataatcataacaaatattaaagatttccttggagtcaaagtaaaaaacaaaaaattgtaatgttgtctagggatgacatgatatgctacctcctttttcctgaagttttattccattctgttgacaagatggagaaagcaagatcatgaaggtgtgcaaatgattcttacggcatgggcgaggatttttcaatttattttttaaagtttccataccctttctttgtctttcttgctttttgtttttgccgttgtgtttatgtttgagatacaaccagtcattggtggcaggggcatagagtggtcagtctgaaagggaggctctcttaagagctatgtgccttccacccagagggagacccagtagaaagaaaaacatcctgggaaatccagctaccatggccctcccagtggaggcatcttacatttaggatacttcaggtatcctcagaaatgtattctgcaccccccggccccgcccatgctgagggaaggggagcagttgccaatatttgcaccatcttcacatgcacatgttgcaacaagagcttctgggaaggtaagcggcatcggagctagatcacgtttcacaattagtggtggttcttttccatgtttgttttgcactttaaaaaagagagaacacatgcaaatgaacttgcttgtgtgtatttgatggctccaagggctataaattacaaacaaaacacatcccagacattaggagttcataagtatatttaatgaaattggtggttttaggaagtcaactttagttttgctttgtttgcatgtccactaatttttttattttgatattagtcttttttaaaaaattttacagtagtcattgaaagttatgtttctttgtttacttcattttttcctctaaatattcaagactgggacaaaagtataaatattatttatttcaggtagaatttttttggtgtagttttttaatatatacttgaaggaaatgtttcaccttatttttggtctttgtttattcatttagaccctgcaagttgattctcattaattgtcagattccactacactttcttcctcataggtagtaattaccagtgtaactaagcatttgtgttctgatatctgaggccagtaactattaatatctagttctcagagcatttggaaaggttatcttaaatggctacctaaattgaaatccttttcagaaaaaatataattgcaaataggtaggagtggcctaaattatctaatgtaataaagtcagacaaaatgcatactttatagttcaagattttcggtatataaaatctgtcctttcctacctggacatgtcccattaaaaagtggaagattttaaataatttctttacagatgttttatttaagcaggtagcacaatctactaatgttgtttgatctgtgtttgttatactggttgtaattaatttttttaattcatgaactagcggaaaatttattaaattaactattaaccacattcaccttgtaaatgactgtataaaacttgttgacaatgcactgactttagaaagatgttaatgtgcataaatagagtgtaaataaaatagtgttgatgtactgaaatatgaactgtataaaaagtattagtaattgtatatggggtgtacctgtttatctgtaactgttatccaaacaaattaaatactgtggatgcctttatgtactgtttttcctcatacaagtaaacacagaaagtcaaatt

SEQ ID NO: 27266 - DNA, 3302 bp, Homo sapiens
  misc_feature (3246)..(3246): n is a, c, g, or t
  misc_feature (3252)..(3252): n is a, c, g, or t
ggcattatgcaaatgagaagctttccttctcttcacctcatctcctgatctgcacaaaagtgactgtaggacccagtgttgtagatgagcatgagagtgtggagcagagttggcgagtgcaagtcgagcccatcaacctggacagctgtctccgtgctttcaccagtgaggaagagctaggggaagatgagatatactactgttccaagtgtaagacccactgctttagcaacaaagaagctggatctctggaggcttccacccttcctgattattcaccttaagcgatttcaatttgtaaatgatcagtggataaaatcacagaaaattgtcaaatttcctcgggaaagttttgatccgagtgcttttttggtaccacgagacccggctctctgccagcatcaaccactcacaccccagggggatgagctctccaagcccaggattctggcaagagaggtgaagaaagtggatgtgcagagtttggctggggaagaggacatgctcctgagcaaaagcccatcctcactcagcgctaacatcagcagcagcccaaaaggttctccttcttcatcaagaaaaagtggaaccagctgtccctccagcaaaaacagcagccctaatagctgcccacggactttggggaggagcaaagggaggctccggctgccccagattggcagcaaaaataaactgtcaagtagtaagaagaacttggatgccagcaaagagaatggggctgggcagatctgtgagctggctgatgccttgagctgagggcatatgcgggggggcagccaaccagagctggtcactcctcaggaccacgaggtagctttgggcaatggattcctttatgagcatgaagcatatggcaatggctacagcaatggtcagcttggaaaccacagtgaagaagacagcactgatgaccaaagagaagacactcatattaagcctatttataatctatatgcaatttcatgccattcaggaattctgagtgggggccattacgtcacttatgccaaaaacccaaactgcaagtggtactgctacaatggcagcatctgtgaggaacatcaccctgatgaaattgacaccgactctgcctacattcttttctatgagcagcagaggatagactacgcacaatttctgccaaagattgatggcaaaaagatggcagacacaagcagtatggatgaagactttgagtctgattacgaaaagtactgtgtgttacagtaaagctaccactctggctgctagatagcttggtggggagggagatgactccttgtagctgatacttggcaaaagtgtcactgagaggcaagctaaatgtagttattttatcctgttagaatacaaattctaattaaaatagttaactttaagagtagtagtaattttattttgaagtctcatgcaagttgtctgatagagaactttcaggcagatcccaccattagcctgtaaacaaaaagtttggcaccagccacctgggaccaaataagaattcaattgtgcttgtccagatatgaacaaatatgtagtgagtatagagtttatcaataatcataacaaatattaaagatttccttggagtcaaagtaaaaaacaaaaaattgtaatgttgtctagggatgacatgatatgctacctcctttttcctgaagttttattccattctgttgacaagatggagaaagcaagatcatgaaggtgtgcaaatgattcttacggcatgggcgaggatttttcaatttattttttaaagtttccataccctttctttgtctttcttgctttttgtttttgccgttgtgtttatgtttgagatacaaccagtcattggtggcaggggcatagagtggtcagtctgaaagggaggctctcttaagagctatgtgccttccacccagagggagacccagtagaaagaaaaacatcctgggaaatccagctaccatggccctcccagtggaggcatcttacatttaggatacttcaggtatcctcagaaatgtattctgcaccccccggccccgcccatgctgagggaaggggagcagttgccaatatttgcaccatcttcacatgcacatgttgcaacaagagcttctgggaaggtaagcggcatcggagctagatcacgtttcacaattagtggtggttcttttccatgtttgttttgcactttaaaaaagagagaacacatgcaaatgaacttgcttgtgtgtatttgatggctccaagggctataaattacaaacaaaacacatcccagacattaggagttcataagtatatttaatgaaattggtggttttaggaagtcaactttagttttgctttgtttgcatgtccactaatttttttattttgatattagtcttttttaaaaaattttacagtagtcattgaaagttatgtttctttgtttacttcattttttcctctaaatattcaagactgggacaaaagtataaatattatttatttcaggtagaatttttttggtgtagttttttaatatatacttgaaggaaatgtttcaccttatttttggtctttgtttattcatttagaccctgcaagttgattctcattaattgtcagattccactacactttcttcctcataggtagtaattaccagtgtaactaagcatttgtgttctgatatctgaggccagtaactattaatatctagttctcagagcatttggaaaggttatcttaaatggctacctaaattgaaatccttttcagaaaaaatataattgcaaataggtaggagtggcctaaattatctaatgtaataaagtcagacaaaatgcatactttatagttcaagattttcggtatataaaatctgtcctttcctacctggacatgtcccattaaaaagtggaagattttaaataatttctttacagatgttttatttaagcaggtagcacaatctactaatgttgtttgatctgtgtttgttatactggttgtaattaatttttttaattcatgaactagcggaaaatttattaaattaactattaaccacattcaccttgtaaatgactgtataaaacttgttgacaatgcactgactttagaaagatgttaatgtgcataaatagagtgtaaataaaatagtgttgatgtactgaaatatgaactgtataaaaagtattagtaattgtatatgggtgactattattggactgtatccaacaatanatctgngatgctcttgtctgttttctatacaagacacagagtaaatcaaaaaaaaa

SEQ ID NO: 27267 - DNA, 3218 bp, Homo sapiens
ggcattatgcaaatgagaagctttccttctcttcacctcatctcctgatctgcacaaaagtgactgtaggacccagtgttgtagatgagcatgagagtgtggagcagagttggcgagtgcaagtcgagcccatcaacctggacagctgtctccgtgctttcaccagtgaggaagagctaggggaagatgagatatactactgttccaagtgtaagacccactgctttagcaacaaagaagctggatctctggaggcttccacccttcctgattattcaccttaagcgatttcaatttgtaaatgatcagtggataaaatcacagaaaattgtcaaatttcctcgggaaagttttgatccgagtgcttttttggtaccacgagacccggctctctgccagcatcaaccactcacaccccagggggatgagctctccaagcccaggattctggcaagagaggtgaagaaagtggatgtgcagagtttggctggggaagaggacatgctcctgagcaaaagcccatcctcactcagcgctaacatcagcagcagcccaaaaggttctccttcttcatcaagaaaaagtggaaccagctgtccctccagcaaaaacagcagccctaatagctgcccacggactttggggaggagcaaagggaggctccggctgccccagattggcagcaaaaataaactgtcaagtagtaagaagaacttggatgccagcaaagagaatggggctgggcagatctgtgagctggctgatgccttgagctgagggcatatgcgggggggcagccaaccagagctggtcactcctcaggaccacgaggtagctttgggcaatggattcctttatgagcatgaagcatatggcaatggctacagcaatggtcagcttggaaaccacagtgaagaagacagcactgatgaccaaagagaagacactcatattaagcctatttataatctatatgcaatttcatgccattcaggaattctgagtgggggccattacgtcacttatgccaaaaacccaaactgcaagtggtactgctacaatggcagcatctgtgaggaacatcaccctgatgaaattgacaccgactctgcctacattcttttctatgagcagcagaggatagactacgcacaatttctgccaaagattgatggcaaaaagatggcagacacaagcagtatggatgaagactttgagtctgattacgaaaagtactgtgtgttacagtaaagctaccactctggctgctagatagcttggtggggagggagatgactccttgtagctgatacttggcaaaagtgtcactgagaggcaagctaaatgtagttattttatcctgttagaatacaaattctaattaaaatagttaactttaagagtagtagtaattttattttgaagtctcatgcaagttgtctgatagagaactttcaggcagatcccaccattagcctgtaaacaaaaagtttggcaccagccacctgggaccaaataagaattcaattgtgcttgtccagatatgaacaaatatgtagtgagtatagagtttatcaataatcataacaaatattaaagatttccttggagtcaaagtaaaaaacaaaaaattgtaatgttgtctagggatgacatgatatgctacctcctttttcctgaagttttattccattctgttgacaagatggagaaagcaagatcatgaaggtgtgcaaatgattcttacggcatgggcgaggatttttcaatttattttttaaagtttccataccctttctttgtctttcttgctttttgtttttgccgttgtgtttatgtttgagatacaaccagtcattggtggcaggggcatagagtggtcagtctgaaagggaggctctcttaagagctatgtgccttccacccagagggagacccagtagaaagaaaaacatcctgggaaatccagctaccatggccctcccagtggaggcatcttacatttaggatacttcaggtatcctcagaaatgtattctgcaccccccggccccgcccatgctgagggaaggggagcagttgccaatatttgcaccatcttcacatgcacatgttgcaacaagagcttctgggaaggtaagcggcatcggagctagatcacgtttcacaattagtggtggttcttttccatgtttgttttgcactttaaaaaagagagaacacatgcaaatgaacttgcttgtgtgtatttgatggctccaagggctataaattacaaacaaaacacatcccagacattaggagttcataagtatatttaatgaaattggtggttttaggaagtcaactttagttttgctttgtttgcatgtccactaatttttttattttgatattagtcttttttaaaaaattttacagtagtcattgaaagttatgtttctttgtttacttcattttttcctctaaatattcaagactgggactatatacttgaaggaaatgtttcaccttatttttggtctttgtttattcatttagaccctgcaagttgattctcattaattgtcagattccactacactttcttcctcataggtagtaattaccagtgtaactaagcatttgtgttctgatatctgaggccagtaactattaatatctagttctcagagcatttggaaaggttatcttaaatggctacctaaattgaaatccttttcagaaaaaatataattgcaaataggtaggagtggcctaaattatctaatgtaataaagtcagacaaaatgcatactttatagttcaagattttcggtatataaaatctgtcctttcctacctggacatgtcccattaaaaagtggaagattttaaataatttctttacagatgttttatttaagcaggtagcacaatctactaatgttgtttgatctgtgtttgttatactggttgtaattaatttttttaattcatgaactagcggaaaatttattaaattaactattaaccacattcaccttgtaaatgactgtataaaacttgttgacaatgcactgactttagaaagatgttaatgtgcataaatagagtgtaaataaaatagtgttgatgtactgaaatatgaactgtataaaaagtattagtaattgtatatggggtgtacctgtttatctgtaactgttatccaaacaaattaaatactgtggatgcctt

SEQ ID NO: 27268 - DNA, 3216 bp, Homo sapiens
ggcattatgcaaatgagaagctttccttctcttcacctcatctcctgatctgcacaaaagtgactgtaggacccagtgttgtagatgagcatgagagtgtggagcagagttggcgagtgcaagtcgagcccatcaacctggacagctgtctccgtgctttcaccagtgaggaagagctaggggaagatgagatatactactgttccaagtgtaagacccactgctttagcaacaaagaagctggatctctggaggcttccacccttcctgattattcaccttaagcgatttcaatttgtaaatgatcagtggataaaatcacagaaaattgtcaaatttcctcgggaaagttttgatccgagtgcttttttggtaccacgagacccggctctctgccagcatcaaccactcacaccccagggggatgagctctccaagcccaggattctggcaagagaggtgaagaaagtggatgtgcagagtttggctggggaagaggacatgctcctgagcaaaagcccatcctcactcagcgctaacatcagcagcagcccaaaaggttctccttcttcatcaagaaaaagtggaaccagctgtccctccagcaaaaacagcagccctaatagctgcccacggactttggggaggagcaaagggaggctccggctgccccagattggcagcaaaaataaactgtcaagtagtaagaagaacttggatgccagcaaagagaatggggctgggcagatctgtgagctggctgatgccttgagctgagggcatatgcgggggggcagccaaccagagctggtcactcctcaggaccacgaggtagctttgggcaatggattcctttatgagcatgaagcatatggcaatggctacagcaatggtcagcttggaaaccacagtgaagaagacagcactgatgaccaaagagaagacactcatattaagcctatttataatctatatgcaatttcatgccattcaggaattctgagtgggggccattacgtcacttatgccaaaaacccaaactgcaagtggtactgctacaatggcagcatctgtgaggaacatcaccctgatgaaattgacaccgactctgcctacattcttttctatgagcagcagaggatagactacgcacaatttctgccaaagattgatggcaaaaagatggcagacacaagcagtatggatgaagactttgagtctgattacgaaaaggagatgactccttgtagctgatacttggcaaaagtgtcactgagaggcaagctaaatgtagttattttatcctgttagaatacaaattctaattaaaatagttaactttaagagtagtagtaattttattttgaagtctcatgcaagttgtctgatagagaactttcaggcagatcccaccattagcctgtaaacaaaaagtttggcaccagccacctgggaccaaataagaattcaattgtgcttgtccagatatgaacaaatatgtagtgagtatagagtttatcaataatcataacaaatattaaagatttccttggagtcaaagtaaaaaacaaaaaattgtaatgttgtctagggatgacatgatatgctacctcctttttcctgaagttttattccattctgttgacaagatggagaaagcaagatcatgaaggtgtgcaaatgattcttacggcatgggcgaggatttttcaatttattttttaaagtttccataccctttctttgtctttcttgctttttgtttttgccgttgtgtttatgtttgagatacaaccagtcattggtggcaggggcatagagtggtcagtctgaaagggaggctctcttaagagctatgtgccttccacccagagggagacccagtagaaagaaaaacatcctgggaaatccagctaccatggccctcccagtggaggcatcttacatttaggatacttcaggtatcctcagaaatgtattctgcaccccccggccccgcccatgctgagggaaggggagcagttgccaatatttgcaccatcttcacatgcacatgttgcaacaagagcttctgggaaggtaagcggcatcggagctagatcacgtttcacaattagtggtggttcttttccatgtttgttttgcactttaaaaaagagagaacacatgcaaatgaacttgcttgtgtgtatttgatggctccaagggctataaattacaaacaaaacacatcccagacattaggagttcataagtatatttaatgaaattggtggttttaggaagtcaactttagttttgctttgtttgcatgtccactaatttttttattttgatattagtcttttttaaaaaattttacagtagtcattgaaagttatgtttctttgtttacttcattttttcctctaaatattcaagactgggacaaaagtataaatattatttatttcaggtagaatttttttggtgtagttttttaatatatacttgaaggaaatgtttcaccttatttttggtctttgtttattcatttagaccctgcaagttgattctcattaattgtcagattccactacactttcttcctcataggtagtaattaccagtgtaactaagcatttgtgttctgatatctgaggccagtaactattaatatctagttctcagagcatttggaaaggttatcttaaatggctacctaaattgaaatccttttcagaaaaaatataattgcaaataggtaggagtggcctaaattatctaatgtaataaagtcagacaaaatgcatactttatagttcaagattttcggtatataaaatctgtcctttcctacctggacatgtcccattaaaaagtggaagattttaaataatttctttacagatgttttatttaagcaggtagcacaatctactaatgttgtttgatctgtgtttgttatactggttgtaattaatttttttaattcatgaactagcggaaaatttattaaattaactattaaccacattcaccttgtaaatgactgtataaaacttgttgacaatgcactgactttagaaagatgttaatgtgcataaatagagtgtaaataaaatagtgttgatgtactgaaatatgaactgtataaaaagtattagtaattgtatatggggtgtacctgtttatctgtaactgttatccaaacaaattaaatactgtggatgcctt

SEQ ID NO: 27269 - DNA, 3218 bp, Homo sapiens
ggcattatgcaaatgagaagctttccttctcttcacctcatctcctgatctgcacaaaagtgactgtaggacccagtgttgtagatgagcatgagagtgtggagcagagttggcgagtgcaagtcgagcccatcaacctggacagctgtctccgtgctttcaccagtgaggaagagctaggggaagatgagatatactactgttccaagtgtaagacccactgctttagcaacaaagaagctggatctctggaggcttccacccttcctgattattcaccttaagcgatttcaatttgtaaatgatcagtggataaaatcacagaaaattgtcaaatttcctcgggaaagttttgatccgagtgcttttttggtaccacgagacccggctctctgccagcatcaaccactcacaccccagggggatgagctctccaagcccaggattctggcaagagaggtgaagaaagtggatgtgcagagtttggctggggaagaggacatgctcctgagcaaaagcccatcctcactcagcgctaacatcagcagcagcccaaaaggttctccttcttcatcaagaaaaagtggaaccagctgtccctccagcaaaaacagcagccctaatagctgcccacggactttggggaggagcaaagggaggctccggctgccccagattggcagcaaaaataaactgtcaagtagtaagaagaacttggatgccagcaaagagaatggggctgggcagatctgtgagctggctgatgccttgagctgagggcatatgcgggggggcagccaaccagagctggtcactcctcaggaccacgaggtagctttgggcaatggattcctttatgagcatgaagcatatggcaatggctacagcaatggtcagcttggaaaccacagtgaagaagacagcactgatgaccaaagagaagacactcatattaagcctatttataatctatatgcaatttcatgccattcaggaattctgagtgggggccattacgtcacttatgccaaaaacccaaactgcaagtggtactgctacaatggcagcatctgtgaggaacatcaccctgatgaaattgacaccgactctgcctacattcttttctatgagcagcagaggatagactacgcacaatttctgccaaagattgatggcaaaaagatggcagacacaagcagtatggatgaagactttgagtctgattacgaaaagtactgtgtgttacagtaaagctaccactctggctgctagatagcttggtggggagggagatgactccttgtagctgatacttggcaaaagtgtcactgagaggcaagctaaatgtagttattttatcctgttagaatacaaattctaattaaaatagttaactttaagagtagtagtaattttattttgaagtctcatgcaagttgtctgatagagaactttcaggcagatcccaccattagcctgtaaacaaaaagtttggcaccagccacctgggaccaaataagaattcaattgtgcttgtccagatatgaacaaatatgtagtgagtatagagtttatcaataatcataacaaatattaaagatttccttggagtcaaagtaaaaaacaaaaaattgtaatgttgtctagggatgacatgatatgctacctcctttttcctgaagttttattccattctgttgacaagatggagaaagcaagatcatgaaggtgtgcaaatgattcttacggcatgggcgaggatttttcaatttattttttaaagtttccataccctttctttgtctttcttgctttttgtttttgccgttgtgtttatgtttgagatacaaccagtcattggtggcaggggcatagagtggtcagtctgaaagggaggctctcttaagagctatgtgccttccacccagagggagacccagtagaaagaaaaacatcctgggaaatccagctaccatggccctcccagtggaggcatcttacatttaggatacttcaggtatcctcagaaatgtattctgcaccccccggccccgcccatgctgagggaaggggagcagttgccaatatttgcaccatcttcacatgcacatgttgcaacaagagcttctgggaaggtaagcggcatcggagctagatcacgtttcacaattagtggtggttcttttccatgtttgttttgcactttaaaaaagagagaacacatgcaaatgaacttgcttgtgtgtatttgatggctccaagggctataaattacaaactttaggaagtcaactttagttttgctttgtttgcatgtccactaatttttttattttgatattagtcttttttaaaaaattttacagtagtcattgaaagttatgtttctttgtttacttcattttttcctctaaatattcaagactgggacaaaagtataaatattatttatttcaggtagaatttttttggtgtagttttttaatatatacttgaaggaaatgtttcaccttatttttggtctttgtttattcatttagaccctgcaagttgattctcattaattgtcagattccactacactttcttcctcataggtagtaattaccagtgtaactaagcatttgtgttctgatatctgaggccagtaactattaatatctagttctcagagcatttggaaaggttatcttaaatggctacctaaattgaaatccttttcagaaaaaatataattgcaaataggtaggagtggcctaaattatctaatgtaataaagtcagacaaaatgcatactttatagttcaagattttcggtatataaaatctgtcctttcctacctggacatgtcccattaaaaagtggaagattttaaataatttctttacagatgttttatttaagcaggtagcacaatctactaatgttgtttgatctgtgtttgttatactggttgtaattaatttttttaattcatgaactagcggaaaatttattaaattaactattaaccacattcaccttgtaaatgactgtataaaacttgttgacaatgcactgactttagaaagatgttaatgtgcataaatagagtgtaaataaaatagtgttgatgtactgaaatatgaactgtataaaaagtattagtaattgtatatggggtgtacctgtttatctgtaactgttatccaaacaaattaaatactgtggatgcctt

SEQ ID NO: 27270 - DNA, 3203 bp, Homo sapiens
ggcattatgcaaatgagaagctttccttctcttcacctcatctcctgatctgcacaaaagtgactgtaggacccagtgttgtagatgagcatgagagtgtggagcagagttggcgagtgcaagtcgagcccatcaacctggacagctgtctccgtgctttcaccagtgaggaagagctaggggaagatgagatatactactgttccaagtgtaagacccactgctttagcaacaaagaagctggatctctggaggcttccacccttcctgattattcaccttaagcgatttcaatttgtaaatgatcagtggataaaatcacagaaaattgtcaaatttcctcgggaaagttttgatccgagtgcttttttggtaccacgagacccggctctctgccagcatcaaccactcacaccccagggggatgagctctccaagcccaggattctggcaagagaggtgaagaaagtggatgtgcagagtttggctggggaagaggacatgctcctgagcaaaagcccatcctcactcagcgctaacatcagcagcagcccaaaaggttctccttcttcatcaagaaaaagtggaaccagctgtccctccagcaaaaacagcagccctaatagctgcccacggactttggggaggagcaaagggaggctccggctgccccagattggcagcaaaaataaactgtcaagtagtaagaagaacttggatgccagcaaagagaatggggctgggcagatctgtgagctggctgatgccttgagctgagggcatatgcgggggggcagccaaccagagctggtcactcctcaggaccacgaggtagctttgggcaatggattcctttatgagcatgaagcatatggcaatggctacagcaatggtcagcttggaaaccacagtgaagaagacagcactgatgaccaaagagaagacactcatattaagcctatttataatctatatgcaatttcatgccattcaggaattctgagtgggggccattacgtcacttatgccaaaaacccaaactgcaagtggtactgctacaatggcagcatctgtgagtacgcacaatttctgccaaagattgatggcaaaaagatggcagacacaagcagtatggatgaagactttgagtctgattacgaaaagtactgtgtgttacagtaaagctaccactctggctgctagatagcttggtggggagggagatgactccttgtagctgatacttggcaaaagtgtcactgagaggcaagctaaatgtagttattttatcctgttagaatacaaattctaattaaaatagttaactttaagagtagtagtaattttattttgaagtctcatgcaagttgtctgatagagaactttcaggcagatcccaccattagcctgtaaacaaaaagtttggcaccagccacctgggaccaaataagaattcaattgtgcttgtccagatatgaacaaatatgtagtgagtatagagtttatcaataatcataacaaatattaaagatttccttggagtcaaagtaaaaaacaaaaaattgtaatgttgtctagggatgacatgatatgctacctcctttttcctgaagttttattccattctgttgacaagatggagaaagcaagatcatgaaggtgtgcaaatgattcttacggcatgggcgaggatttttcaatttattttttaaagtttccataccctttctttgtctttcttgctttttgtttttgccgttgtgtttatgtttgagatacaaccagtcattggtggcaggggcatagagtggtcagtctgaaagggaggctctcttaagagctatgtgccttccacccagagggagacccagtagaaagaaaaacatcctgggaaatccagctaccatggccctcccagtggaggcatcttacatttaggatacttcaggtatcctcagaaatgtattctgcaccccccggccccgcccatgctgagggaaggggagcagttgccaatatttgcaccatcttcacatgcacatgttgcaacaagagcttctgggaaggtaagcggcatcggagctagatcacgtttcacaattagtggtggttcttttccatgtttgttttgcactttaaaaaagagagaacacatgcaaatgaacttgcttgtgtgtatttgatggctccaagggctataaattacaaacaaaacacatcccagacattaggagttcataagtatatttaatgaaattggtggttttaggaagtcaactttagttttgctttgtttgcatgtccactaatttttttattttgatattagtcttttttaaaaaattttacagtagtcattgaaagttatgtttctttgtttacttcattttttcctctaaatattcaagactgggacaaaagtataaatattatttatttcaggtagaatttttttggtgtagttttttaatatatacttgaaggaaatgtttcaccttatttttggtctttgtttattcatttagaccctgcaagttgattctcattaattgtcagattccactacactttcttcctcataggtagtaattaccagtgtaactaagcatttgtgttctgatatctgaggccagtaactattaatatctagttctcagagcatttggaaaggttatcttaaatggctacctaaattgaaatccttttcagaaaaaatataattgcaaataggtaggagtggcctaaattatctaatgtaataaagtcagacaaaatgcatactttatagttcaagattttcggtatataaaatctgtcctttcctacctggacatgtcccattaaaaagtggaagattttaaataatttctttacagatgttttatttaagcaggtagcacaatctactaatgttgtttgatctgtgtttgttatactggttgtaattaatttttttaattcatgaactagcggaaaatttattaaattaactattaaccacattcaccttgtaaatgactgtataaaacttgttgacaatgcactgactttagaaagatgttaatgtgcataaatagagtgtaaataaaatagtgttgatgtactgaaatatgaactgtataaaaagtattagtaattgtatatggggtgtacctgtttatctgtaactgttatccaaacaaattaaatactgtggatgcctt

SEQ ID NO: 27271 - DNA, 1922 bp, Homo sapiens
ggcattatgcaaatgagaagctttccttctcttcacctcatctcctgatctgcacaaaagtgactgtaggacccagtgttgtagatgagcatgagagtgtggagcagagttggcgagtgcaagtcgagcccatcaacctggacagctgtctccgtgctttcaccagtgaggaagagctaggggaagatgagatatactactgttccaagtgtaagacccactgctttagcaacaaagaagctggatctctggaggcttccacccttcctgattattcaccttaagcgatttcaatttgtaaatgatcagtggataaaatcacagaaaattgtcaaatttcctcgggaaagttttgatccgagtgcttttttggtaccacgagacccggctctctgccagcatcaaccactcacaccccagggggatgagctctccaagcccaggattctggcaagagaggtgaagaaagtggatgtgcagagtttggctggggaagaggacatgctcctgagcaaaagcccatcctcactcagcgctaacatcagcagcagcccaaaaggttctccttcttcatcaagaaaaagtggaaccagctgtccctccagcaaaaacagcagccctaatagctgcccacggactttggggaggagcaaagggaggctccggctgccccagattggcagcaaaaataaactgtcaagtagtaagaagaacttggatgccagcaaagagaatggggctgggcagatctgtgagctggctgatgccttgagctgagggcatatgcgggggggcagccaaccagagctggtcactcctcaggaccacgaggtagctttgggcaatggattcctttatgagcatgaagcatatggcaatggctacagcaatggtcagcttggaaaccacagtgaagaagacagcactgatgaccaaagagaagacactcatattaagcctatttataatctatatgcaatttcatgccattcaggaattctgagtgggggccattacgtcacttatgccaaaaacccaaactgcaagtggtactgctacaatggcagcatctgtgaggaacatcaccctgatgaaattgacaccgactctgcctacattcttttctatgagcagcagaggatagactacgcacaatttctgccaaagattgatggcaaaaagatggcagacacaagcagtatggatgaagactttgagtctgattacgaaaagtactgtgtgttacagtaaagctaccactctggctgctagatagcttggtggggagggagatgactccttgtagctgatacttggcaaaagtgtcactgagaggcaagctaaatgtagttattttatcctgttagaatacaaattctaattaaaatagttaactttaagagtagtagtaattttattttgaagtctcatgcaagttgtctgatagagaactttcaggcagatcccaccattagcctgtaaacaaaaagtttggcaccagccacctgggaccaaataagaattcaattgtgcttgtccagatatgaacaaatatgtagtgagtatagagtttatcaataatcataacaaatattaaagatttccttggagtcaaagtaaaaaactgtaatatgatggtcagtctagggatgaatctctagtcgcgttcgcctcttgccggtactctgttgccagacatcgactcaggatggagggcacatgattatgaagggggcctaactgatcagtaacgcactcgtgcgaggattctgccatctatgtctggtggtttccttaccctttctctgtcactccttgcttcttgttgcgcgcgttgtctttatttttgtaagacaaccagtcaattggtggcttggggcatcagtgtggctctgtctgaaaggtgaaggctctcttcagag

SEQ ID NO: 27272 - DNA, 375 bp, Homo sapiens
tgtaagacatttgtataggaaatgtggagaataaaaagtttgacatttataacctcaccaaccagcatggttgctaatattttgggtgtgttttcttgggagtgatgtttaaacatattcaagatcttgctgtttaatgaatgtgtatcatgcttctttcactttatcataaacaaccgtgttcctagaagccattcacgaggatggctgagaatggctgcagaatatttcatcagatcaatataagcaggccaccaaataatggtctgcattgggactctgttgctagtgacaagaaacctaagtcaaagttgtttaaacaaaaagagttcattgatcttatattattcagaacttggctttcatttcctggct

SEQ ID NO: 27273 - DNA, 947 bp, Homo sapiens
ctctttccatttctattctctctcacttgaattctggcattatttttagtggcctctactgataatacctaccctagagtacataaaaattatattaaaagaggaagtagcagtatgcataattttaacagattctataatgggtgcctcaaaatatgtattgtgccattccgcaaatttaaaagctaattgaggacaatttttttttaatttcctaaatgagaccaccttggatttttatttttgccatttagatgtttatacttatttagcttttataaaacataagccaagctaaatcccacataacaactctggtattcttccctcatatgagcagtgattttatttgttacccaccttagatagactaagaaagttctagtcttgtttctccttctccccgcttccctggggtttttccttaccataagtattctggtccgagggttcagttcctttagtcaagatgtcacaagtttaaaaacaaaacttgagaaactaccaaaggctcaggagttgtccactttgttgaaatccattaaattagagaagtctcactaacagatgtatttaaatataggtacaacaaataatttctttttctccccttccccaaattacagtcagcatttaaagctgtttatggcttgccatcagcattattctggtaggcttgttagtgttaaaatctatttgatttttttttttttttttgcctcttaaagtctaattttaggatggatgaattcagatgtttaccagagtgtgtattttacataatgttcttgattaaaaagacttgtttgtaaattatccgttgtttttgcatatgcccagttgatgtgataaaattttcattgtcttgccatataaagccttggttatcaacaggtggaatgtagatattgtaaagctttttgtgaattaaaagtgcaaaataaagc

SEQ ID NO: 27274 - DNA, 2227 bp, Homo sapiens
  misc_feature (583)..(583): n is a, c, g, or t
gaggcactaaagaaaaagtggcagtaatgtaatccgcttgttttgccaagccactaaaaataccttggtaaatattagctaatgtgcagccctttgcttgctattaagatttactgatttcaatagaaaggaacctaaaaactgagcatattatataacccagacaccagggacaatctctaatcacctaagagttcataaaatacatattggctctgtctgtggttagattaaatgccattatctaaaaaaagtaggatctgtgcaataataggtctgccatgtgaatgacagttttggttagtggatgaatttatcctgtatcattgcattctctaagaataatccctctcactctgaacaaataaatcaatagcattggctaacccagtgcatgtaaaaaacaccttcagtaaatgccaggttttcccgaataataaagacttccaacaataaagacttcttttaagtctgtttcttacataactgttgtatggagagattaacatggtatcttgtttcttcctggtgtgatcttacttttgtcttgtaaatatgtacttatgtctgtatgttcacctgnatctttgtgaacccttggaaaactcagtatttcagtgggtttcagagaataggccgggagattgatgataagtaagtgtttccggccagttgttattaggcacaacttttaggagaaacaagtgagcgatagagcgtggccaaggagaggaaggcaatgctggaacccaatccacgcctgctgcccagagaccttagctgatggcttgtcatgtcttagcatgttggtattcaagccatgtgatgttggaaagaaaaaatacctattcagcttggggcttggtctgagaacaaccaattgccttggtttaaatcacacgactccactatcaaattaagtgtttccaagtttacacaaattagcgtcagtccactgactgtcgcctacaataaattaggctgagtctaaaagaaatcagtctgcatagaaagaccaacaaccagcaccacttccttgctttttccagccatgaatgcttccagtcggaatgtgtttgacacgttgatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggccatcttagccaagatctccaggcccaaaaaacgtgccaagaccattacgttcagcaagaacgcagtgatcagcaaacggggagggaagctttgcctcctaatccgagtggctaatctcaggaagagccttcttattggcagtcacatttatggaaagcttctgaagaccacagtcactcctgaaggagagaccattattttggaccagatcaatatcaactttgtagttgacgctgggaatgaaaatttattcttcatctccccattgacaatttaccatgtcattgatcacaacagccctttcttccacatggcagcggagacccttctccagcaggactttgaattagtggtgtttttagatggcacagtggagtccaccagtgctacctgccaagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaa

SEQ ID NO: 27275 - DNA, 314 bp, Homo sapiens
tcttcatgcacagacttgttcctgatgtctcagtcccacagtcgtgtgcttctcatagtttatttgatccacaagttaagtaattttatctgcattttaccagtaaggataatgactaaaagatcttactaaagttactgcacctacttagtgttaagagattggggccaggtgcggtggctcacacctgtaatcctagcactttgggaggctgaggtgggaggattgcttgagcctgggaggtcgaggctgcaatgagccatgaagtatgccactgtgctccagtctgggtgatagagcaagactctgtctca

SEQ ID NO: 27276 - DNA, 357 bp, Homo sapiens
gccatatgtattttaaatgtattctcttagtggttagcctggggattacaattaacatcttaaaacaatctcttttggattcatatccacttaatttcaatagtggcagtcaagagtcactccaatatacctttattctctcctcactcccttgtgctattattatcatacaaattacatctctatatattataaggcccatcaacacagttttgtaattattgctttagggcagctgtcctttaaaacaggaaaatttacaaacaaaactgtttatattgtctttcaccatacctacataggtacccttacctctgctctttatttcttcatctggatgcaagttaatgtctggtg

SEQ ID NO: 27277 - DNA, 1829 bp, Homo sapiens
  misc_feature (1556)..(1556): n is a, c, g, or t
gttattaacacactgaagctaccgtgtgaggaggtgcctcactcatgtactgcattattatagcttgctaaacataccttggttaataaggaactatttcttgaatgtcacttccttgtctcctgccacgcatctggtggtgggcccggagcccttgttgaccaataggctcaatatttgtgagggagacctggacagcagagtagaggtgtgttaggacacgctgggccctgccagcatttgtgtctgtcacctctaaccacgaagaggataatgacttgagagagcagtgcctgctgctgcagctcctccttcccaatctcaagtgaatacctcttgaattcctctagctgtagcctagaatcatgtatagaaaaggattctgggaaatgtagttccccttaacccaaatgctaacagtacaaactgcagttgtgcagttaagtatgtgtttgtacttatttgttatactggaaacaggagagatatttgtaattatttctgcttaaaagatatcagaatagttatttactattcaggtatcagatttgtttaaaaatgacatttaacttgattatatcattattttcttttccattaaaccctaacaatttttaaagccatgaaataacttaaaaaacagaagtaatttaatcttaccctctcctttggaaagaaaatattccttttttaaagtgaaagcaagtttcaaaaaaagaaaaggaataaagaacagctactccataggcagagcagcggcctggtctgcttgactgagtatccttgcagttatttctggattatatgctaaacaaggggtggattattcatgagttttccaggaaaggggtggagatttcccggaactgagagttcctcccctttttagaccatatagggtaacttccggacattgccttgggatttctaaactgtcatggcgctggcaggagcgccttttagcatgctaatatattataattagtgtataatgagcagcggggacgaccagaggtctctttcattgccatcttggttttggtgagttttggccggcttctttatggcatcctgtgttatcagcagggtctttgtgacctgtatcctgtgccgacctcctatctcatcctgtgactaagaaaatattcttttaatttgacaaatcaagttggatctcattgtgctaaaaaaggtttttaaaaatattatccaatacagtgccatctagtgacaaatcatttacttgctggttattgaaaatagttgactacaagttttatgtcctgataagtcaggaacttcacttctaattgtgcaaattcttaagatattttaagcgactatttctaaataaataaaatatttgtaaatagagagctggaaaatattttctaaccctcaggttttatacatatgtatcacaatgtgtcttatttaatgccacgtggacccaggagtaaaatcaaaatcagtgttttgtctaataaggtggtaataggattattttagaaatgtgatgtaaaggaatgagcatggctttaaaatcaaacagacangagtttgtctatttggacttatttttcttatgacttagcaggtaattactacctgcttggaagtgcaccaagcactatataggtactgcctcattacatattcacaaaactctataggtattttacaaatgaggaaaccggccaggcgcggtggctcacgcctgtaatcccagcactttgggaggccgaggcgggggaatcacgaggtctggagatccagaccatcctggctaacacagtgaaaccccgtctctactaaaaatacaaaaaaaa

SEQ ID NO: 27278 - DNA, 925 bp, Homo sapiens
atttgaactataaattcaaggcatgaaaaagttaggctctggagaaaggattccaacacaataaggtgaattcaataccctgacctttgcctttgtcccgtgatactggattttgtcttttcctaacccggcttagtctcccatccatgcactgagaagggcacaagagaatgtactttcaatagtgcctgggatttcatcttttactttatacagagaatattaaacttaccttgaaagatgtcaccttgaagaagttcccattggctgaatctgggacaatttgaacatccaaataaatatgatagtaatggcttataacccattgaataaaatccatgagtccattcagataatgaacaatcagctgggcacagtagctcacgcctataatcccagcaccttggggctgaagcaggagaatcacttaaggccaggagttcaagaccagcctgggcagcatagttgagacccccgtctgtactttttaaaaataaaaataataaaataaaaaatttttaaggaggtaataaacaacaaggtcaagccccattacagctgattaaaatctaataaatataaaaggaatgataacatcagaaaatcaccataactgtcatagctacaattaattgaggcaagagtcatcaagggatgcccaaattttgggacaataataacctccttacttggaaaatgaaatggtaacttcacagtggagaaagcaaatggacactaagttacccaagtggtaaaagttaacaatcctaataataaaacaaaatgacataatcacttatgtagtattgatgccaaaaaatgtattacctgaatctagtcatgaaggaactccagatcagcccagattgaggaatgctgtacaaatcaagtggcctgtactcttttaaaatgctaataacattta

SEQ ID NO: 27279 - DNA, 438 bp, Homo sapiens
gcttatctacatggatatctgtgtttaataaggagaataacagctaccagatgtgatttgctggatagtggaaagtcacaggactcaaatacctttcctaacggcctgctaactgcaacctctgcctcccggatccaagcgattctcctgccgcagcctgcagagtagctgggattataggcacaccttggtaatccgcccgcctcggcctcccaaagttctaggattacaggtgtgagccactgcacctggcccttccccatagtttaatactttaggcttaggtttttcctttaacagttcaaattccccttgctaagccctaggaaccgtcctttgcagacggaataaggaactattccaaagtacttgctggccggacacagtggtgcaaacctgtaatcccagcactttgggagacggaggcaggaagatctc

SEQ ID NO: 27280 - DNA, 309 bp, Homo sapiens
atggcaaaaatctccagccctacagagactgagcggtgcattgagtccctgattgctgttttccagaagtatgctggaaaggatggttacaaccgcaatctctccaagacggagttcctaagcttcatgaatacagagctggctgcctttacaaagaaccagaaggaccccggtgtccttgaccacatgaagaaactggatgtcagcagtgatgggcagttagatttcccaaaatttcttaatctgattggtggcctagctgtggcttgccatgactccttcctcaaggctgtcccctcccagaagtag

SEQ ID NO: 27281 - DNA, 1487 bp, Homo sapiens
atgatttcatttcccagaaaatgtaaagaatggataccagcaatgattcctggctgttacctattctggaggggtggggttggggagggggttgtccatacctctgtggtatgagtatttcagggaaaaagaaagcaggcatggcacccattcgattttccctgacagcatctgagatccttttggggagacgctgaggagtgtttgctgccatgtactcttacagctctatgctgacactcccatttgatgtggtccagaacttagacctcagtccttggatcagccctgtggtccctgcaagcaggggcatctttctgcatgtgagccagcccccttcctgttcaagggttctgctggatctgggcttttcctgtccttcacttctgggatgattcaccccacatcttccagtaccctgtaaaccattttaaaatatttagaaaactatcctcccaaaaatgcttttgaaaatgagagccctctgtccctgccacttacagctagtctctttgggataggggtgtatgtggagagattcatgtaagtctcacatgagtgacctgtgcccctatgtgtactaatgtgtgtactgggtcagaaggtgccctgggttcccacagaccttggtttcctgcctgggtgggtgggagggagggaacttcagagagtatgtgcgaacagccatagcagagccacccctgccaaggacccagtgagggaaactcaggagcaggtggttggttcagttcccgcgctgatgtctggggcagtgcatgtgtgagaagagaggcgcaaagcagtgaaaggagtgatttggcatccagagggcccgggagccccacggataccccagggaagccactgactcacaccgctgcagaggctcctgggcccaatgcccgacccctgctggccagcatggggcctagcactggaagatgcctcaggtgtgtttggagtgggggaaacggaagtagggcacgctctcagagaccaggatagagagtcagggaacctgggaaagagtagtgccagttccgggtaggctgctgcaccaggccctaccagctcaggctataaacagtctgctttgccccaagtcttttccgtccacccccaacagccttgtcatcacttagctactgatcacgcccatggcttgacattggagggttacattagtggagtccgccacagcttcgaaccctctccccagatgccctttgcctctgctgtggccctggggttttatcaactgtccccttcctatcctcctctccaccctgttttttgttttttttttttttaaataatattttgctatgggggaggggaatatcaaatggacaagatcacttttaaatggtagtttttataagatgttataaacttgtatctttttaccattaaagtgcagtgtatgttccttcgtgatatatttaggatatttaaataaaaggaaaatggggcttttctacatacta

SEQ ID NO: 27282 - DNA, 552 bp, Homo sapiens
atgatttcatttcccagaaaatgtaaagaatggataccagcaatgattcctggctgttacctattctggaggggtggggttggggagggggttgtccatacctctgtggtatgagtatttcagggaaaaagaaagcaggcatggcacccattcgattttccctgacagcatctgagatccttttggggagacgctgaggagtgtttgctgccatgtactcttacagctctatgctgacactcccatttgatgtggtccagaacttagacctcagtccttggatcagcccctttgcctctgctgtggccctggggttttatcaactgtccccttcctatcctcctctccaccctgttttttgttttttttttttttaaataatattttgctatgggggaggggaatatcaaatggacaagatcacttttaaatggtagtttttataagatgttataaacttgtatctttttaccattaaagtgcagtgtatgttccttcgtgatatatttaggatatttaaataaaaggaaaatggggcttttctacatacta

SEQ ID NO: 27283 - DNA, 399 bp, Homo sapiens
tggctccctttcaagtttgtttttccatcagaagtgtgactttgtcttaaaccatccacactagatccccagccttcatagtgacctcattaaagattcagcctgtggctcctgagaattaaacctcttttgatttgaaggaatcgggatttttcaattatctcaagaaaagggataggccaggtgcagtggctcacacctgtaatcccagccctttgggaggctgaggtgggaggatcaccagaggccaggagttggcatccagtctgggcaacatagcaacaccctatctctaaaaaaaattaggtgtgtggtggtgtgtgcctgtaggcctagctgcttgggaggctgaggccagaggatcgcttgagcccaggagttggagatttcactccagcc

SEQ ID NO: 27284 - DNA, 408 bp, Homo sapiens
acactaaggaatatgctgctaatttgcacagtagacatatttatgaaattttacttttttgagaaattaatccattttcctcttgatatacactatgaattctaagacatggatgcacacacacatttaaaaactgtatttaagagtgcataggccgggcacggtggctcacacctgtaatcccagcactttgggaggccaaggtgggcagatcacaaggtcaggagatggagaccatcctggctaacacggtgaaacctcatctctactaaaaatacaaaaaaattagccaggcatggtagtgggtgcctgtaatcccagctacttgggaggctgaggcaggagaatggcgtgaacccaggaggcgaagcctgcagtgagctgagattgtgccactgcactccagcc

SEQ ID NO: 27285 - DNA, 261 bp, Homo sapiens
tgcccctcagcaaatccaaaattgcagattaaagtaacaatgggaagccattgttatccatcaagttagtgcagataattacaagaacactcaatgctcatgagggtaaggtgaaacacagcagcttcacatgcctcctgtagggatagaaactggaccatttagggggtgaatatctatacacatcataagctttaaaagggttcaaaacttttaacccaataatttaagcaaataattaggaatacaggcaatgataca

SEQ ID NO: 27286 - DNA, 537 bp, Homo sapiens
tcagcatttcaggcaacctgttttcaacacttcgtcaatttaacacactgtgttcagttccctgtaagctgagtaggcaataccttccctctgtttgtgccatcaaacaaaagctgcctgctattgttaacccgaagattgtccccaatgttgagcagcctcaatccagctaggtcaggatgtgatgacactggatagtttgtctctctctgtttccaagaacaaatagtacacaacttgagtcaagggctgaacagtcttgccttttcataaaaaatgcccatgcgtgtcatagcatgccctcttttctgggacagacattttcaaactggggttccttgggctcttgttcagtttagggaagatccatcgacctgacttttgggtcactgggtcactgcagaggtgagagggaagccaaagggatgggctctggatcctaggatcctgccttcaaatagaggagtaccactcttcactgttggatcaattaattctaagtaaaatttcttaaaataaagggtatgactatgctgt

SEQ ID NO: 27287 - DNA, 243 bp, Homo sapiens
ctgacctagaaatattatccatactttttgtacacccacagataaattcaatacatctgtacctaagtgaaagtcaagactggaaagaaaagtaaaaatctaaagaatgttttaaaatgatcagcagtatgggatgtagtatagttgtaatgctacacttccaagaaacattacttatgaagaagagatgaaatttaaaattgactaacatgattgaaattaataaaatacatgagaaatttg

SEQ ID NO: 27288 - DNA, 436 bp, Homo sapiens
cacacaacctttaaatgaccagatctcgcgagaacttactcactatcatgaagacggcaccaagccatgagagatccatcccgtgatccaatcacctcccaccggcccccacctccagcactggggattacaattcaacctgagatttgggtgggtacagatatccaaactatatcaattggatataagtttaccaagattgagaatattgcaggaagaactggtttgggagcaggaagtcaagcatcccattttggaaatgttatatttgaatgaccattagatatctaagtaataatttagagcaagcaattggaggacatataagtctggagctcaggagtaggtcagagctagaggtataaatttgagtctttggctttgaggtggtattttaaagctatgggattagatgaatgtatctatggaagaaatc

SEQ ID NO: 27289 - DNA, 369 bp, Homo sapiens
aaaaaaaagaaaaaaaaaaccctgctgcactgtctttggagttggagaacagatacagtttatagtagagagtgtcaggcgcacactgtgtgatgttggataaaaggcatgctgacttgtagagaagctgtgtacagaagtgtttttgctggttccctttttgtggtttgtgaaactacctctgtttttatgtgggagctgggcagaagactattttctggcagtgctttttagagaatcattttaagatagcttgaaggacatgaaacagatgatgttaggtagctcctgatgacctctgctggcctgggcagatcatcagaagttggtttactttttttccaagttgattttttcaaacctccaaac

SEQ ID NO: 27290 - DNA, 235 bp, Homo sapiens
gaaacacatggagatggctgaaaagtgaagagctatttcaagtgtaataaaactatcagcaaggtgtggtggctcatgcctgtaataccagcaactggggaggtcaaggtgggcagattgcttgagctcaggagttcaagaccagcctgtgcaacatggcgagaccccacctctataaaatgaaaggtaagaccagcatatcaaactatttccgcattaaatgcagtaacagata

SEQ ID NO: 27291 - DNA, 364 bp, Homo sapiens
cgagacttcatctgaaaaaaaaaaaaaaaaagccaagtgttgctaaaaccttgagtttttaagagaagccagaagtttggtttttaaaatgagagcgctccagatatttttcagtgaaggcttaatttttacttttttatttcagaaaatgttagatatagtcagaagtagatagtagtttagatagtagtagtttaatgaactctcatcactcaacttctgttacctcattgtcctcacttacctctcccctgccctgatgattttgaagtaaggttcagacatcatattatttcacctataaactatattaccatcatcacacacacctgaaatgtcttcacaatcccgggactgttcccat

SEQ ID NO: 27292 - DNA, 349 bp, Homo sapiens
ttccccatagcagtctatgcttggctttcatccctcttatcctaaggatcctaaattatatattttgtcatgaactacccacccacacccatcccaaaggagactgcaggctacctgctggcaatctgtctttcctattcggctcaccgcctaacacacagaatacgatgaaggaacaaataaaggaatgaatgaatgaggatcaacgtcatctggctcccggtgtctctcacaccctcactttccattcgctctggttgagctgttcatttttccacccagcaattctcacatctaggtaaggccatcagagccctttcagagtgaatgaggatgagaaacagaaaca

SEQ ID NO: 27293 - DNA, 343 bp, Homo sapiens
tcttgccatattgcccaggctggactcaaactcctggggcttaagcagttctcctgcctcaacttctcactgaaagatatttttaatccttgtaccaaccctctaggcaggatgtttcctcttaggttaatgggtagggaaactggcttagatgaaaatgacttgctcatggtcacacttgctagtatagagttagtgggaacctacacaccttggattactgtgctttttttcattgcataatgttgcttactttgtaccttcatctttcatttacagctgttaccgaacatacttcttgatcacctaatttgtgctgaggataaagcactaaatacaagac

SEQ ID NO: 27294 - DNA, 514 bp, Homo sapiens
gccatgcacagctcaggaatacaggttattggggcttgaagctgagtcatctgcccctcacctgacttcacccacccctaactgccatgacaacgggagccggtcaccccagagtcacctggatacttcacaactttactggtggcccaggacttgcagggctggaagatagtgcaggcttattggaaacgtggggcagaggcggctgtgacctcacagggtacttctctgggccttcacactgtactccttcctgccaactttactctcggcacctactgtcccctgtgagatgctattaaagtaagaagactaattttccaaatacttatggaaacacaactcatgacatgtttttgatttttcatgaacatttcaaaaagtgaaaaaagcactagtaaaacaaaacccttttagttctgctcccccaagaaataaccactgttaacactgtggtatatttccttcaagtctttgtgtgtgtgtgtctaaaatacagagttgtaaatatatg

SEQ ID NO: 27295 - DNA, 3468 bp, Homo sapiens
  misc_feature (69)..(69): n is a, c, g, or t
  misc_feature (854)..(854): n is a, c, g, or t
  misc_feature (1302)..(1302): n is a, c, g, or t
ctcctgcatagagggtaccattctgcgctgctgcaagttacggaatgaaaaattagaacaacagaaacntggttctcttgacacttcagtgttagggaacatcagcaagacccatcccaggagaccttgaaggaagcctttgaaagggagaatgaaggagtcatctttgcaaaatagctcctgcagcctgggaaaggagactaaaaaggaaaacatgttccttcagtcgtcaatgctgacctgcattttcctgctaatatctggttcctgtgagttatgcgccgaagaaaatttttctagaagctatccttgtgatgagaaaaagcaaaatgactcagttattgcagagtgcagcaatcgtcgactacaggaagttccccaaacggtgggcaaatatgtgacagaactagacctgtctgataatttcatcacacacataacgaatgaatcatttcaagggctgcaaaatctcactaaaataaatctaaaccacaaccccaatgtacagcaccagaacggaaatcccggtatacaatcaaatggcttgaatatcacagacggggcattcctcaacctaaaaaacctaagggagttactgcttgaagacaaccagttaccccaaataccctctggtttgccagagtctttgacagaacttagtctaattcaaaacaatatatacaacataactaaagagggcatttcaagacttataaacttgaaaaatctctatttggcctggaactgctattttaacaaagtttgcgagaaaactaacatagaagatggagtatttgaaacgctgacaaatttggagttgctatcactatctttcaattctctttcacacgtgncacccaaactgccaagctccctacgcaaactttttctgagcaacacccagatcaaatacattagtgaagaagatttcaagggattgataaatttaacattactagatttaagcgggaactgtccgaggtgcttcaatgccccatttccatgcgtgccttgtgatggtggtgcttcaattaatatagatcgttttgcttttcaaaacttgacccaacttcgatacctaaacctctctagcacttccctcaggaagattaatgctgcctggtttaaaaatatgcctcatctgaaggtgctggatcttgaattcaactatttagtgggagaaatagcctctggggcatttttaacgatgctgccccgcttagaaatacttgacttgtcttttaactatataaaggggagttatccacagcatattaatatttccagaaacttctctaaacntttgtctctacgggcattgcatttaagaggttatgtgttccaggaactcagagaagatgatttccagcccctgatgcagcttccaaacttatcgactatcaacttgggtattaattttattaagcaaatcgatttcaaacttttccaaaatttctccaatctggaaattatttacttgtcagaaaacagaatatcaccgttggtaaaagatacccggcagagttatgcaaatagttcctcttttcaacgtcatatccggaaacgacgctcaacagattttgagtttgacccacattcgaacttttatcatttcacccgtcctttaataaagccacaatgtgctgcttatggaaaagccttagatttaagcctcaacagtattttcttcattgggccaaaccaatttgaaaatcttcctgacattgcctgtttaaatctgtctgcaaatagcaatgctcaagtgttaagtggaactgaattttcagccattcctcatgtcaaatatttggatttgacaaacaatagactagactttgataatgctagtgctcttactgaattgtccgacttggaagttctagatctcagctataattcacactatttcagaatagcaggcgtaacacatcatctagaatttattcaaaatttcacaaatctaaaagttttaaacttgagccacaacaacatttatactttaacagataagtataacctggaaagcaagtccctggtagaattagttttcagtggcaatcgccttgacattttgtggaatgatgatgacaacaggtatatctccattttcaaaggtctcaagaatctgacacgtctggatttatcccttaataggctgaagcacatcccaaatgaagcattccttaatttgccagcgagtctcactgaactacatataaatgataatatgttaaagttttttaactggacattactccagcagtttcctcgtctcgagttgcttgacttacgtggaaacaaactactctttttaactgatagcctatctgactttacatcttcccttcggacactgctgctgagtcataacaggatttcccacctaccctctggctttctttctgaagtcagtagtctgaagcacctcgatttaagttccaatctgctaaaaacaatcaacaaatccgcacttgaaactaagaccaccaccaaattatctatgttggaactacacggaaacccctttgaatgcacctgtgacattggagatttccgaagatggatggatgaacatctgaatgtcaaaattcccagactggtagatgtcatttgtgccagtcctggggatcaaagagggaagagtattgtgagtctggagctaacaacttgtgtttcagatgtcactgcagtgatattatttttcttcacgttctttatcaccaccatggttatgttggctgccctggctcaccatttgttttactgggatgtttggtttatatataatgtgtgtttagctaaggtaaaaggctacaggtctctttccacatcccaaactttctatgatgcttacatttcttatgacaccaaagatgcctctgttactgactgggtgataaatgagctgcgctaccaccttgaagagagccgagacaaaaacgttctcctttgtctagaggagagggattgggacccgggattggccatcatcgacaacctcatgcagagcatcaaccaaagcaagaaaacagtatttgttttaaccaaaaaatatgcaaaaagctggaactttaaaacagctttttacttggctttgcagaggctaatggatgagaacatggatgtgattatatttatcctgctggagccagtgttacagcattctcagtatttgaggctacggcagcggatctgtaagagctccatcctccagtggcctgacaacccgaaggcagaaggcttgttttggcaaactctgagaaatgtggtcttgactgaaaatgattcacggtataacaatatgtatgtcgattccattaagcaatactaactgacgttaagtcatgatttcgcgccataataaagatgcaaaggaatgacatttctgtattagttatctattgctatgtaacaaattatcccaaaacttagtggtttaaaacaacacatttgctggcccacagtttt

SEQ ID NO: 27296 - DNA, 3331 bp, Homo sapiens
  misc_feature (69)..(69): n is a, c, g, or t
  misc_feature (717)..(717): n is a, c, g, or t
  misc_feature (1165)..(1165): n is a, c, g, or t
ctcctgcatagagggtaccattctgcgctgctgcaagttacggaatgaaaaattagaacaacagaaacntggaaaacatgttccttcagtcgtcaatgctgacctgcattttcctgctaatatctggttcctgtgagttatgcgccgaagaaaatttttctagaagctatccttgtgatgagaaaaagcaaaatgactcagttattgcagagtgcagcaatcgtcgactacaggaagttccccaaacggtgggcaaatatgtgacagaactagacctgtctgataatttcatcacacacataacgaatgaatcatttcaagggctgcaaaatctcactaaaataaatctaaaccacaaccccaatgtacagcaccagaacggaaatcccggtatacaatcaaatggcttgaatatcacagacggggcattcctcaacctaaaaaacctaagggagttactgcttgaagacaaccagttaccccaaataccctctggtttgccagagtctttgacagaacttagtctaattcaaaacaatatatacaacataactaaagagggcatttcaagacttataaacttgaaaaatctctatttggcctggaactgctattttaacaaagtttgcgagaaaactaacatagaagatggagtatttgaaacgctgacaaatttggagttgctatcactatctttcaattctctttcacacgtgncacccaaactgccaagctccctacgcaaactttttctgagcaacacccagatcaaatacattagtgaagaagatttcaagggattgataaatttaacattactagatttaagcgggaactgtccgaggtgcttcaatgccccatttccatgcgtgccttgtgatggtggtgcttcaattaatatagatcgttttgcttttcaaaacttgacccaacttcgatacctaaacctctctagcacttccctcaggaagattaatgctgcctggtttaaaaatatgcctcatctgaaggtgctggatcttgaattcaactatttagtgggagaaatagcctctggggcatttttaacgatgctgccccgcttagaaatacttgacttgtcttttaactatataaaggggagttatccacagcatattaatatttccagaaacttctctaaacntttgtctctacgggcattgcatttaagaggttatgtgttccaggaactcagagaagatgatttccagcccctgatgcagcttccaaacttatcgactatcaacttgggtattaattttattaagcaaatcgatttcaaacttttccaaaatttctccaatctggaaattatttacttgtcagaaaacagaatatcaccgttggtaaaagatacccggcagagttatgcaaatagttcctcttttcaacgtcatatccggaaacgacgctcaacagattttgagtttgacccacattcgaacttttatcatttcacccgtcctttaataaagccacaatgtgctgcttatggaaaagccttagatttaagcctcaacagtattttcttcattgggccaaaccaatttgaaaatcttcctgacattgcctgtttaaatctgtctgcaaatagcaatgctcaagtgttaagtggaactgaattttcagccattcctcatgtcaaatatttggatttgacaaacaatagactagactttgataatgctagtgctcttactgaattgtccgacttggaagttctagatctcagctataattcacactatttcagaatagcaggcgtaacacatcatctagaatttattcaaaatttcacaaatctaaaagttttaaacttgagccacaacaacatttatactttaacagataagtataacctggaaagcaagtccctggtagaattagttttcagtggcaatcgccttgacattttgtggaatgatgatgacaacaggtatatctccattttcaaaggtctcaagaatctgacacgtctggatttatcccttaataggctgaagcacatcccaaatgaagcattccttaatttgccagcgagtctcactgaactacatataaatgataatatgttaaagttttttaactggacattactccagcagtttcctcgtctcgagttgcttgacttacgtggaaacaaactactctttttaactgatagcctatctgactttacatcttcccttcggacactgctgctgagtcataacaggatttcccacctaccctctggctttctttctgaagtcagtagtctgaagcacctcgatttaagttccaatctgctaaaaacaatcaacaaatccgcacttgaaactaagaccaccaccaaattatctatgttggaactacacggaaacccctttgaatgcacctgtgacattggagatttccgaagatggatggatgaacatctgaatgtcaaaattcccagactggtagatgtcatttgtgccagtcctggggatcaaagagggaagagtattgtgagtctggagctaacaacttgtgtttcagatgtcactgcagtgatattatttttcttcacgttctttatcaccaccatggttatgttggctgccctggctcaccatttgttttactgggatgtttggtttatatataatgtgtgtttagctaaggtaaaaggctacaggtctctttccacatcccaaactttctatgatgcttacatttcttatgacaccaaagatgcctctgttactgactgggtgataaatgagctgcgctaccaccttgaagagagccgagacaaaaacgttctcctttgtctagaggagagggattgggacccgggattggccatcatcgacaacctcatgcagagcatcaaccaaagcaagaaaacagtatttgttttaaccaaaaaatatgcaaaaagctggaactttaaaacagctttttacttggctttgcagaggctaatggatgagaacatggatgtgattatatttatcctgctggagccagtgttacagcattctcagtatttgaggctacggcagcggatctgtaagagctccatcctccagtggcctgacaacccgaaggcagaaggcttgttttggcaaactctgagaaatgtggtcttgactgaaaatgattcacggtataacaatatgtatgtcgattccattaagcaatactaactgacgttaagtcatgatttcgcgccataataaagatgcaaaggaatgacatttctgtattagttatctattgctatgtaacaaattatcccaaaacttagtggtttaaaacaacacatttgctggcccacagtttt

SEQ ID NO: 27297 - DNA, 450 bp, Homo sapiens
gatagcttgagcccagaaagtcaaggctgcagtgagcagtgatcgtgccactgtactccagcctggaaaacaaagtgagaccctttctcaacaacaacaacaaataaagaagagaggcaataatacctacctcatagcatcgttagaaaaattaaataatacatgtaatgcatttagcaaaatgttcagcacgtatcagttacttgaagaatgcttattttgtttccactctttctttcttcttttttttttttttgagatggagtttccctcttgttgcccaggctggagtgcaatggtctgatcgcagctcagtgcaacctctgcctgccaggttcaggtgattctcctgcctcggcctcccaagtagttgggattaaaggcatgcgccaccatgcctggctaattttgtatttttagtagagaatgttggtccatgttggtcaggct

SEQ ID NO: 27298 - DNA, 168 bp, Homo sapiens
  misc_feature (17)..(17): n is a, c, g, or t
ccaacgatcgaagattntatcccagcaagcacaactagcagctgctgagaaattcaaagttcaaggtgaagctgtctcaaacattcaagaaaacacacagactccaactgtacaagaggagagtgaagaggaagaggttgatgaaacaggtgtagaagttaaggacat

SEQ ID NO: 27299 - DNA, 487 bp, Homo sapiens
ctgtaatgacctgtttgaggccccttctgtcctacccggtttgatctcccatcacctccagatatttcaattcccaggtaaactcaaggcagttgaaattatattctggaacacagtcttctaaagttgattagaaatgttatcagagtacctaggattcagtaggaaaaggcaaggtagtggatgtaaacagaaggtggtttcttatacagaggttaatgtgagcagaacacaccaaagtaagagaaatcaacccaactactgtgagacacaaaaatctattgtttctctagaatagtgggtcaagattgcagatatggagggaaatggggacacagttgagcttatgggggcctgaatctgtcctgaatgtctaaaccacctaagttctgtataattttgtggtttggtcaagtaatgtaccatatttgctgttggttatggtcagcacctggagctgctgagaacggtttgggtgctagaaatg

SEQ ID NO: 27300 - DNA, 1594 bp, Homo sapiens
ctcctcgctgcagctggcaagattctttctagcagaacagaaacactggcccccaattccactctcccctcctgatgctaccgcagagggcagaaaggtgccctgtagcgtccaccatgtgtgtgtcctgagtttccagtgcaagtcatctggatttgcatttagctagggaaactcggccctcaaaccctctccctctctgcctgaatttgccaaaatgccaaccatccgggcaggtgtggatgccacagtccatccccattgcatttcacccccacatggacagaggcacacactcgcacacattcccagcacctttgactgctgggggatgcaggccagggtctgcctggagcctcagggttgggacttatctccaaaggagcccacaccccctcttccaggatgggcactggctggcagcacttttttccctcatcacatccctgacccctgcccagcccacatgcacatgctgtttcctgtctccagggccctagcctgtggatctcttcctcccatgcactcctagggtgaatgggctcagcaccaaacctggctgtgcccattccccacaaccccagcttggcctcctgtgggaaggagaaggcagacctgcccagaggagaggggcagtgttcccacccacctgctccagcacaggaaccagggaggaaagaagggagagggaggttccattcaccgtcttctgggttagcgcttgattggatgtttcaagcaagggacaaggtgatggtggctgtaataggctcctcgtgggcaccgtcaccccagaaggcctgggcacccatgagaacctgtggccagcccttttcattggctgagttccctgctgttgtgcgtggtgccattttttttttaaacaacatatataaaaacaaaacaactggttctgtgtgtatcaacttaatttgcatatgaatgagtgttgtgttgtgatttgcagtgttttgacaccgtgattggctttgtttgggtctctcttctttctgtgaaattaactgctgtgcgttttcactgttcttagagaagaccctgagctcctggggttttcttgtctcacttctaccctgacctgctgggagcccaccccaccccagtccagccatgagggtatttccagcctattccaatgactgaaacccttcttggaagaaaacgtctaatgtcggggacgtagggacgcttccagacttgccctggccggaaccctgcagcctggggccccagcccgcctgcagctcagctttccccaacaccctcaggacccagccccagccccggcagaccttccctgggagctgcttaggtggtctccacagcgccctctaggggccaagcagggttccagattctccagccttctgccagctttaaaacccttcactcaagcagcattactgtacatgcaatgaaaaatactatatatgacagtcaaaacctgtgtacatatttccatgtacatatttatacatacacacaccttcctattataaatatataaagcatgacatctctttggcattccaagtttgtgtttttttaaatccttggaaatacggctttggaaacc

SEQ ID NO: 27301 - DNA, 498 bp, Homo sapiens
aaaaaaaaaaaaaaaaaacctttcctctgagcccatcttcctttcgctccttgactttccttgacttgctgttggaaagtctaatatgaaaagggctgaaactaggcattaaatataactgatgctcaaaggtaagatttccatccaacagattccttctccctcccaagggtcttcccaggcagtgctgctacttatcccaaataaaatggtaaaagaataaagacagccgggcgcggtggctcacgcctgtaatcccagcactttgggaggccgaggcggacggatcacaaggtcaggagatcgagaccatcctggctaacacggtgaaaccccgtctctactaaaaatacaaaaaaaaaattggctgggcgcggtggcgggcgcggaggctgaggcgggagaatggcgtgaacccggggggcggagcttgcagcgagccgagatcgcgccactgcactccagcctgggcgacagagcgagactcatctcaaaaag

SEQ ID NO: 27302 - DNA, 469 bp, Homo sapiens
tctgtatcccattttcatcctccctaatcacataatttttctcttctttttttctgcattcttgaagtgcttcttcagtttgttgtcttagggacaattttctataatattgtcccagagatcttgctggtctccatattgtgagatttcttagcccttcatgaagatatatcaaataaataatttgtttgtaacttgatatcattacaatctttcctttttaaaaatctaccttcttttttatatttgcctgacccagtctgttccccttctatctaaatgttaaccttatattattttacagagtcgatgttttcttgaatttcattcaagttcctgtaaaaaaaaagaatctactagtttaccatttcctatagtagatctttttcaaaggtttgtttttcttatgcatctttagtacttaggttctctctctttttgaaagtgcagactattttcacaaatatcg

SEQ ID NO: 27303 - DNA, 471 bp, Homo sapiens
catggctggctgaaccctggatgccttttcttccgcgtccccatgaatgaaagctgtctgggccttcattctgcagacagggacaaacagctccatgctgtttgtcctcccagtgcagccgtgctgggagggtctgggggagcttcctacaaggagagactcctgctgctttggaaaactgagaaaaaataggggtctaaccctctcctcccattttacaagtggggaaatgaggcgtgaaaggagaggcgtctgggttactccgtgggtctggggtccagggaagggcctgtatgggggagggagctgggaggggacggtgtctggctctacccctgtggggtggggaggtggggctcccctgtatcacaggacatcccccctgagaggtccctcatatgtctgggtcctgtgggtgggggactaactgcgcaatgtagttaggtgctcaataaacggagttgccgctga

SEQ ID NO: 27304 - DNA, 283 bp, Homo sapiens
agcaagggagtgtgtggacactgagaagaggcaggcagatttggcaattgaggtggagccgtttggacaaacttgaaagcccgactacaggggattaataaatgtgagtggagaacggtgaggcagaggcggaaagcccagacagccccccccccccccccaacaccacaaaaccccccccaagagaagttaatttagggtcaccaggctgaggaacccgatgaccatcttcctgtgtaacgttcagtctttcattgtagtgaggaggcatttctccactctt

SEQ ID NO: 27305 - DNA, 975 bp, Homo sapiens
agactcaggcaagagccatctcattaaggtggaggtcacagttttaaaggaaaatttaaaattcaaattaattacaaaatgtcatagttaagaaaagtcttttaaagtagatgtggtttccaaggttcatgctgttttttttaaaaaatggagatacataaagtggctgaaatagaagttgaattagaaaaaatgtgtatatgcacacaatcacatgcatataccaccctccccacacccagcacgcatggttcccactgacaaattctcctcaaggttgagtgtgggatttagttcctggccaaatgcgacttggaacctattctgagtgggcagataggtgtctgctgtggccactggcatccatgccggggtggcccccacagctgcctcctgcatgtgcagtggcatgtaatgcatttctgaaccaggcagagaagatatttagaaagtccagcatgtagaagaattgagtatctggtgaagaatttattagatatagcctcataaattccttagatatataacatttccaaattctttgtccttgaaaaaagttgattttgaaaatttgactagtttattgaacatatatcagtttgttaattggattgaatcactattatattccaggtattttactaggacctttaatatacactgtcccatgtaaggtaataagtactgagtttaggtgaaagtatgaaaacaggagagatgttgaggatggaattattgaaaaggaattggccttgaattctaaccaagatagctaagtaaggtcaggctttgatttgtccttgccagcaaaaagacttaggcagtaacagaaaacatgtgaaggaaaataaaaaatacctctgagttaaaaagtgaggtaaacgtttcatgaaatggaaataaaatccagtatgaaacagttagctaggttcttggtccaaaaagttcaccagtgactaggattttagcatacta

SEQ ID NO: 27306 - DNA, 533 bp, Homo sapiens
cttcagcctcccgagtaactgggactacaggcatgtgccaccacacccagcttttttttgtattttttgtggagacggggttttgccatgttgcctaggctggtttcgaactcctgtgctcaagcgatctgcctgccttgtaaagtactgggattacaggcgtgagctactacacctggcctttatttttaaagatgattaaaacttaccctgaaagaccatcatgctgatgatctaccatactattatatgttcagtttttcctatgtcttcatagtgatctttctgattatttcatttccttaaactctgatattttggtcttaaatgcgggataaagtccaaattccctaatgtggcttacaaaatcttcaggattttgacccctactaacctttcatagcttttattgctccttcccccatccttgccccctggaaaacctctttctgtgaaaacaaacagaagcaaaaccaaagaaagcttctcaactccagccacaataaatgctttgtagtttactgtaaaccttt

SEQ ID NO: 27307 - DNA, 408 bp, Homo sapiens
aactctgtgaatatgccgaaaacttttggcataagaacactttaaatgagtgaactgtatagtacaataagtcctcaatgttgtcagtaggttcttggaaactatgactttaagcaaaaggacatataacagaaccaatatttttttctcatcattataataaaatgaagttgaactaaacagtcttattcaaggacctgatgtacattgtttcacttaaagttgcagtttccaaatacctggtaaggactttaagtgaggacttactgtatgtaaattaatttcaataaagctgttttttataaaagccaaaatggcagaaggacagagaaaaatgcagaccttggtgttattatattatttgactttctctgtacacaagccaataaatcctccttattgtttaaa

SEQ ID NO: 27308 - DNA, 316 bp, Homo sapiens
atatttagtcacattttaggttagaactttcaggaagtgagtttttacacagaaattagtgctataaacagcccttaaaatgggaatttaatcgtacttatttaaaatatatatgtatataatcttaccaacccagaaagacatgttctctggcattttataaactaagatgctactggaaggaaaaagctaaatctgaaatacacaaacaacatatttacactgtgatatggtttagatctgtatgccaaagctgaatctcatgtcagattgtaatctccaatgttggagatggggcctaggaggaggtgattgg

SEQ ID NO: 27309 - DNA, 386 bp, Homo sapiens
gatggtcttggagtgttggttcaatggggtgcactggctttggttctaggtggatgcagtagtgcagtgtccatgtagtttcttcagctgtaatccatgttagtgatgtttgcatgtgtctcagtggcataggctaagagagtttgtggcagtggtggtgcagctctgctggaagtgggctttcaggttatttcaggttatttctcaggtcagtgtgcctacatgcccatggtgggttggccaacttggggtctcactcatcagggttgggaccacagagcttttactttaactaagggcgtcagtgtgctgtttcatggctagcctgaaggccgatcatccaggggtggcccattgtgctgtttcttgagtccagtacactggtt

SEQ ID NO: 27310 - DNA, 458 bp, Homo sapiens
aagttatacaaatatctctaacaatgattgctccacagcctgctcgagttcctctcttgtaaaagctttttatttttctgccacatgactaggctgcaaagtttttaagcttttacgctatgcttcccttgcaagtaaaaataaattacaacttacttttttttgctccaacgtgtgagcataggttgttagaagcagccaggccacatcttgaacgctttggtgcttagacatttttccaacagaagccctaaatcatcgctttcaaatttaaacttttatatatccctagggcatgacaaaaattcagccaaccactttgctaagacaacatgaatgacctttgcttcggtcctaattttctaattttcatctgagacctcctcagctcagccttcactgtccaggtcactatcagcattttggtcacagccattcaaagttaagaaaatctcaac

SEQ ID NO: 27311 - DNA, 218 bp, Homo sapiens
aagttatacaaatatctctaacaatgattgctccacagcctgctcgagttcctctcttgtaaaagctttttatttttctgccacatgactaggctgcaaagtttttaagcttttacgctatgcttcccttgcaagtaaaaataaattacaacttacttttttttgctccaacgtgtgagcataggttgttagagatatttgtataacttaaaaaaaaa

SEQ ID NO: 27312 - DNA, 1082 bp, Homo sapiens
atttgtaactttctggattatttaggaagatatttcaaaaatattttagaggtcagaacttttactgagcaagtgcttatatgagagctagattcttaagctttgccacaaaaaatactatgtaattcatgatataaaatatatttctgaaagaactttagttaattcattgatttctaagtaaaagtgagtaatgaatggttcttttatcccatctttcagtatacaaatttattattcttggcatctaacttggtggaaaaatgtactgcgagttgaatagctctcagaaagtttattttccaaaagtaagcattactgtattatagaaggaatgcctaaggaagatgtcctctataatccttagtggactcatttataagattcataaattgttttgtttggtcattgtatattaactctttcaggtgagtctcctgaaacttaaacatcttaggacgtgtttaagattattagcacacatgttgggaattaagttgaaatcctggtctttttattcaagagcgtatgttcctccctgtgtttgtctatttatggaagtattcagaattagaaacatggaaagaagcaattcagtaattacattaaaatagatgggatcctttttgataatgagtccttttatttttttgagatggagtctcactctgttgcccaggctagagggcagtggcaggatttcggctcactgcaacttctgcctcctgggtttaagagattcttgtgcctcagcctcctgagtagctgggattacaggtgtgtgccaccatgccccctaatgtttgtatttttagtagagatagggtttcaccatgttggccaggctgatctcaaactcctgacttcaagtgatccacctgtctcagcctcccaaagtgctgggattacaggcgtgagccaccgtgcctggacagtaataagtcttaattgtgtatttttacccaaggttggtgtttggggagatgtttaccaagagctgtctgagagtttttgtaaacattgagaactgacacatgaatgatattttcaaaatttaatttctttaataatgctccccttaa

SEQ ID NO: 27313 - DNA, 441 bp, Homo sapiens
tctggtgatttccacgcggtctcatttaaacccggtggtggcactgcaggatggaaaccgaggctcagagaggagaagtaacttggaagtcaggctccagatccaacctttatcctgtgctgtacccagaaagggccatgcccattgcaagccgctttcctgctgtgagcctcagttttcatttctgtgaaatgttgcctagcaaagctggggcaggctgtggatctcaggctctcaattaatgctccatttatcttgcccggcccctgagtgtcctcagggcacagccagcccgaggttctcatccacggatcaccagcagcagagggcctcgggcattctggtggctgtttgggagctcgcctccgccctgggctggagtatccctagcttttgctttcagtcagtgctgtgaactttgccagggaacagggaagttgt

SEQ ID NO: 27314 - DNA, 476 bp, Homo sapiens
gagccgatttcaaaccaggcaagagtccaggacacaggggccaccacacacctcccccagcaacgtgcctccaggcaggagttggcttaaaccctctcgcaaccccttaggggcaaattatttgcattaattaatggattgattcattaattcaagatactgtgcttgggacctacagctggggttccataagctcaaactagagcgaaggtgatggagacctcagttcgctttcattggggtacgtctggcaggtaccccaggccctgtgtggtcatggaggacgaggtctggtgcccctcgaggccggctgctgtggggtgggggttgcatcgtgtctcttcatcttcagctcccagccctggcttggcgcagaacacacagacatttaatactcatgcctgaagtgaaaatgtaaagtgtctgggaattttgaagtcacagaaaaaaatgtttaaagaaaataaactacaggg

SEQ ID NO: 27315 - DNA, 518 bp, Homo sapiens
tggcttcatgcctgtcatcctagcacttttgggaggatgaggcggtaggatcactcaagcccaggagtttgagaccagcctgggcaacatagtgagaccccatctctacaaaaaactaggccaggagcagtggctaacacccgtaatcccaactactctcaaggccaaggtgggaggattgtttgagcccaggagataagactgcagtgagctgtgattgcaccactgtactctagcctaggttaaaaaaaaaaattagctggacgtgatggcatgtgcttgtagtctcagctactcaggaagctgaggcaggaggatcatttacacccaggagtttgagggtaccgtgcagtaaagtatgattgagccactgcactccagtctgagtgacagcaagactgtctaaaaaaaataagaaggaatttgtggcatcagcagttcggagattgcagtgagccgagatcacgccactgcactccagcctgggcgacagagcaagactccgtctcaaaaaaaaa

SEQ ID NO: 27316 - DNA, 490 bp, Homo sapiens
gattgacatttcaagacaatggaagtaattagcaaggataacacaagtgtccctatgctgccagtttctcttctgacacaaaaataaataattgatttcattgaagtattagtcagtcaacaatgcttagtgtgatgatattgttaacagtgaaatatatatgttgtgcattgcttctagggtgaaacttaagtatctttgccctggctcccgcagtattttcatggcagtgaggatacatactcttggaaatgagccaggaacactctaatgtattacacatgtggcttaataccaggtgaacaggtattttaaatattctaatcacatacccacaatgtatatcgctactgggaaaaggatatcatttttaaccactggtgtttgttctgagccatacctttttcacactctgaagattttcaagacgaactgtgatttggggagggatggccatctcagtcaactttaactgataggaggtacaaca

SEQ ID NO: 27317 - DNA, 3541 bp, Homo sapiens
aagatcgtctcagtctgggcaagtaattgatctgtctgcagctggtctcaaactcctgacctcaagtgatccgccagcctcggcctcccaaagtgctgggattacaggcacgagccaccatgccggacctattagtgtatttactggatatcaagatgactaagaaatagcacttgccttgaaggagcttttctatttgaggaaaaagacatgtatataaataactgcaaacagaatgaaacaagtgttatgtagatctacatacagtgacatgccatgggaatgctgaacactgagcaacagtttcaactagcgaattggcacaggaaacatgaaaaataagcgtattttcaatatgacaagaatggtcatttctggatataagaacaagagaaaagtcatgggtatatggaaaggcatggactcttcaaggaagagcaagtagtctaatgtagatgctgtataggaatctggggacaaagggacagataagtggtgtagacaaagaggctggaaatagggttatgggctagatcatgagtgacctgtaagcattaggagttttgatttattttggaataagaaacatttatggcttttgagaaggaaaattacacaagggaaaagaaaggatttttattttttatttttatttttggagagatgagatctcactatgttgcccaggctggtcttgaactcctgaactcaagcaatcctcccggctcggcctctgaaacttctaggattataggcgtgagccactacgcccagccaggattatgtttttttatgggagggatgagaatattggtaggtgggtagaggataaatgagagagaatatgtatatgtgagattgaatatataatagaaaaaattgataggacaagtcctgcgttattactacattttatgaggaaaatctatatattagaagcactttaaaggtatatttgctattctagctgtggaaaccatctgaaaacacatttgaaagtgctttgaaacaggggtcaacttctctgcaaagggccagagtatgtttagctttgcgggccacagatggcctctgttgcatatgctgctgggtctccaccttcctcctccttttcttcccttcctcttccttctttttcttcttctctttcttctttctctttaaaagcataaaatcattctcagctcttgggccatacagaaacaggccataggccagatttgacttctaggccatagtttgccgaccctccattttagaacttagctttcctgaaagagcatttgggtctctctctctctttccctttctctctctctgtctctctctctctctctttcagtaagtgaagtaagaaataggtctttcttgaggaacaaaaagctgaaataatttcatgcatttgaatatgacccttgacctgtttttgtccatcatcactcagatttgtggctgcaaccaccaaccaatttggtgccataggatatagcataatttttcagcaacagttcataagcttttctttttgttctttttccttcttccagttgtggtggtttaaaaacatgtctgcaaaatctttgacacttctcagtaaaaaatatagtcttgtgttcccttttcttgaacctaagtggcctttgtgctgcctcaacaaatagaatatgacagaaaagacactatgtgacttttgagacagggtcataagaggtgatacagcttccccatgcccctgcattttagagctctgggttgccatgtaagaatagctaccctgaagctaccatgctgaagagaccacagggaaatcacatagagttagaaagaggtgtctgaagaagcccagctgctcccaatcccagctatttaagtcctcccagaccaggtgccatatatatgagtgagcaagccttcagatggttccagcaccagccaccatctagctgtaagctcatgagaccccttcaacgaaaaccatctagattagcttagtcaagccccagaaccgtgaaagacaatagacttgctatggaggtcgccacatgcctcttttttctccctttgtgaatgggattatttataatggttaccccatacctactccactatgtatattgggtatgagggagagataatttgtctcactagctgacagatttttcagacctcaaggaatgccacgtgagctgtactcacaggaccacacacaagtatctttatccacacgtgacctgatttcactgataaagtcctggaccttgagcctgagcccaatgtcttaataaatgagaatttcagaaggtcttgggagggggtgagtatattttgcatgtgggaaggatgtaaataatatgtggcctgagagcagattatggtggtttgaaaatgtgtccaccaattctttaatactactctcaacaagaggtggaatctgtgtctcttcctttggaacatgagtggacctttgtgattaaatgcagcagaaggatgctgtgtgaactctgagacagggtaataaggggtgatacagctgccacctagttctttctcagaacatgtgcctttggagccctgagctgccatggaagaaaaccacctaccctgaagccacaacactggaaagaccatgtggaagaaccacagagagagagaagaggaccaaatgtgtgagccttcccagcccaggctccaaatatgcaagtagtaagccttcatttctttttggttttaatttttttttttaaataaatcgaaatgggttctcactatgttgcccaggctggtcttgaactcctaagctcaagtaatcctcctacctcagtctcccaaagtgctggaattgtaggcatgagccaccatgcctggctgcaattagtaagtcttcagatgcttccatcaccagccaccatccgatgacaaccccatgaatgaccctcagcaagaactacctagctgaatccagccaaactccagacccatgagagagaaataaaattgttgtttgagtcactaaatacggagtaatttatattatcaacagataactggaaccacaagtgtaattgttaaaggtaaaactttgaatacatttatatttgccttctgccacattccataattgacttttgttcatgaacctattggcaagtttgccttattgcttttccttcttccctcttttttttttttgtaacttaaaaaatcatataataaaacaacacaaaaatgtatttgaatgtaggttgagtgaccgtaaataagcacaaaacttctccttcctgtgactctcttgtctgtatatgccaagtatctaacacaaggcctgcctggcacataatttttttttttaaatgttagtctcttttatcattctttttccctgtcagtggtattatctttacccatggaatccagcaccctcatgctgacttatagttccccaaagtccctaacctctacagtcctctccaacccccaccccaggcctctctctatgttccagacattttctggctttttaccattatccaaactctgaact

SEQ ID NO: 27318 - DNA, 2434 bp, Homo sapiens
aagatcgtctcagtctgggcaagtaattgatctgtctgcagctggtctcaaactcctgacctcaagtgatccgccagcctcggcctcccaaagtgctgggattacaggcacgagccaccatgccggacctattagtgtatttactggatatcaagatgactaagaaatagcacttgccttgaaggagcttttctatttgaggaaaaagacatgtatataaataactgcaaacagaatgaaacaagtgttatgtagatctacatacagtgacatgccatgggaatgctgaacactgagcaacagtttcaactagcgaattggcacaggaaacatgaaaaataagcgtattttcaatatgacaagaatggtcatttctggatataagaacaagagaaaagtcatgggtatatggaaaggcatggactcttcaaggaagagcaagtagtctaatgtagatgctgtataggaatctggggacaaagggacagataagtggtgtagacaaagaggctggaaatagggttatgggctagatcatgagtgacctgtaagcattaggagttttgatttattttggaataagaaacatttatggcttttgagaaggaaaattacacaagggaaaagaaaggatttttattttttatttttatttttggagagatgagatctcactatgttgcccaggctggtcttgaactcctgaactcaagcaatcctcccggctcggcctctgaaacttctaggattataggcgtgagccactacgcccagccaggattatgtttttttatgggagggatgagaatattggtaggtgggtagaggataaatgagagagaatatgtatatgtgagattgaatatataatagaaaaaattgataggacaagtcctgcgttattactacattttatgaggaaaatctatatattagaagcactttaaaggtatatttgctattctagctgtggaaaccatctgaaaacacatttgaaagtgctttgaaacaggggtcaacttctctgcaaagggccagagtatgtttagctttgcgggccacagatggcctctgttgcatatgctgctgggtctccaccttcctcctccttttcttcccttcctcttccttctttttcttcttctctttcttctttctctttaaaagcataaaatcattctcagctcttgggccatacagaaacaggccataggccagatttgacttctaggccatagtttgccgaccctccattttagaacttagctttcctgaaagagcatttgggtctctctctctctttccctttctctctctctgtctctctctctctctctttcagtaagtgaagtaagaaataggtctttcttgaggaacaaaaagctgaaataatttcatgcatttgaatatgacccttgacctgtttttgtccatcatcactcagatttgtggctgcaaccaccaaccaatttggtgccataggatatagcataatttttcagcaacaactggaaagaccatgtggaagaaccacagagagagagaagaggaccaaatgtgtgagccttcccagcccaggctccaaatatgcaagtagtaagccttcatttctttttggttttaatttttttttttaaataaatcgaaatgggttctcactatgttgcccaggctggtcttgaactcctaagctcaagtaatcctcctacctcagtctcccaaagtgctggaattgtaggcatgagccaccatgcctggctgcaattagtaagtcttcagatgcttccatcaccagccaccatccgatgacaaccccatgaatgaccctcagcaagaactacctagctgaatccagccaaactccagacccatgagagagaaataaaattgttgtttgagtcactaaatacggagtaatttatattatcaacagataactggaaccacaagtgtaattgttaaaggtaaaactttgaatacatttatatttgccttctgccacattccataattgacttttgttcatgaacctattggcaagtttgccttattgcttttccttcttccctcttttttttttttgtaacttaaaaaatcatataataaaacaacacaaaaatgtatttgaatgtaggttgagtgaccgtaaataagcacaaaacttctccttcctgtgactctcttgtctgtatatgccaagtatctaacacaaggcctgcctggcacataatttttttttttaaatgttagtctcttttatcattctttttccctgtcagtggtattatctttacccatggaatccagcaccctcatgctgacttatagttccccaaagtccctaacctctacagtcctctccaacccccaccccaggcctctctctatgttccagacattttctggctttttaccattatccaaactctgaact

SEQ ID NO: 27319 - DNA, 936 bp, Homo sapiens
gcggcggcggcggctggaggaggagagcggcggcggcgggagcagcgaagggggcggcagggatcctccaggctgccggctgggaaggcgtgggcgacccggtgtgtggcgcgcccagagccccgcgtttcagccctagggaaggaagccagttgagggaagttctccatgaatgtacgtcacaatgatgatgaccgaccaaatccctctggaactgccaccattgctgaacggagaggtagccatgatgccccacttggtgaatggagatgcagctcagcaggttattctcgttcaagttaatccaggtgagactttcacaataagagcagaggatggaacacttcagtgcattcaagatgaagtggtgaagagagcctgcgattgaagattttttcatctcagctttttcccccttaccttgttctctctcatgtttcatgatctgtgtcatagatatttcttcattacgagcacttcgcggtgtggcttttcaatgtctgaagtggattaagtggcccacagtcagttctgtgacttgagtttcaaaagtaaaattaccatcaacaatgtgattcaattttattttctatactagctaaaagcaaggaactatattattaacaatcttggctttactgtagtttaaggcaggtgatgatgatgcttattagtccacctgaaagagtccttccaggtttttggaagctttattcctgcttattaccttgcccttgagaagtccttcatggaaagtggaaacactgggttgacttcttttccccatatcctagttgaaagggacagcttatatgtatgttagactgtccaaaagtgtttgtagaacctcattttaaaaaatcaactgtattgtactttttaaaaaatgggatcttaaactctttattaaaaataataaatggaaatgtgttaagc

SEQ ID NO: 27320 - DNA, 1245 bp, Homo sapiens
tgtttctcagctgccttgttctcactctacgcttgaattcaaagtccctcttcaaagtcctatccccagaggaagtagcgtaccatgagggtgtaaaaagggagaggtggtggtggtggtaggtaggtttggctatttgtggagtatgatttattcatagtggggactctctctactgttgaggtatgtcaaagttagtgtatgatgatgattgaccaaggaacgcaggaaccatcagctttaatcccctgaggggagagcacaggactatcatagacactgtatgtgagccaggtgggtaactcataagttttgtctgtgaacaactttctctaatctcatgttactattttttttaggcaccaattgacaacggttcaaaaatcaccaactaccttttagagtgggatgaggtaagcttattttcatattcacccatctaaaacaccatttcaaaaacaaaattaactgaacaaatgccatcttattcttttataagacatgctaaacacagaaaaaaggaatgctagtagagaaatttaaatcaatagttattgactatggaaaatgaagttagattgaagtagtattatgagttgtgtattgaaatatatgtacctggcttatttgcaagcactactgctgaaagaaaaaaagtggggtcttatctattttggatctccagtgtctagccagccaataatttgtattaaaaattgactgctttgtcatcttgactgctcagatgattttgataaggtaaaacacactgccgcttggaaagcataatttgcttttcctttttgaatgccatgtatgtactttggtgttacactgttgagtggcctctgtgagagcagagcagtacatagaagtcacattctacccatgtgcgagtgccctgtgggttagaatgtcctgtatcggatgccccccttgctgttcatgtcaccagaggcccttggaaggtatctacggtggagtgtccttattctcaaagccactgtgtgccaactggtggacccagtgcatttctggcctagctaactctacacacagaatctcaggcaggaaacacttgacctagaagcctttcatttctaaaaagcaactgtaggtcgggcgcgatgactcacgcctgtaatcccagcactttgggagccaaggcaggtggatcacgaggtcaggagatcaagaccatcctggctaacacgatgaaacaccgtctctactaaaaatacaaaa

SEQ ID NO: 27321 - DNA, 1453 bp, Homo sapiens
tttctctccagtctgtgacctcttattactgtttcttttgcctttttatccagctcttaactcttagcctttttccagataaagtcaaccagagagtagctcatggggttttagaacatatatttggagatcgttctggggttaaggtttattttcttacttagaataatctcttctagtcagtagatcctgcctatcttgaaatggagctgggtggcacacactgagacaaatacctgttgggatgactgtcccctgttaatgctaaccataggtcaggacaagaccaacagataagagcaagagcatgatactcactccgtaagaaattctgttcatctacagaaagccttagggtgaaacaaagataagaatcctggtcttctatgatgagtcactgccactgactgtgtctgttttgttttcagggtgtatgccatgtacaattccgtaaagggatcctgctccgagcctgttagcttcaccacccacagctgtgcacccgagtgtcctttcccccctaagctggcacataggagcaaaagttcactaaccctgcagtggaaggcaccaattgacaacggttcaaaaatcaccaactaccttttagagtgggatgaggtaagcttattttcatattcacccatctaaaacaccatttcaaaaacaaaattaactgaacaaatgccatcttattcttttataagacatgctaaacacagaaaaaaggaatgctagtagagaaatttaaatcaatagttattgactatggaaaatgaagttagattgaagtagtattatgagttgtgtattgaaatatatgtacctggcttatttgcaagcactactgctgaaagaaaaaaagtggggtcttatctattttggatctccagtgtctagccagccaataatttgtattaaaaattgactgctttgtcatcttgactgctcagatgattttgataaggtaaaacacactgccgcttggaaagcataatttgcttttcctttttgaatgccatgtatgtactttggtgttacactgttgagtggcctctgtgagagcagagcagtacatagaagtcacattctacccatgtgcgagtgccctgtgggttagaatgtcctgtatcggatgccccccttgctgttcatgtcaccagaggcccttggaaggtatctacggtggagtgtccttattctcaaagccactgtgtgccaactggtggacccagtgcatttctggcctagctaactctacacacagaatctcaggcaggaaacacttgacctagaagcctttcatttctaaaaagcaactgtaggtcgggcgcgatgactcacgcctgtaatcccagcactttgggagccaaggcaggtggatcacgaggtcaggagatcaagaccatcctggctaacacgatgaaacaccgtctctactaaaaatacaaaa

SEQ ID NO: 27322 - DNA, 681 bp, Homo sapiens
agcggagacactggaatgtgaatgctttgggaggtgagcccttaaggagagcccaaatgtttaccaaagagaaaatctggtcagcaggttattctcgttcaagttaatccaggtgagactttcacaataagagcagaggatggaacacttcagtgcattcaaggacctgctgaagttcccatgatgtcacccaatggatccattcctcccattcatgtgcctccaggttatatctcacaggtgattgaagatagtactggagtccgccgggtggtggtcacaccccagtctcctgagtgttatcccccaagctacccctcagccatgtctccaacccatcatctccctccctatctgactcaccatccacattttattcataactcacacacggcttactacccacctgttaccggacctggagatatgccgcctcagttttttccccagcatcatcttccccacacaatatatggtgagcaaaaattataccattttatggaatgtcaagctacatcacccgagaagaccagtacagcaagcctccgcacaaaaaactgaaagaccgccagatcgatcgccagaaccgactcaacagacctccttcttctatctacaaaagcagctgcacaacagtatacaatggctatgggaagggccatagtggtggaagtggcggaa

SEQ ID NO: 27323 - DNA, 504 bp, Homo sapiens
gcggccgcggccggacttggcgagccggcggctggaagctcgggcgggggagcggggcgcggcgggaaggagcgggcgacccggtgtgtgggccagcggagctccggtcagtcggtcaccccgaggggcgcctcggccggggatagggcgggcgggcggaatctgcgccccgaggcggccaggaggggccgcgcggaccgtctggtgcccgcggctgggctggggccggcaggcgtgggaagggcctgtcactctcggcagaaagtggggcctcgggctgtgcccgcgaactttcccagaggtccgggtcccggcgtcccgtgggaaccggaggacccgggcccgccgtctcgggagactgggctgcgccgcccggcggcgcctttggcggggaggcttccaggagtgcgcggtcggagttggagcttttggaatctcagctcccaccctgccatcccagacgaagggaagcaatggcattttatccagacagtgccgtttgca

SEQ ID NO: 27324 - DNA, 1992 bp, Homo sapiens
  misc_feature (21)..(21): n is a, c, g, or t
aaatacggaacccagtgagtnccagccgcagtgacccagtcaccctgaatctcctcccgaagctgcccaagccctacatcacccgagaagaccagtacagcaagcctccgcacaaaaaactgaaagaccgccagatcgatcgccagaaccgcctcaacagccctccttcttctatctacaaaagcagctgcacaacagtatacaatggctatgggaagggccatagtggtggaagtggcggaggcggcagcggtagtggtcccggaattaagaaaacagagcgacgagcaagaagcagcccaaagtcgaatgattcagacttgcaagaatatgagttggaagtaaagagggtgcaagacattctttcgggaatagagaaaccacaggtttctaatattcaggcaagagcagttgtgttgtcctgggctccccctgttggactttcctgtggaccccacagtggtctttccttcccctacagttacgaggtggccttatcagacaaaggacgagatggaaaatacaagataatttactacagtggagaagaattagaatgtaacctgaaagatcttagaccagcaacagattatcatgtgagggtgtatgccatgtacaattccgtaaagggatcctgctccgagcctgttagcttcaccacccacagctgtgcacccgagtgtcctttcccccctaagctggcacataggagcaaaagttcactaaccctgcagtggaaggcaccaattgacaacggttcaaaaatcaccaactaccttttagagtgggatgagggaaaaagaaatagtggtttcagacagtgcttcttcgggagccagaagcactgcaagttgacaaagctttgtccggcaatggggtacacattcaggctggccgctcgaaacgacattggtaccaggtatgacgtttccttgtcctcttgcccttcagcctttggatggtgatcctgagccttcttttacatagctggaaggcatgaggaagcctgctgcctccacactaaatcaactggaggttttccaagagggaatcctaatcagaggagagaaggcctcctttaagctggtgaatgtcactatggcctctgcagtcttgcaagctgtattgcgaaggccccactaggggtctctaagaaccaaggtgaaggtagcagtacagatcttgaaaggaattcctcttggagctttaattttttagatcacatgcctttttcttttatcactttagcaagctcttcattcacttgccttttttcaattatgtgagtgtttcctggtacaaagaaagagatgctgggccagccattgttgtcaagcccagggcagatacggaattggagaaaacctggactgtcttagaggcctctgcaggcctctaggctgtatgagaaaggcgagaacgggtgtactgtaaggtatcaattgattaaagaggctttgaaaaggccatgtttcagttgcacttggggggtaactcttcattaagggaaaaatctttttctttcatcactgcttgttgaaatcttcttaaaggttttgcacatcggtggtccccaaccctctttccaacctaaagaacctctttttaacatcacaaagttttacagacctgcctccaccaccatggtagccattacagcttcagagttcactggttgaaaaaataccgacacaaagccctttatggctcaagaatttttaaatgaattggaagcatccacaaacttttgaaaaacagcactgtatatattgtaaaacattatttcatcaacaaatatttgttgctcacattgatttgaaggctccttgacccgtaacttgataaacattgccttgtgctataccttctttccagtgcttttgaggggggaaaatgaattcttaagtacaattgtcctttggtttccacaggggattggtttcaggacttcccccacctccctgccatgaataccaaaatctatggatgccc

SEQ ID NO: 27325 - DNA, 1089 bp, Homo sapiens
  misc_feature (780)..(780): n is a, c, g, or t
  misc_feature (803)..(803): n is a, c, g, or t
  misc_feature (830)..(830): n is a, c, g, or t
  misc_feature (1002)..(1002): n is a, c, g, or t
gcggctgtatctagagtatccccttctgcgcacacgcacttgtggactttcctgtggaccccacagtggtctttccttcccctacagttacgaggtggccttatcagacaaaggacgagatggaaaatacaagataatttactacagtggagaagaattagaatgtaacctgaaagatcttagaccagcaacagattatcatgtgagggtgtatgccatgtacaattccgtaaagggatcctgctccgagcctgttagcttcaccacccacagctgtgcacccgagtgtcctttcccccctaagctggcacataggagcaaaagttcactaaccctgcagtggaaggcaccaattgacaacggttcaaaaatcaccaactaccttttagagtgggatgagggaaaaagaaatagtggtttcagacagtgcttcttcgggagccagaagcactgcaagttgacaaagctttgtccggcaatggggtacacattcaggctggccgctcgaaacgacattggtaccagtggttatagccaagaggtggtgtgctacacattaggaaatatccctcagatgccttctgcaccaaggctggttcgagctggcatcacatgggtcacgttgcagtggagtaagccagaaggctgttcacccgaggaagtgatcacctacaccttggaaattcaggaggatgaaaatgataaccttttccacccaaaatacactggagaggatttaacctgtactgtgaaaaatctcaaaagaagcacacagtatanattcaggctgactgcttctaatncggaaggaaaaagctgtccaagcgaanttcttgtttgtacgacgagtcctgacaggcctggacctcctaccagaccgcttgtcaaaggcccagttacatctcatggctttagtgtcaaatgggatccccctaaggacaatggtggttcagaaatcctcaagtacttgctagagattactgatggaaattctgaagcgantcatgggaagtggcctacagtgggtcggctaccgaatacaccttcacccacttgaaaccaggcactttgtacaactccgagcatgct

SEQ ID NO: 27326 - DNA, 898 bp, Homo sapiens
gcggccgcggccggacttggcgagccggcggctggaagctcgggcgggggagcggggcgcggcgggaaggagcgggcgacccggtgtgtgggccagcggagctccggaagccagttgagggaagttctccatgaatgtacgtcacaatgatgatgaccgaccaaatccctctggaactgccaccattgctgaacggagaggtagccatgatgccccacttggtgaatggagatgcagctcagcaggttattctcgttcaagttaatccaggtgagactttcacaataagagcagaggatggaacacttcagtgcattcaagatgaagtggtgaagagagcctgcgattgaagattttttcatctcagctttttcccccttaccttgttctctctcatgtttcatgatctgtgtcatagatatttcttcattacgagcacttcgcggtgtggcttttcaatgtctgaagtggattaagtggcccacagtcagttctgtgacttgagtttcaaaagtaaaattaccatcaacaatgtgattcaattttattttctatactagctaaaagcaaggaactatattattaacaatcttggctttactgtagtttaaggcaggtgatgatgatgcttattagtccacctgaaagagtccttccaggtttttggaagctttattcctgcttattaccttgcccttgagaagtccttcatggaaagtggaaacactgggttgacttcttttccccatatcctagttgaaagggacagcttatatgtatgttagactgtccaaaagtgtttgtagaacctcattttaaaaaatcaactgtattgtactttttaaaaaatgggatcttaaactctttattaaaaataataaatggaaatgtgttaagc

SEQ ID NO: 27327 - DNA, 768 bp, Homo sapiens
  misc_feature (21)..(21): n is a, c, g, or t
aaatacggaacccagtgagtnccagccgcagtgacccagtcaccctgaatctcctcccgaagctgcccaagccctacatcacccgagaagaccagtacagcaagcctccgcacaaaaaactgaaagaccgccagatcgatcgccagaaccgcctcaacagccctccttcttctatctacaaaagcagctgcacaacagtatacaatggctatgggaagggccatagtggtggaagtggcggaggcggcagcggtagtggtcccggaattaagaaaacagagcgacgagcaagaagcagcccaaagtcgaatgattcagacttgcaaggtgattgaagatagtactggagtccgccgggtggtggtcacaccccagtctcctgagtgttatcccccaagctacccctcagccatgtctccaacccatcatctccctccctatctgactcaccatccacattttattcataactcacacacggcttactacccacctgttaccggacctggagatatgccgcctcagttttttccccagcatcatcttccccacacaatatatggtgagcaaaaattataccattttatggaatgtcaagctacatcacccgagaagaccagtacagcaagcctccgcacaaaaaactgaaagaccgccagatcgatcgccagaaccgactcaacagacctccttcttctatctacaaaagcagctgcacaacagtatacaatggctatgggaagggccatagtggtggaagtggcggaa

SEQ ID NO: 27328 - DNA, 145 bp, Homo sapiens
tccattcctcccattcatgtgcctccaggttatatctcacaggtaatccatttgatggacttctctactcactatggacactgtcgttgctccaacagaatatatgttgaggcttcaaagccatattccaggagttaatttgggt

SEQ ID NO: 27329 - DNA, 1483 bp, Homo sapiens
  misc_feature (21)..(21): n is a, c, g, or t
  misc_feature (1174)..(1174): n is a, c, g, or t
  misc_feature (1197)..(1197): n is a, c, g, or t
  misc_feature (1224)..(1224): n is a, c, g, or t
  misc_feature (1396)..(1396): n is a, c, g, or t
aaatacggaacccagtgagtnccagccgcagtgacccagtcaccctgaatctcctcccgaagctgcccaagccctacatcacccgagaagaccagtacagcaagcctccgcacaaaaaactgaaagaccgccagatcgatcgccagaaccgcctcaacagccctccttcttctatctacaaaagcagctgcacaacagtatacaatggctatgggaagggccatagtggtggaagtggcggaggcggcagcggtagtggtcccggaattaagaaaacagagcgacgagcaagaagcagcccaaagtcgaatgattcagacttgcaagaatatgagttggaagtaaagagggtgcaagacattctttcgggaatagagaaaccacaggtttctaatattcaggcaagagcagttgtgttgtcctgggctccccctgttggactttcctgtggaccccacagtggtctttccttcccctacagttacgaggtggccttatcagacaaaggacgagatggaaaatacaagataatttactacagtggagaagaattagaatgtaacctgaaagatcttagaccagcaacagattatcatgtgagggtgtatgccatgtacaattccgtaaagggatcctgctccgagcctgttagcttcaccacccacagctgtgcacccgagtgtcctttcccccctaagctggcacataggagcaaaagttcactaaccctgcagtggaaggcaccaattgacaacggttcaaaaatcaccaactaccttttagagtgggatgagggaaaaagaaatagtggtttcagacagtgcttcttcgggagccagaagcactgcaagttgacaaagctttgtccggcaatggggtacacattcaggctggccgctcgaaacgacattggtaccagtggttatagccaagaggtggtgtgctacacattaggaaatatccctcagatgccttctgcaccaaggctggttcgagctggcatcacatgggtcacgttgcagtggagtaagccagaaggctgttcacccgaggaagtgatcacctacaccttggaaattcaggaggatgaaaatgataaccttttccacccaaaatacactggagaggatttaacctgtactgtgaaaaatctcaaaagaagcacacagtatanattcaggctgactgcttctaatncggaaggaaaaagctgtccaagcgaanttcttgtttgtacgacgagtcctgacaggcctggacctcctaccagaccgcttgtcaaaggcccagttacatctcatggctttagtgtcaaatgggatccccctaaggacaatggtggttcagaaatcctcaagtacttgctagagattactgatggaaattctgaagcgantcatgggaagtggcctacagtgggtcggctaccgaatacaccttcacccacttgaaaccaggcactttgtacaactccgagcatgct

SEQ ID NO: 27330 - DNA, 1626 bp, Homo sapiens
  misc_feature (21)..(21): n is a, c, g, or t
aaatacggaacccagtgagtnccagccgcagtgacccagtcaccctgaatctcctcccgaagctgcccaagccctacatcacccgagaagaccagtacagcaagcctccgcacaaaaaactgaaagaccgccagatcgatcgccagaaccgcctcaacagccctccttcttctatctacaaaagcagctgcacaacagtatacaatggctatgggaagggccatagtggtggaagtggcggaggcggcagcggtagtggtcccggaattaagaaaacagagcgacgagcaagaagcagcccaaagtcgaatgattcagacttgcaagaatatgagttggaagtaaagagggtgcaagacattctttcgggaatagagaaaccacaggtttctaatattcaggcaagagcagttgtgttgtcctgggctccccctgttggactttcctgtggaccccacagtggtctttccttcccctacagttacgaggtggccttatcagacaaaggacgagatggaaaatacaagataatttactacagtggagaagaattagaatgtaacctgaaagatcttagaccagcaacagattatcatgtgagggtgtatgccatgtacaattccgtaaagggatcctgctccgagcctgttagcttcaccacccacagctgtgcacccgagtgtcctttcccccctaagctggcacataggagcaaaagttcactaaccctgcagtggaaggcaccaattgacaacggttcaaaaatcaccaactaccttttagagtgggatgaggtaagcttattttcatattcacccatctaaaacaccatttcaaaaacaaaattaactgaacaaatgccatcttattcttttataagacatgctaaacacagaaaaaaggaatgctagtagagaaatttaaatcaatagttattgactatggaaaatgaagttagattgaagtagtattatgagttgtgtattgaaatatatgtacctggcttatttgcaagcactactgctgaaagaaaaaaagtggggtcttatctattttggatctccagtgtctagccagccaataatttgtattaaaaattgactgctttgtcatcttgactgctcagatgattttgataaggtaaaacacactgccgcttggaaagcataatttgcttttcctttttgaatgccatgtatgtactttggtgttacactgttgagtggcctctgtgagagcagagcagtacatagaagtcacattctacccatgtgcgagtgccctgtgggttagaatgtcctgtatcggatgccccccttgctgttcatgtcaccagaggcccttggaaggtatctacggtggagtgtccttattctcaaagccactgtgtgccaactggtggacccagtgcatttctggcctagctaactctacacacagaatctcaggcaggaaacacttgacctagaagcctttcatttctaaaaagcaactgtaggtcgggcgcgatgactcacgcctgtaatcccagcactttgggagccaaggcaggtggatcacgaggtcaggagatcaagaccatcctggctaacacgatgaaacaccgtctctactaaaaatacaaaa

SEQ ID NO: 27331 - DNA, 771 bp, Homo sapiens
  misc_feature (43)..(43): n is a, c, g, or t
  misc_feature (56)..(56): n is a, c, g, or t
agcggagtgtctagcagcaaactcctaaggctggatggtggangccagttgagggnttctccatgaatgtacgtcacaatgatgatgaccgaccaaatccctctggaactgccaccattgctgaacggagaggtagccatgatgccccacttggtgaatggagatgcagctcagcaggttattctcgttcaagttaatccaggtgagactttcacaataagagcagaggatggaacacttcagtgcattcaaggacctgctgaagttcccatgatgtcacccaatggatccattcctcccattcatgtgcctccaggttatatctcacaggtgattgaagatagtactggagtccgccgggtggtggtcacaccccagtctcctgagtgttatcccccaagctacccctcagccatgtctccaacccatcatctccctccctatctgactcaccatccacattttattcataactcacacacggcttactacccacctgttaccggacctggagatatgccgcctcagttttttccccagcatcatcttccccacacaatatatggtgagcaaaaattataccattttatggaatgtcaagctacatcacccgagaagaccagtacagcaagcctccgcacaaaaaactgaaagaccgccagatcgatcgccagaaccgactcaacagacctccttcttctatctacaaaagcagctgcacaacagtatacaatggctatgggaagggccatagtggtggaagtggcggaa

SEQ ID NO: 27332 - DNA, 513 bp, Homo sapiens
taaaaaaattaactctttaaccatcagtccctttccactcaaatcctaaagcaatgcagtttcatattttctgcttgtacaaggttaggatccatcactgactcaaacatgatcatttagacgaccatttagaaggcccaagagcaatgtaactggcatttctgggtcacagctaattgaatggaatgtgtgcctgtgaccgatcgtacaggtagcactttggcaaagaggtgtttgtgaaagtgcataagtatcgtttgtgtgttctgactattgtttgtatactactaaatgctctgaaaagtgttataatttgtacatagtatgaatgatttggtggagggaaactcccttgtgaattttgtataaagagtatactgcattcctgttgtcaccagaaaagtactgatatggcacattctgttaacagtaattggatatgtatgccttgttagaagagaagagggtaatttcccacttattataaataaaattattcttatttcatgtctt

SEQ ID NO: 27333 - DNA, 451 bp, Homo sapiens
tcctgacctcatgatctgcccacctcagcctcccaaagtgctgggattacaggcatgaaccactgtgcctgactgaaactcatactttttggctagcaccttcaccctctccatcccatttccccagccctagacaaccactgatctatagagagctgagttttgaagggttaacaaatgcctataggtgaaagcagtttggatgtgttggcttgaagatagagatggatgaccaaatgtgatcttgttgaggaatgtggaaaaatgaaggtggtgaggctgacagaccgaaggtgatttatgccaaagagtttgaatttcaatgaatcactcagtcatcaaacaggtattgagatcctatatgcagagcgcttcctaggcaaagtgaagtcaattcaatgaggagctgtcgtagattctggagcttgggagagacactctcaaagtgttg

SEQ ID NO: 27334 - DNA, 571 bp, Homo sapiens
gtttaaataaaccatttcccctctaaatatttggaactgagagatattacctcagattctgactcttactaagtcatcattctctttttaactgccagaggttacagtcttatcaccctgtcaaaacaattagactattcaatggaatattgtctttggtagaatttaaaacaatgtgtctttaataaaactgaaagtgaaaaatcttcttggctaattctgtggtgtactttaggaggcataatagtggagaaaatttggtctcttgaaatttgagcacatcccactgtattatttcactgtatggcaaaagtgaaggaggtaggcatgctctgtcatccttaattaagctttgggctgcttattgaagtatcattttttctatagattggaacatggtttatatagcagactatcttgtccactgacattgcccagtactgagttcctaatctaatttcattttctctgaaatctgccttcctagttctgactaagctaaataactcagggagatttatattctatttcagatggtccactcttgggactatgccgactgtatctcatg

SEQ ID NO: 27335 - DNA, 740 bp, Homo sapiens
agtccatggccaaatgcagattcgtagtttataatgatgagggaggcaaagtgaagagtcatctgaattgcccagatcaataatctccatgtctgatatggtgattgagaaatctacttcctggagctccgagtgctatccctgggctgctctcatcaacccattcagcagtgtggctgccaacagtttcttcctggagccagctatacagagctgaaggactggattccagagggaagtcaagcatttttccagtggccagagaggaaacctaatgtatatgagagtgctttgtaaatggtaaaaagccccagataaatgtgtgctctcatcatccctggagctgatgtcttagaggcttccccattaggtgacatcagcagtgctaagtgtactagctatatttggatgttttattctagtttttgttgttgttgttgttagtttgtttacaaaagggtatatattaaccaggcatgggttccagttgcaagttttcatgcttttaaagtaatatttattaagatatataaacttctttctacgtggtaatcattttttggagggagttcagatcattgattttcatactgaaacatttaaagggatttaaatcagtgtctttgtttaaagcatcctgattattagcatcgtgagaaacttttatttttctaataagttgctaacaataaaatcctcggcggtgtcattaatagaaatgaaatgactgcctaaagtca

SEQ ID NO: 27336 - DNA, 2711 bp, Homo sapiens
  misc_feature (920)..(920): n is a, c, g, or t
  misc_feature (980)..(980): n is a, c, g, or t
tccctttttaaaataaccatttaaaaattttctaccctgaattgcattttgaaagggatggttcctaggtaacacaaggtagaaaatttacatctcaaaggcagagaacttacatttcaggcctaaatattgttatttgccaagacagaaagttgatgctaagaagcccagttcagacaaaatggttgaaggtgagtttatttggactaatgctctcacctattgtaagaatttctactgattttcctttatagatacacgtttttacaaagagtttcaaaataactggctaaataccagaaacgcaaattttggagactgatttaattcaataggcggtcttttcaacttagcttctgtttcttaactagattactgagttcagggcagagcccattagcaaatagagcagacaaagggtttcctatttctggatgcagatggatagttctgaaaatgcaaatctgcttcacccaagggcctaatttttataaatattacctagctttctttttccctttggagtaaaacagtaactaagtgaaaagattggcagattcaattttcttataaactagttgcttaaacttttcatttgccttctacatgagctcttttaaagagacaaacatttttgaaatctttttagaagcttttgcacatcaataggtatccctaggagggcctgattcagaagccctcatttttaaactcaattcttagatgaacagtcttattcatctggaatgttccacataatggtcatcataattctaatttatctttagtaagatttcaccatttttgtaagtatttgcagcttctaggccctaacacatgtaaaaggtaaacatagccagaaggtgaaatacacagttctttaaaaatttaaggatgctggccaggcgaggtggctcacncctgtaatcccagcactttgggaggctgaggtcggaggccaggagtttgagaccagcctngccaacatggtgaaaccccgtctctactaaaaatacaaaaattagatgggtgtggcagtgtggcctttaatccagctacccaggaggctgaggtgcgagaattgtttgagcccaggaggtggaggttgcattgagctgagactgcgccactgcactccagcctggacaacagagtgagatgctgtcttaaaaataaaaaaaagaattaaggatgccatttttaagttgaatcttgagtctctcagagtcaagataaaagtctgagtgaaacgccatgaggttgggtcactgtgtttgctatctatctacctatctatctatctatctatctatcatcatctatcttatcatcatctatctttatctatctatctatctatctatctatctatctatctatctatttttgtccaggtttcctggcttgtaattcccatagcccttgttacaagcttttgttacaatgttgggtgttaggccttgcaggcaggcctcaggaaacagaatctctctgaccttctcttgccttcctttcacttccgcaaggcagaactgtgggtcatataaacccttattccagagagggtcctgctccatatgctgggggaaagaatgccaacttaatgaagcatccataaaaacccaagaggactgggttccaagagcttctggatagctgaacacatggagggtcctggagggtgacacaccccgggaggactggagagctctgtgccccttccccaatactgtgccctatgcatctcttcatatgttatcctttatgattttctttgcaataaactggtaaacgtgtttccctgagttctgtgagctgcaccagcaaattaatcaaaccccaagtggaggttgtgggaaccccaacttgaagccagttggtcagaatttccagacacccagagttacaactggtgtctgggaggtggggcagttttggggactgagcccctcgacctgtggcatctaacactatccacctggagacagtagatagtgggcaacatggtgagacccactatctccaagtagatagtgtcagaataaaactggaggacacctacttggtgtccactgcttagcgtgtgggaaaaactctcacacatttggtcacagaagtcttcttatgtgttgatgattgttgttatgttagtatgagagcagaggaaaaatggtttagagttttttcccaaaacagtcatgtaatgctatcatagtatacctcagtgcatagatgttttattttttctgccactcattctagagtgcagtggcatgctcatagctcactgcagccttgaattcctgggctcaaggtcttagctttccaagtctcagctttcctgggctcctgcctcagctttccaagtagctgggattacaggcacataccaccatgcctggctttgtttgttttttgtgtggacagggtctcgctttgttgcccaggctggtctcaaactcctggcttcacgcaatcctcccacctcagcctcccaaagtgctgggattataggtgtgagccaccatgcccagcctaaataattttttaaattccagtttttaattattctttgttaggatacagaaatgctttgtgtcctgcaatactgttaaatctccttattagttttagcagctttttttgtaaatcccttaggattttctatgtatgtgattgttatctgcaaataaaggcagttttatttcttc

SEQ ID NO: 27337 - DNA, 725 bp, Homo sapiens
ctattgactccctaccatgattggaaatctcagttttgttttgtttctaattttttttaattccaagcagggcctaggacagtgtgtgtcatagagcaggtgtttaggaatgattgtctggctcattacttgagacaaacactctcacactctgttggaataaagaatcccacagtcctggcgcttgttttgctgctgtgcatgcaggagaggcacgggccactggtcgtcttctgggctggcaaagccatctgacttcataggaatatagaggtagcaattacaactttattccctggcaacaaattatcaggatgactgttaagaagggcctgctcttcgaagttaaagtttactttcacaggacataatctctaaagcgcagttatctttatataaataacatgcccaaaggcagtgcctggtttaataacaaaataaaactgttttcccataagtctccacactgaataagtgagtaaaacagatacttttgaggttcccactttattatgctgacaaaggagcacttctctgcagcacagagatagaacatttttcccttgtcctgagaggcggcccaaaggctagagcagatgtgactcttctgaggcagtgcaccagaacccgagggatgggcagggcctgaaagctgcccgctctgaccgggtgcctctggctaggaattgtccatctccgagtctaggagtgcccccactaatccc

SEQ ID NO: 27338 - DNA, 273 bp, Homo sapiens
cgccttccatcctgacaaggagaatgcgaggcatgaggttggggtagctgtgggtagctgtgtcctctccccctctgccctcggtctctccccttttcacccttcaccttccccatctctgcccttcagtctccctctcctcggtccctctgtcccctcctccccctcagccctctgtcctcccggcacgagctgatagtggagaggcctgtccccccaccccccagtctctaggcaaagcttgtcccagcatcagggaggaggcggtggcag

SEQ ID NO: 27339 - DNA, 540 bp, Homo sapiens
aaatccctgcacctgtagagcctgcaccccctccaggacgggtgagtcccttggccacagccaggcctgacaccccgaatgcgctactccctgaccttccattaataccagcttttcgctagcttctggtcttatgcttcacctgaaccatgcagcaggtccctgtcctcatcaaactttgatgccgaacaaagcaaatgtccggcaggccacagtgcagcctcctccccctcaggaccccaggcccaccctgcacaccctcatgtggtccctccaggctcctgggcggggtggggggacagggatttctccgcaacataccacccctgcagtgggattcccagcgttaaggggagaaggtgtcactggcacgtggtgtgcacaattctgaatcctccagcctctccagcatttgccttcattcccacagaggccgagaggctcatggcttccagaaggctatgagatgtggcacaggcacccgacaggtaggactggctggaagcctcgggcctgggcaggagcggctggagcctgcct

SEQ ID NO: 27340 - DNA, 268 bp, Homo sapiens
ataatgaatggcactattaggccatattcaaggcctttttgataccatttagagtgacttgagttgaataataaaatgctggttaagccattattaaaactggtgtgctattttcaccctttaaataaagacacattgtgtacaaaaatttggaggattttgactaactacattaaatctatttaaagagtttccctagggcgtaaaattctaacactctttcagtgagttactagcaagctaaaaccattcctttagacattgtact

SEQ ID NO: 27341 - DNA, 428 bp, Homo sapiens
ggtgactgctggcaatgctaggtggggcttggaagcccagtgctgtccaagtgcacacagactctacaagaggccaaggaggacactggtatccctgcgccatggcagctgcaccccagggggtgagccatgggccagagggcacccaaatactcaccggggggtccagcactattagctgaaaatcaagcaaaggaaaaaatgttgagcattttgattatccaaaagggagttggacaattcatttatgaaccaaagaccaaaacctaacagagctagattcaaagaaaacccactgtggattaattttaattttaagtagttagatgaaataattgcaaaataaaatattaccaaatctaatctaaaagcatgtaacaaggaattgtcccacgatcaagtaaggttgtttggggaatgcaaggatc

SEQ ID NO: 27342 - DNA, 1228 bp, Homo sapiens
tgtaagacattcccagaaagtcagactcactcatattcaggtgtaagaaaatatattccaataccaaatatcaactttttgtgtaactttcacttgtctacccttccattattttgaatagtttagaatagaatgtatttcttttctattttagaactacttggaaattattaaactcatagttcaataaaatagtgttttgggctttttttctcttgactgtgtaaagtaaaatgaagaaaaagattgtccttagaagaatccctctctgttatttttgataattatatttctcccagggatagcatatttgaaaattcataactgttgggtcagccacagtggctcacacctgtaatcccagcactttgggaggccgaggcgggcagaccatctgaggtcaggagttagagaccagcctggccaacatggtgaaaccctgtctctactaaaaatacaaaaattagctgggcgtggtggcaggcacctgtaatcccagctactcgggaggctgaggcaagagaatcacttgaacctgggagacggaggttgcagtgagctgagattgtaccattgcactccagcctgggggacaagagtgagacttcgtctcaaaaaaaaaaaaaaaattcatattgttggccataccagtgtgatttacttttatatgataagtcttcttaagaatcagtcaccattttaatttttgatacttattttctcaatgccagagagttgaaagataaccttggcagtgatgacccagaaggtgacataccagtcttgttgcaggccgtcctggcaaggagtcctaatgttttcagggagaaaagcatgcagaacagatatgtacaaagtggtgagtttcttaataactgaattcccatatcaaacttgttttatacatatttaaatccaggtgtcttctttaacaagctggcctatcaggaatgcgatgtttatgccttcagtcaagccaagaacaagaaggaaactaaactgataagattcttgtagtttaatatgtaactaaattccttgagaattagacaaagctttaagtgtattttgttaaatatgttggaatatatcagtttactcagcttaaaaatttttttgttttggaaaatcagaattaatttgaaataagtctttcattttttaatactgattgtgattatattcatggttttctagtaattgatttaatactcctgttgccttagca

SEQ ID NO: 27343 - DNA, 429 bp, Homo sapiens
aattcaggatgaatggtgatatgccccatgtccccattactactcttgcggggattgctagtctcacagacctcctgaaccagctgcctcttccatctcctttacctgctacaactacaaagagccttctctttaatgcacgaacggcagaagaggtgaactgccttttggcttgtagggatgacaatttggtttcacagcttgtccatagcctcaaccaggtatcaacagatcacatagagttgaaagataaccttggcagtgatgacccagaaggtgacataccagtcttgttgcaggccgtcctggcaaggagtcctaatgttttcagggagaaaagcatgcagaacagatatgtacaaagtggaatgatgatgtctcagtataaactttctcagaattccatgcacagtagtcctgcatcttcca

SEQ ID NO: 27344 - DNA, 808 bp, Homo sapiens
gcaatccagagaccaaaaggagcccattgcgatctggctctgggggaccctgggatgatatccctacccccagggacaggacccaacccccggggacctggagagactctgtgccctgcaggaccgatgggggactcctccctgtatgtacgtgtgcgtggccctgccttgttcttgccccggacctggcctggtgaaggaggcacgaggaagattgcagtcagggacgctcagcctgggagctgaccctcaggtgaggccctaaggaagttcccagacctccctgaacctcagtatgctcatctgtccagcagcaaccctgggccttaagtgagaacatctatgcggaagaggcaggtgccaatcaagccctctgtaaagttacctccccttttcccttcttctcctctcacagagctgaagaatattttgcaaagttcattgtaaacattaaaataatcttgggtgtttatcattcgttaaacctgttgggctgactttaggtctaccgctctcaaaaaaccaagaataaatggcacagggagctgaaaaaaagacaccgagctcgatcaaagaagaaacgaaaaaatctccaggaggatttctatatcgggccgtggccgggcgcaaacagaggggtgtgattaaagaggcggaccatgtggtggaaaagacagttgtttcgtccaagcccaaggattttctagggacccgaaggggtgggaagatttcagggcggactcccactatagtagagcgcgtagtataaacttcgaaaaaagcagacagttgaactcgcggcatctag

SEQ ID NO: 27345 - DNA, 640 bp, Homo sapiens
gcaatccagagaccaaaaggagcccattgcgatctggctctgggggaccctgggatgatatccctacccccagggacaggacccaacccccggggacctggagagactctgtgccctgcaggaccgatgggggactcctccctgtatgtacgtgtgcgtggccctgccttgttcttgccccggacctggcctggtgaaggaggcacgaggaagattgcagtcagggacgctcagcctgggagctgaccctcagatccagggatcccagcagccttagaaagctgatgatgccaggagcggggacttgcctggggctcaagggaaccattatgcctgtgctgagatgaaacgtgtcccactattcctggatgtgtacagaacccgacaccatggctatgagtacctaccacgaagaaacagtaacaataactggactgtcaatactggatgtcttgggagcttaagagacactgttctgagtattttacatgtatttgtcagtggctgttcccatgcaggaggccctgggacatgcctgctactgtttctttctgctggtctgaatattttacatgtattatctaatttaatcctcacaacaactatcatacttatggtaattatattatacccattatgc

SEQ ID NO: 27346 - DNA, 364 bp, Homo sapiens
gagggtaggcatttttgtctccaggtattgggtaggtaaccctaagatactcagcaccagctcgtagtgagcccttgggagtgtacgtggagctgaactgaaccagagccgccctcaaggaagcgggtgtgtgttgagagagaatgctcccacacaggtgttgggcagggcgggttgcctgcttgcctgtgtggtggtttctgaggatgctccagaggtgcatctgctccaggaactccagaacagactcagcaggagtgtgggcctggcccaggatggacctgcttcctcctgaggcttcctagcctccaccatgcagtcctccccctctgtgttcctaaaaccggctccaccttgctgcccc

SEQ ID NO: 27347 - DNA, 428 bp, Homo sapiens
gggtaataaacacataagctatactgtcttgtcttcaactggaagggtgagaggtgaagctggcagatctagctcagagatgatgaggaagatgggaaggaaaagtggtcccgacaggctacagactgggaatatccgaggacccttggtcaaagacatggcaagggacaggggcactgttggaaacacttccaaagctctacaagtttgtttgtttgtttgttttgaagggaggaatagaggagaggtgatataaagaggctcaaaggggctgcagctggctgcagctgggctgggaggaggaagctgggggagacatgaggtcagtgtgggactgggaccaggccaagggctgagtctctttcttccctttctccccatcagcagggaagaacccaagagagcccagttcctagccttaaaaaaaa

SEQ ID NO: 27348 - DNA, 534 bp, Homo sapiens
catattatctgttatcttttttaaagggtcaaatgaaatattcagaaggctttactttatagatgggttcctgttgaaatggatcttatatctctaaccattgtacaggagaaattcattattgcctgatggcaaactcatgtctctggaccaagtgggccaagccctccccctgaggatgggtgtagtggttccatttaactgatggaatctcttgtatgcatgactaatgtgaacatttctcttctttctagaatctcttcattctaactctactttttttcctgaagttcaacataaaacctttaccacgaactcttgagcacttggtagattataagtgatgcttgcgtccttgtcctctagtgaacctttaccacaaactctcgagcacttagtgggattatagctgatgtttgtgtccttgtcctctagtgtgttcctcaagtgtttgcttccagtgtgcatcacacttttatcatcagaaaagacaaacaaaaaatcttttaactctgttttgaacatagaagaaag

SEQ ID NO: 27349 - DNA, 424 bp, Homo sapiens
gcatggaagtcaagccagggcctctggggaagatatggcctgagctgagatttggaaacaaatgaataaaaacctggaaacaagagcaatctggacagaggaactctcagctgacctccaggagactcagcctccaggcctcaggaagtagctggcagacagaggcaagcgagcaaacagagtcaccacaggggtagcctttggagccagactgcctgagttcaaatgctggttcagcccttttttagctcagtgacgttgggtgcatcacttaacctctctgattcttcacctgtaaaatgtggctaataagtactacttcccttatgggttgaaatagggattgaataagttcatgtattgagactgtttagaatagtgtctggcacatgccctgtgtgtgtattcctctacagaacctcca

SEQ ID NO: 27350 - DNA, 333 bp, Homo sapiens
aaaatatgtacaagatctatgagaaaaatatataaaatctaatgaaagaaatcaaataactgaataaatggagagagagttcatgttcgtaggtaagaagactcaatattgtcaagatgtcaatttttcacaacttgatctatacttttaaaaaatatctataaaaatctcagtctcccaaagtgctgtgattacaggtggtgagcaaccacacccggccaagcagaggatttttaggacagtgaaactattatgtataacactgtaatggtgggtcaatgtcattctttatacatttgtcaaaattcattgaatttacaacacaaagaagga

SEQ ID NO: 27351 - DNA, 486 bp, Homo sapiens
acattccttccgacctgtagattgggcttttcatatacgtatttatcatgtcttcttggattttcttcatttaattctatctgaactttcgaagtgggaagcaaaggattcgggggagagcactggtttcagtacacgaaaatatccctggggtttccttacctttatctttggatatccccatttttctcgacacacaatccaagtttctagccataatccttagattacaaaagaacaggacttttggtacacatcttttttttttttttttttttttttttgagacagattctctgtctctgttgcccagtctggagtgcagtggcgcaatctcggcttcactgcaacctctgcctcctgggttcaagcgattctagtgtctcagcctcccaagtagctaggaccataggcacgcgcccccatgcctggctaatttttgtatttttagtagagacagggtttcaccatgttggccaggctggt

SEQ ID NO: 27352 - DNA, 531 bp, Homo sapiens
ataaaggggaattcccttcagtgagtggcttccctgccaatcatggcaaattacacagctctctagtaaatatctgcacgatgccaaccgagaagaagcggaggtcagaaaagccaattttgagacaacacttcaatccttcctctaagtcactgtgattcagaaaacatttaggtgcatctcctatcctggaaataaaaactgatttttgcaaaggttaaatgagatgcgacacattaaagaggctattgtgtaactcttactatccaatagcttttatgctcatcatcatgtcattcgattctgctcattaacgctcatcctgcaaacattcgagcaagaccagccactttctagtacctcaggccatcctttgtcagctgattccctgtcacacagatgctatgtatttgcctgtattgcaaatatcgtatatattatatatagtatataaatgtgtgtacatacatgttttcaatgtatagatttgctgcaaatacttcaatataataaaaactgtattctactcta

SEQ ID NO: 27353 - DNA, 5168 bp, Homo sapiens
gccttggtcattggaccggctcccaaccaaaaccacaccatagggttttctgctcttggccaacccaacatgagaaaagaggaattaaatggtcctactaataagaaagcctcagcgtagcattaagggacgtagcaggtcttctggccacactcccctacaaatgtggaaagctcattggtgaaaacagttctcaggggtcaaagcaaaggaactgatctgggtaaagtagaggctgcctgatcccaatcagacatcctcacctctcaataacctttgccatttctctgccatagagtgaaagtgtccccaggccaaaagcccagggctccaggctgccatcaggatggtgggtgaaggaccctaccttatctcagatctggaccagcgaggccggcggagatcctttgcagaaagatatgaccccagcctgaagaccatgatcccagtgcgaccctgtgcaaggttagcacccaacccggtggatgatgccgggctactctccttcgccacattttcctggctcacgccggtgatggtgaaaggctaccggcaaaggctgaccgtagacaccctgcccccattgtcgacatatgactcatctgacaccaatgccaaaagatttcgagtcctttgggatgaagaggtagcaagggtgggtcctgagaaggcctctctgagccacgtggtgtggaaattccagaggacacgcgtgttgatggacatcgtggccaacatcctgtgcatcatcatggcagccatagggccggtgattctcattcaccaaatcctccagcagactgagaggacctctgggaaagtctgggttggcattggactgtgcatagccctttttgccaccgagtttaccaaagtcttcttttgggcccttgcctgggccatcaactaccgcacggccatccggttgaaggtggcgctctccaccttggtttttgaaaacctagtgtccttcaagacattgacccacatctctgttggcgaggtgctcaatatactgtcaagtgatagctattctttgtttgaagctgccttgttttgtcctttgccagccaccatcccgatcctaatggtcttttgtgcggcgtacgcctttttcattctggggcccacagctctcatcgggatatcagtgtatgtcatattcatacccgtccagatgtttatggccaagctcaattcagctttccgaaggtcagcaattttggtgacagacaagcgagttcagacaatgaatgagtttctgacctgcatcaggctgatcaaaatgtatgcctgggagaaatcttttaccaacactatccaagatataagaaggagggaaagaaaattactggaaaaagctggatttgtccaaagtggaaactctgccctggcccccatcgtgtccaccatagccatcgtgctgacattatcctgccacatcctcctgagacgcaaactcaccgcacccgtggcatttagtgtgattgccatgtttaatgtaatgaagttttccattgcaatcttgcccttctccatcaaagcaatggctgaagcgaatgtctctctaaggagaatgaagaaaattctcatagataaaagccccccatcttacatcacccaaccagaagacccagatactgtcttgcttttagcaaatgccaccttgacatgggagcatgaagccagcaggaaaagtaccccaaagaaattgcagaaccagaaaaggcatttatgcaagaaacagaggtcagaggcatacagtgagaggagtccaccagccaagggagccactggcccagaggagcaaagtgacagcctcaaatcggttctgcacagcataagctttgtggtgagaaaggggaagatcttgggaatatgtgggaatgtgggaagtggaaagagctccctccttgcagctctcctaggacagatgcagctgcagaaaggggtggtggcagtcaatggaactttggcctacgtttcacagcaggcatggatctttcatggaaatgtgagagaaaacatactctttggagaaaagtatgatcaccaaaggtatcagcacacagtccgcgtctgtggcctccagaaggacctgagcaacctcccctatggagacctgactgagattggggagcggggcctcaacctctctggggggcagaggcagaggattagcctggcccgcgctgtctactccgaccgtcagctctacctgctggacgaccccctgtcggccgtggacgcccacgtggggaagcacgtctttgaggagtgcattaagaagacgctcaggggaaagacagtcgtcctggtgacccaccagctacagttcttagagtcttgtgatgaagttattttattagaagatggagagatttgtgaaaagggaacccacaaggagttaatggaggagagagggcgctatgcaaaactgattcacaacctgcgaggattgcagttcaaggatcctgaacacctttacaatgcagcaatggtggaagccttcaaggagagccctgctgagagagaggaagatgctggtataatcgttttggctccaggaaatgagaaagatgaaggaaaagaatctgaaacaggctcagaatttgtagacacaaaagttcctgagcaccagctcatccagactgaatccccccaggaaggaaccgtgacctggaaaacatatcacacgtacattaaggcttctggagggtacctcctttctctcttcactgtgttcctcttcctcctgatgattggcagcgctgccttcagcaactggtggctgggtctctggttggacaagggctcacggatgacctgtgggccccagggcaacaggaccatgtgtgaggtcggcgcggtgctggcagacatcggtcagcatgtgtaccagtgggtgtacactgcaagcatggtgttcatgctggtgtttggcgtcaccaaaggcttcgtcttcaccaagaccacactgatggcatcctcctctctgcatgacacggtgtttgataagatcttaaagagcccaatgagtttctttgacacgactcccactggcaggctaatgaaccgtttttccaaggatatggacgagctggatgtgaggctgccgtttcacgcagagaactttctgcagcagttttttatggtggtgtttattctcgtgatcttggctgctgtgtttcctgctgtccttttagtcgtggccagccttgctgtaggcttcttcattctgttacgcattttccacagaggagtccaggagctcaagaaggtggagaatgtcagccggtcaccctggttcacccacatcacctcctccatgcagggcctgggcatcattcacgcctatggcaagaaggagagctgcatcacctatcacctcctctactttaactgtgctctcaggtggtttgcgctgagaatggatgtcctcatgaacatccttaccttcactgtggccttgttggtgaccctgagtttctcctccatcagtacttcatccaaaggcctgtcattgtcatacatcatccagctgagcggactgctccaagtgtgtgtgcgaacgggaacagagacgcaagccaaattcacctccgtggagctgctcagggaatacatttcgacctgtgttcctgaatgcactcatcccctcaaagtggggacctgtcccaaggactggcccagctgtggggagatcaccttcagagactatcagatgagatacagagacaacaccccccttgttctcgacagcctgaacttgaacatacaaagtgggcagacagtcgggattgttggaagaacaggttccggaaagtcatcgttaggaatggctttgtttcgtctggtggagccagccagtggcacaatctttattgatgaggtggatatctgcattctcagcttggaagacctcagaaccaagctgactgtgatcccacaggatcctgtcctgtttgtaggtacagtaaggtacaacttggatccctttgagagtcacaccgatgagatgctctggcaggttctggagagaacattcatgagagacacaataatgaaactcccagaaaaattacaggcagaagtcacagaaaatggagaaaacttctcagtaggggaacgtcagctgctttgtgtggcccgagctcttctccgtaattcaaagatcattctccttgatgaagccaccgcctctatggactccaagactgacaccctggttcagaacaccatcaaagatgccttcaagggctgcactgtgctgaccatcgcccaccgcctcaacacagttctcaactgcgatcacgtcctggttatggaaaatgggaaggtgattgagtttgacaagcctgaagtccttgcagagaagccagattctgcatttgcgatgttactagcagcagaagtcagattgtagaggtcctggcggctgattctagaggaggaagaggctctgtgagatgaataggaggagtcttcaggaggaggggctgtcctctccgcaggcagccctggtcttcagcccctcccatccacggagtgagctggggctgaagttgtccccactgccatactcagtccatgtcaccccacttggtgggcttggggttggttctgggtggtgaaccggggcagacccagctaatggattaaaaaactgcccttcacctcccaaatccccaagggttcctcatgtgttttcaccaaaaccaccccagtgcctgagattgaaaatattgtaactttcagttagaaatcagccacaataaacaacatgggaaaatgccttaggatggagtttgcaaggtttccttgcccattatcagaaggaaaaagagcagaattttcttctcgtttaaccccactcacttccatcttgactgggtgacaagtggtaatgacacagatttgtagcgtgaaagactgaatacagtgtttggccaaaaatttttttaaaaatcatattatatgtttcaattgatctgttagaataaccaagaaaacaaaatgctggagtttctctataaatgacacttttatatcttctttattcgtcgttaaaacgcggtaggaaattaccctgaaatgtcgccttgcaattatttcactgaagatattccaatttccatactatttcctccaatagacccttgttgcct

SEQ ID NO: 27354 - DNA, 5325 bp, Homo sapiens
aggtgtggtgggagtggcagttgaatggggcagttggagaggaggacttcaggcgggtgggacaagagaaactgaatctgaggtccttggggagaagcaggccctggagtcctgggcagcagatgccaggctctgagccccatgactgctgaccctcctcccctccctctcatcctcagcccagggctgccaaatttagcaaagtgccattccagctgcaatgcttccaagccgcctcagatcatcaaaacttcacatgccctggggagcactcaaggaaattaccttctagcaccaatttcctatgcgcgctgattactcaaacctggccagggaggcctggcctccagtgtttggcatctgggactcaggagcccttaagacaagctgatgacatcttgctgccagggtcccttaccattagaaaagggaaccaaaaaatagaagttatagagtgaaagtgtccccaggccaaaagcccagggctccaggctgccatcaggatggtgggtgaaggaccctaccttatctcagatctggaccagcgaggccggcggagatcctttgcagaaagatatgaccccagcctgaagaccatgatcccagtgcgaccctgtgcaaggttagcacccaacccggtggatgatgccgggctactctccttcgccacattttcctggctcacgccggtgatggtgaaaggctaccggcaaaggctgaccgtagacaccctgcccccattgtcgacatatgactcatctgacaccaatgccaaaagatttcgagtcctttgggatgaagaggtagcaagggtgggtcctgagaaggcctctctgagccacgtggtgtggaaattccagaggacacgcgtgttgatggacatcgtggccaacatcctgtgcatcatcatggcagccatagggccggtgattctcattcaccaaatcctccagcagactgagaggacctctgggaaagtctgggttggcattggactgtgcatagccctttttgccaccgagtttaccaaagtcttcttttgggcccttgcctgggccatcaactaccgcacggccatccggttgaaggtggcgctctccaccttggtttttgaaaacctagtgtccttcaagacattgacccacatctctgttggcgaggtgctcaatatactgtcaagtgatagctattctttgtttgaagctgccttgttttgtcctttgccagccaccatcccgatcctaatggtcttttgtgcggcgtacgcctttttcattctggggcccacagctctcatcgggatatcagtgtatgtcatattcatacccgtccagatgtttatggccaagctcaattcagctttccgaaggtcagcaattttggtgacagacaagcgagttcagacaatgaatgagtttctgacctgcatcaggctgatcaaaatgtatgcctgggagaaatcttttaccaacactatccaagatataagaaggagggaaagaaaattactggaaaaagctggatttgtccaaagtggaaactctgccctggcccccatcgtgtccaccatagccatcgtgctgacattatcctgccacatcctcctgagacgcaaactcaccgcacccgtggcatttagtgtgattgccatgtttaatgtaatgaagttttccattgcaatcttgcccttctccatcaaagcaatggctgaagcgaatgtctctctaaggagaatgaagaaaattctcatagataaaagccccccatcttacatcacccaaccagaagacccagatactgtcttgcttttagcaaatgccaccttgacatgggagcatgaagccagcaggaaaagtaccccaaagaaattgcagaaccagaaaaggcatttatgcaagaaacagaggtcagaggcatacagtgagaggagtccaccagccaagggagccactggcccagaggagcaaagtgacagcctcaaatcggttctgcacagcataagctttgtggtgagaaaggggaagatcttgggaatatgtgggaatgtgggaagtggaaagagctccctccttgcagctctcctaggacagatgcagctgcagaaaggggtggtggcagtcaatggaactttggcctacgtttcacagcaggcatggatctttcatggaaatgtgagagaaaacatactctttggagaaaagtatgatcaccaaaggtatcagcacacagtccgcgtctgtggcctccagaaggacctgagcaacctcccctatggagacctgactgagattggggagcggggcctcaacctctctggggggcagaggcagaggattagcctggcccgcgctgtctactccgaccgtcagctctacctgctggacgaccccctgtcggccgtggacgcccacgtggggaagcacgtctttgaggagtgcattaagaagacgctcaggggaaagacagtcgtcctggtgacccaccagctacagttcttagagtcttgtgatgaagttattttattagaagatggagagatttgtgaaaagggaacccacaaggagttaatggaggagagagggcgctatgcaaaactgattcacaacctgcgaggattgcagttcaaggatcctgaacacctttacaatgcagcaatggtggaagccttcaaggagagccctgctgagagagaggaagatgctggtataatcgttttggctccaggaaatgagaaagatgaaggaaaagaatctgaaacaggctcagaatttgtagacacaaaagttcctgagcaccagctcatccagactgaatccccccaggaaggaaccgtgacctggaaaacatatcacacgtacattaaggcttctggagggtacctcctttctctcttcactgtgttcctcttcctcctgatgattggcagcgctgccttcagcaactggtggctgggtctctggttggacaagggctcacggatgacctgtgggccccagggcaacaggaccatgtgtgaggtcggcgcggtgctggcagacatcggtcagcatgtgtaccagtgggtgtacactgcaagcatggtgttcatgctggtgtttggcgtcaccaaaggcttcgtcttcaccaagaccacactgatggcatcctcctctctgcatgacacggtgtttgataagatcttaaagagcccaatgagtttctttgacacgactcccactggcaggctaatgaaccgtttttccaaggatatggacgagctggatgtgaggctgccgtttcacgcagagaactttctgcagcagttttttatggtggtgtttattctcgtgatcttggctgctgtgtttcctgctgtccttttagtcgtggccagccttgctgtaggcttcttcattctgttacgcattttccacagaggagtccaggagctcaagaaggtggagaatgtcagccggtcaccctggttcacccacatcacctcctccatgcagggcctgggcatcattcacgcctatggcaagaaggagagctgcatcacctatcacctcctctactttaactgtgctctcaggtggtttgcgctgagaatggatgtcctcatgaacatccttaccttcactgtggccttgttggtgaccctgagtttctcctccatcagtacttcatccaaaggcctgtcattgtcatacatcatccagctgagcggactgctccaagtgtgtgtgcgaacgggaacagagacgcaagccaaattcacctccgtggagctgctcagggaatacatttcgacctgtgttcctgaatgcactcatcccctcaaagtggggacctgtcccaaggactggcccagctgtggggagatcaccttcagagactatcagatgagatacagagacaacaccccccttgttctcgacagcctgaacttgaacatacaaagtgggcagacagtcgggattgttggaagaacaggttccggaaagtcatcgttaggaatggctttgtttcgtctggtggagccagccagtggcacaatctttattgatgaggtggatatctgcattctcagcttggaagacctcagaaccaagctgactgtgatcccacaggatcctgtcctgtttgtaggtacagtaaggtacaacttggatccctttgagagtcacaccgatgagatgctctggcaggttctggagagaacattcatgagagacacaataatgaaactcccagaaaaattacaggcagaagtcacagaaaatggagaaaacttctcagtaggggaacgtcagctgctttgtgtggcccgagctcttctccgtaattcaaagatcattctccttgatgaagccaccgcctctatggactccaagactgacaccctggttcagaacaccatcaaagatgccttcaagggctgcactgtgctgaccatcgcccaccgcctcaacacagttctcaactgcgatcacgtcctggttatggaaaatgggaaggtgattgagtttgacaagcctgaagtccttgcagagaagccagattctgcatttgcgatgttactagcagcagaagtcagattgtagaggtcctggcggctgattctagaggaggaagaggctctgtgagatgaataggaggagtcttcaggaggaggggctgtcctctccgcaggcagccctggtcttcagcccctcccatccacggagtgagctggggctgaagttgtccccactgccatactcagtccatgtcaccccacttggtgggcttggggttggttctgggtggtgaaccggggcagacccagctaatggattaaaaaactgcccttcacctcccaaatccccaagggttcctcatgtgttttcaccaaaaccaccccagtgcctgagattgaaaatattgtaactttcagttagaaatcagccacaataaacaacatgggaaaatgccttaggatggagtttgcaaggtttccttgcccattatcagaaggaaaaagagcagaattttcttctcgtttaaccccactcacttccatcttgactgggtgacaagtggtaatgacacagatttgtagcgtgaaagactgaatacagtgtttggccaaaaatttttttaaaaatcatattatatgtttcaattgatctgttagaataaccaagaaaacaaaatgctggagtttctctataaatgacacttttatatcttctttattcgtcgttaaaacgcggtaggaaattaccctgaaatgtcgccttgcaattatttcactgaagatattccaatttccatactatttcctccaatagacccttgttgcct

SEQ ID NO: 27355 - DNA, 1661 bp, Homo sapiens
gctctaactgcggctgctcgctccttttcaacagctgagcggactgctccaagtgtgtgtgcgaacgggaacagagacgcaagccaaattcacctccgtggagctgctcagggaatacatttcgacctgtgttcctgaatgcactcatcccctcaaagtggggacctgtcccaaggactggcccagctgtggggagatcaccttcagagactatcagatgagatacagagacaacaccccccttgttctcgacagcctgaacttgaacatacaaagtgggcagacagtcgggattgttggaagaacaggttccggaaagtcatcgttaggaatggctttgtttcgtctggtggagccagccagtggcacaatctttattgatgaggtggatatctgcattctcagcttggaagacctcagaaccaagctgactgtgatcccacaggatcctgtcctgtttgtaggtacagtaaggtacaacttggatccctttgagagtcacaccgatgagatgctctggcaggttctggagagaacattcatgagagacacaataatgaaactcccagaaaaattacaggcagaagtcacagaaaatggagaaaacttctcagtaggggaacgtcagctgctttgtgtggcccgagctcttctccgtaattcaaagatcattctccttgatgaagccaccgcctctatggactccaagactgacaccctggttcagaacaccatcaaagatgccttcaagggctgcactgtgctgaccatcgcccaccgcctcaacacagttctcaactgcgatcacgtcctggttatggaaaatgggaaggtgattgagtttgacaagcctgaagtccttgcagagaagccagattctgcatttgcgatgttactagcagcagaagtcagattgtagaggtcctggcggctgattctagaggaggaagaggctctgtgagatgaataggaggagtcttcaggaggaggggctgtcctctccgcaggcagccctggtcttcagcccctcccatccacggagtgagctggggctgaagttgtccccactgccatactcagtccatgtcaccccacttggtgggcttggggttggttctgggtggtgaaccggggcagacccagctaatggattaaaaaactgcccttcacctcccaaatccccaagggttcctcatgtgttttcaccaaaaccaccccagtgcctgagattgaaaatattgtaactttcagttagaaatcagccacaataaacaacatgggaaaatgccttaggatggagtttgcaaggtttccttgcccattatcagaaggaaaaagagcagaattttcttctcgtttaaccccactcacttccatcttgactgggtgacaagtggtaatgacacagatttgtagcgtgaaagactgaatacagtgtttggccaaaaatttttttaaaaatcatattatatgtttcaattgatctgttagaataaccaagaaaacaaaatgctggagtttctctataaatgacacttttatatcttctttattcgtcgttaaaacgcggtaggaaattaccctgaaatgtcgccttgcaattatttcactgaagatattccaatttccatactatttcctccaatagacccttgttgcct

SEQ ID NO: 27356 - DNA, 455 bp, Homo sapiens
gcctctaaggcttacctgcatgatgaatttccgttttccttactctcacacccagctttcaatttagcaagaaacagattcgcccaggccagtctcaagaattaaactctgaaaatcctgagccttgtggagctctccttctgataagagagttctgtatcaaaaatcctaaccctaaacctgggaagggcatgggtaactgtgtttgatgtgcctagtcccccaactccctttctcccttcttcttctttttaagaaggagtctcactctgttggccaggctggagtgcagtcgcacgatctcagctcactgcaagctccacctcccaggttcaagtgattctcctgcctcagctactcgggaggctgagacaggagaattgcttgaaccctggaggtggaggttgcagtgagccgagattgcaccattgcactccaccctaggcaacaagatg

SEQ ID NO: 27357 - DNA, 437 bp, Homo sapiens
gatcctctatcttttcccactttccaccctccaatgggccccagtgtctattgttcccctctatgtccatgtgttctcatcatttagctcccacttacaagtgagaacacacaatatgtggttttctgttcctgcctcagtttgctaaggatagtggcctccagctccatccatgttcctgcaaaagacataatcttgttcttttttatggatgcatggtattccatagtgtatatgtatcacgttttctttttccagtctaccaacattgctatatttaaagtagacaagaagagttaaaataaaaaaaccacttacttggtgggaaaatgtggtctaaaggccaataacttagaacagtgctattcaatagtaatataaagagagccacaaatgtgagccacatatacaattttaaattttctagtaggcacatt

SEQ ID NO: 27358 - DNA, 360 bp, Homo sapiens
aatgctcagtggccattcaaattaaacacacacaaagcaaaatccttcaatcctttagatgttgtttagaaacttttaggaatagtttcaggcttatttgccaggccttacccacaggtaggaattgtctaagggtgtggtagagtggtctggagtcttggagcctcaggggccagacttaattgggagggatgtttcccatggtgtgacccaagaagaaaatttgaagctgtggtcagggtaaggagagataggcagatgtatcaagcgtataactcaagaacacacattggaggacagaagaatttctgagaaggtaaatgggcagtgaagtagagagaatgggtcagttggtttaga

SEQ ID NO: 27359 - DNA, 416 bp, Homo sapiens
aaattgcaagcatttggactttaagagtttcctttgattcacaaggtagcaagggaaaaactgtttctaaacaaaactttgtattgtcttggtgctttccagcagttagaaaaacagtagctgtaatacttcacagcaccttaacttcctagctatcccagttatttgatactctgcagttctgcaaatggtgcattgatgatagaatatttactgtttatatacagatcctttttagtctatatgaatcctaggaataagaaagcaaatattctatatactttggatcttttgtgaatatattggtaattgatttgcatgattgcttaattttttcttctttttaatccaaaatatgtcaactcctgactgttgcagaaaatgaagggtcaaaaataaagacagtctcctctcta

SEQ ID NO: 27360 - DNA, 246 bp, Homo sapiens
acacacagacacacacaaacatacatagacatagacatacacatagacccagacagacacacacacacacacaaacatacatagacacatatgcatagacacacacatggacacatacacagacacacacttgtatacacacagatatacacatagacatacacagacacacacagagacacatgcccacacacacacagagacacacacacgtgcacatcctggggaggagaagcagttgtagga

SEQ ID NO: 27361 - DNA, 338 bp, Homo sapiens
cacttgtaatcgtacaggaagcactagactacatttggcattggaattaggtatttttacttatttattttttatttcactaagctttttggaactgaggtactgcaaactggatagcagcttgtactgatttccaaaaccagtggaacagccttgagagtttcttccttacagagtgatgtcatcagttagtaagtttccatagtgccccataccctaccaaagaagttcctctctgtgttagttctacctcacctgccaagaaatgaaaacacacagcttcctttattctacagtgaaacaaagtggtttggacacaatttggaggggaactgcca

SEQ ID NO: 27362 - DNA, 252 bp, Homo sapiens
tttttacaaatctctttaatgtctgtcttaacaaaggacagctgaattctcagataggcttctgcattcagtctgctgctatgttgttagggatgtgttctatgaagaaaaccagtcacagacacacatggagtcagaaaaagaaagcatctcaggaacacccaaggttcctccaatcctactttgagaacccatactttgaaaaccactgttctaaagttttcctgccagctgtaaacattacattaaggg

SEQ ID NO: 27363 - DNA, 181 bp, Homo sapiens
cactctttttcctctgtcaaaaccacccattactgcctcacaggttgcccctcagaccctggcttggactctgttctggcgctctctggcttcacttgtccccatgcccccccttctagaccatggttcatgtacccgggactccaggatcctctacctaggcagaccctggctctcttct

SEQ ID NO: 27364 - DNA, 453 bp, Homo sapiens
aagatagcacacccttgctgtttccctctcttggatcactcacttagggggaagacagtagctatactcagacagtcccgggagagatccatgtggaaagaaactgaggcctctcaccaataaccagccccaacttactagtgagacaccttgacagcagaccctcaagtctaggcatgactgcgaccttctgagaaattccaagccagaaaacgcatggctaagccgctcctaaattcttgacctgtagtaactgataataggaaaatgaatgcatattgttttaaccactaagttttggggttgtttccattgtaattgataccttaaaaagcatgaaaatatagggtctacctaaaaacttgaaactgtttcatttgtatatggttagggattactgagaaataaggttaataaggcagatgtggtcagatcatggatggccttgaatgt

SEQ ID NO: 27365 - DNA, 298 bp, Homo sapiens
gccactccttgagctgggtgcttactatgtgtttattattttaaccctcacaacaacctcaacaccctcatgaagtaggtcctattaggatccctgttttgaagatgaactgaggctcatgtttagcccaagttcactgagctagtaactggcaaagttagaatctgaaatgaaatctgcctgatgtcagaatgatgttgttcattcataggctgatattcttaaggctctaccccaagacaatagtcacggcgtcatggcacaggcagcctgtggagctagctcatttgctccaatc

SEQ ID NO: 27366 - DNA, 541 bp, Homo sapiens
ttgatagagatggggtatcactgtgttgaccaggctgatctaaaactcctggccttgagtaatcattgtgcctcaaccttctaaagtactgagattataggcatgagccactgtgcctggtcatactgttttctgcaatagaacttacctcctctctctcatgcttctgtagcaccaagtatcagaaaacataatctagtcatttctagataagcttacatcattctgattttcctcagtaatttctgcatatgctcatcttaagaattcatgacttctcatccttctcttccctaaggtgagggttacgtggtgagggaagttcacacagcagccgcatggtatcggtgagaggcattggacctgtagcactctgatttggcacctgtcaagtctctagtcacagcatttgtgtgatcgggttttcagtgaactatctgtagtcttagtagactctaatcatgtattccatactaccattcctggcttcttctcaacattactgtgaggtcctttaaagcactggtcttgcatccagctc

SEQ ID NO: 27367 - DNA, 315 bp, Homo sapiens
attcaagtcaaagcagggcccaaaagaaattctaactactttagagtttttatttctaaactaactctcaaatcccttgctgtttctgggaaatgagaagctaagaccttctcagctgtccagtgcatattctgccttcagatcatggagccggctgtagttcaccagttctttaactctccccatccccatcctgcagaaggaaagagctacactctgagcccaagccccactctctcaaacccatcctacatgaacatggtggacatagtaactatgaaaacagctgtgggcttgaaattgtccctgcacaga

SEQ ID NO: 27368 - DNA, 418 bp, Homo sapiens
gctcgacgtggagagggaagttggagagttactgtttaacgagtacagggttttagttgcagaagatgaaaaagttatggaaaatgcgtagttatgaaattgcagatgttcttaatgccacaggactgtacccttaaaaatggttaaaatgtccaggtgtgggtcaccacgcctgtaatcccaggactttgggaggccaaggcaggaggattgcttgaagacaggagtttgaggctgcagtgagctatggttatgctattgctcttcagcctgggcaagtgagcgagactcctttctctccacagccaattcttaacttagctccttgtctgaaggcgcacatcaccataaaagtttcaaaaacagctggaacaaaagtacaactcagtcccatggtgaacacttcacccaagggaac

SEQ ID NO: 27369 - DNA, 432 bp, Homo sapiens
ttgacttacagttccacaagcttaacaggcagcatgactgggaggcctcaggaaacttacaatcatggcagaaggcaaagcagaaccaagtaccttcttcaaaggtggcaggagagagagagagcaaggagggggggatgtgccacacacttttagcatcaaatctcatgagaactcattcactatcacaagaatagcatggggaaaatccgcctccatgatccagtcacttcccaccaggtccctcccccaatattgggaattaaaattcagcatgagatttgggtgggtacacagaggcaaaccacatcactagccaagggaaaacttgcacctaaacctttctgaagataacagcctcaggcctgctgtgttaaattacttctgcacaggcagttgaaagtgagagatcttatgttggttttcccaatt

SEQ ID NO: 27370 - DNA, 1999 bp, Homo sapiens
gagtgtgtgacccacccttcccccgtgccaacagagagagtgccttgagaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagggaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaaactatgctttgagttggactatgagccagctcacatttctctagaccctcagacttcccaccccaagctcctcttgtccgaggaccaccagcgagctcagttctcctcaaaatggcagaactcaccagacaacccccagcgttttgaccgggccacctgtgttctggcccacactggcatcacaggggggagacacacgtgggtggtgagtatagacctggcccatggggcgagctgcaccgtgggcgtggtgagcgaggatgtgcagcggaagggggagcttcggctgcggccagaggagggggtgtgggctgtgaggctggcttggggcttcgtctcggctctgggctccttccccacacggctgaccctgaaggagcagccccggcaggtgagggtgtctcttgactatgaggtgggctgggtgaccttcaccaacgctgtcacccgagagcccatctacaccttcactgcctccttcactaggaaggtcattcccttctttgggctctggggccgagggtccagtttctccctgagctcctgagaaggagcagttacctactctcctctaagtacaggactcattcaacccagtaccatgtggcttgatccctggctgaatcacctggatgactcgggatagaaatgactgctttagaagatgggatggggtcgggtggtaagggatagaagagaggactctcaatctactgatcaagtcctttccccaatgcccagtggatggccagggtacctggggactcaggctgctgccagttctgctcaccaccatccgtgcttggcacagaagtagctgcatagaaagagcactggatttgaagtcagaagacctggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtgggccactggtggacttgga

SEQ ID NO: 27371 - DNA, 2562 bp, Homo sapiens
agaagaaagctggtaggggctgggagagggtaccacaggggagtatgatctacttgggggccagagaaggttccctgaggaaatagtacctgaacttagacttgaaggataacagatgttaactgggaggagagaatgttccaggcagaggaaaaggcatatgcaaaagtccagcgccttgaaggagcacagctggggtgcctggagtgagatggagctggaaagatccaggtggagcttgacctgaagtaccagcccccagagggcgctactggagcctggtcagaggaggactttggggcacccatccaggacagcttcgagttaatcatccccaatgtgggcttccaggaactggagcctggggaggcccagctggagcggcgggcagtggctctaggccgcaggctagctcgaagtctaggccagcaggacgatgaagagaatgagctggagcttgagctggagcaggacctggatgatgagcctgacgtggaactttctggtgttatgttcagccccctcaagagccgcgccagggccctggcccatggggatcccttccaggtgtccagagctcaagacttccaggtgggagtcactgtgctggaagcccagaaactggtgggagtcaacattaacccctatgtggccgtgcaagtgggggggcagcgccgtgtgaccgccacacagcgtgggaccagttgccccttctacaatgagtacttcttgttcgaatttcatgacacgcggcttcgtctccaagacttgctgctggagatcacggtgagtggggtaggggtgaccagtgtccttcagagaaggggggatgagaaagctgcaggactaacaccaccttcccccaaggctttccattcgcagaccctcccctttatggccacccggataggcaccttcaggatggacctgggcatcatcttggaccagccaggtatggaatcgtccccttattgagactctgcacggacaagggccctagagattgaccctgcagtgactccgcatggacccctatacactcacttcggagagggccatctctggcggaggctgaactcttggcacttccgcccctccctgctgagccagagaagccctggccattgtccgtcactccgatagcctcacggccaccctgtgcgtcccgccggtcgccccttacccctggctcgccccttcgcccttagatggccagttctaccaaagatgggttccgctgcatgatccccgagacacccgcgccgggaccaagggtttcattaaggtcaccttgtccgtgagggcgcgcggggacctgccccctccaatgctacccccggccccagggcactgttcggacatcgagaagtgagccgggatgaggtggggaggaggacatggatccgggggtggccgtggggcgcggataaggggaggggccgagatcccagtttctccccccccgctcggtgccccctcccctaggaacctgctcctgccgcgcggggtgcccgccgagaggccatgggcgcggctccgcgtgcgcctgtaccgcgccgaggggcttcccgcgctgcgcctggggctgctgggcagcctggtccgcgccctgcacgaccagcgcgtcctggtggagccctatgtgcgggtgtctttcctggggcaggagggcgagacgtcggtgagcgccgaggcggcggcgcccgaatggaacgagcagctgagcttcgtggagctcttcccgccgctgacgcgcagcctccgcctgcagctgcgggacgacgcgcccctggtcgacgcggcactcgctacgcacgtgccggacctgaggcggatctcccatccgggccgcgcggcggggtttaaccctaccttcggcccggcctgggtgcccctctatggctcgccccccggcgcggggctccgggatagtcttcaaggtctcaacgaaggcgttggccaaggcatttggttccgcggccgccttctgctggctgtgtccatgcaggtgttggaagggagagctgaacctgagcctccccaggcccagcaggggtccacgttgtcccggctcacccgaaagaagaaaaagaaagccagaagggatcagaccccaaaggcggttccgcagcacttggacgccagccccggtgccgaggggcctgagatcccccgtgccatggaggtggaggtggaggagctgctgccgctgccagagaatgtcctggcgccctgtgaagatttcctgcttttcggtgtgctcttcgaggccaccatgatcgaccccaccgtggcctcccagcccatcagcttcgagatctccattggtcgcgcaggccgtctggaggagcaattgggccgagggtccagggctggggagggaactgagggtgcagccgtggaggctcagcctctgctgggagccaggccagaggaggagaaagaggaggaagaactggggacccatgctcagcggcctgagcccatggacggcagtgggtgagtgctgccggtggctggaagggggggtttgggaggtctccaggaacccagaatgcccgc

SEQ ID NO: 27372 - DNA, 2730 bp, Homo sapiens
agaagaaagctggtaggggctgggagagggtaccacaggggagtatgatctacttgggggccagagaaggttccctgaggaaatagtacctgaacttagacttgaaggataacagatgttaactgggaggagagaatgttccaggcagaggaaaaggcatatgcaaaagtccagcgccttgaaggagcacagctggggtgcctggagtgagatggagctggaaagatccaggtggagcttgacctgaagtaccagcccccagagggcgctactggagcctggtcagaggaggactttggggcacccatccaggacagcttcgagttaatcatccccaatgtgggcttccaggaactggagcctggggaggcccagctggagcggcgggcagtggctctaggccgcaggctagctcgaagtctaggccagcaggacgatgaagagaatgagctggagcttgagctggagcaggacctggatgatgagcctgacgtggaactttctggtgttatgttcagccccctcaagagccgcgccagggccctggcccatggggatcccttccaggtgtccagagctcaagacttccaggtgggagtcactgtgctggaagcccagaaactggtgggagtcaacattaacccctatgtggccgtgcaagtgggggggcagcgccgtgtgaccgccacacagcgtgggaccagttgccccttctacaatgagtacttcttgttcgaatttcatgacacgcggcttcgtctccaagacttgctgctggagatcacggtgagtggggtaggggtgaccagtgtccttcagagaaggggggatgagaaagctgcaggactaacaccaccttcccccaaggctttccattcgcagaccctcccctttatggccacccggataggcaccttcaggatggacctgggcatcatcttggaccagccaggtatggaatcgtccccttattgagactctgcacggacaagggccctagagattgaccctgcagtgactccgcatggacccctatacactcacttcggagagggccatctctggcggaggctgaactcttggcacttccgcccctccctgctgagccagagaagccctggccattgtccgtcactccgatagcctcacggccaccctgtgcgtcccgccggtcgccccttacccctggctcgccccttcgcccttagatggccagttctaccaaagatgggttccgctgcatgatccccgagacacccgcgccgggaccaagggtttcattaaggtcaccttgtccgtgagggcgcgcggggacctgccccctccaatgctacccccggccccagggcactgttcggacatcgagaagtgagccgggatgaggtggggaggaggacatggatccgggggtggccgtggggcgcggataaggggaggggccgagatcccagtttctccccccccgctcggtgccccctcccctaggaacctgctcctgccgcgcggggtgcccgccgagaggccatgggcgcggctccgcgtgcgcctgtaccgcgccgaggggcttcccgcgctgcgcctggggctgctgggcagcctggtccgcgccctgcacgaccagcgcgtcctggtggagccctatgtgcgggtgtctttcctggggcaggagggcgagacgtcggtgagcgccgaggcggcggcgcccgaatggaacgagcagctgagcttcgtggagctcttcccgccgctgacgcgcagcctccgcctgcagctgcgggacgacgcgcccctggtcgacgcggcactcgctacgcacgtgccggacctgaggcggatctcccatccgggccgcgcggcggggtttaaccctaccttcggcccggcctgggtgcccctctatggctcgccccccggcgcggggctccgggatagtcttcaaggtctcaacgaaggcgttggccaaggcatttggttccgcggccgccttctgctggctgtgtccatgcaggtgttggaagggagagctgaacctgagcctccccaggcccagcaggggtccacgttgtcccggctcacccgaaagaagaaaaagaaagccagaagggatcagaccccaaaggcggttccgcagcacttggacgccagccccggtgccgaggggcctgagatcccccgtgccatggaggtggaggtggaggagctgctgccgctgccagagaatgtcctggcgccctgtgaagatttcctgcttttcggtgtgctcttcgaggccaccatgatcgaccccaccgtggcctcccagcccatcagcttcgagatctccattggtgtgtggcctagccgaacccctgagtgccatttcagaccttagaaccctggaaggggtgttgactttcagtaaggggcaggttctgacttctgttgaggcagaggtggttgagggggggttccagccctcagcctggcgcccactgacccttgctgctctggggcaggtcgcgcaggccgtctggaggagcaattgggccgagggtccagggctggggagggaactgagggtgcagccgtggaggctcagcctctgctgggagccaggccagaggaggagaaagaggaggaagaactggggacccatgctcagcggcctgagcccatggacggcagtgggtgagtgctgccggtggctggaagggggggtttgggaggtctccaggaacccagaatgcccgc

SEQ ID NO: 27373 - DNA, 2691 bp, Homo sapiens
gcagaggaagtgccagtgccactgggaccatggctctgacggtaacgcgtgcaacgactaacagggctgaccggcacccacgaccgacaagtgaagctcacctttcgaggctttacccagaaaacaagaaaaattcactgtggtccagaagcagatatcggtgagctgttccgatggccccactatggggctccactggctggggagtgtctgtctgtgcaggtggtcaactgcagccgtgtattcagccttaggcctctagggaccctggtgatctccctgcagcagctacagaatgctgggcatttggtgctacgggaagccctagtggatgagaatcttcaagtgtccccgatccaggtggagcttgacctgaagtaccagcccccagagggcgctactggagcctggtcagaggaggactttggggcacccatccaggacagcttcgagttaatcatccccaatgtgggcttccaggaactggagcctggggaggcccagctggagcggcgggcagtggctctaggccgcaggctagctcgaagtctaggccagcaggacgatgaagagaatgagctggagcttgagctggagcaggacctggatgatgagcctgacgtggaactttctggtgttatgttcagccccctcaagagccgcgccagggccctggcccatggggatcccttccaggtgtccagagctcaagacttccaggtgggagtcactgtgctggaagcccagaaactggtgggagtcaacattaacccctatgtggccgtgcaagtgggggggcagcgccgtgtgaccgccacacagcgtgggaccagttgccccttctacaatgagtacttcttgttcgaatttcatgacacgcggcttcgtctccaagacttgctgctggagatcacggtgagtggggtaggggtgaccagtgtccttcagagaaggggggatgagaaagctgcaggactaacaccaccttcccccaaggctttccattcgcagaccctcccctttatggccacccggataggcaccttcaggatggacctgggcatcatcttggaccagccaggtatggaatcgtccccttattgagactctgcacggacaagggccctagagattgaccctgcagtgactccgcatggacccctatacactcacttcggagagggccatctctggcggaggctgaactcttggcacttccgcccctccctgctgagccagagaagccctggccattgtccgtcactccgatagcctcacggccaccctgtgcgtcccgccggtcgccccttacccctggctcgccccttcgcccttagatggccagttctaccaaagatgggttccgctgcatgatccccgagacacccgcgccgggaccaagggtttcattaaggtcaccttgtccgtgagggcgcgcggggacctgccccctccaatgctacccccggccccagggcactgttcggacatcgagaagtgagccgggatgaggtggggaggaggacatggatccgggggtggccgtggggcgcggataaggggaggggccgagatcccagtttctccccccccgctcggtgccccctcccctaggaacctgctcctgccgcgcggggtgcccgccgagaggccatgggcgcggctccgcgtgcgcctgtaccgcgccgaggggcttcccgcgctgcgcctggggctgctgggcagcctggtccgcgccctgcacgaccagcgcgtcctggtggagccctatgtgcgggtgtctttcctggggcaggagggcgagacgtcggtgagcgccgaggcggcggcgcccgaatggaacgagcagctgagcttcgtggagctcttcccgccgctgacgcgcagcctccgcctgcagctgcgggacgacgcgcccctggtcgacgcggcactcgctacgcacgtgccggacctgaggcggatctcccatccgggccgcgcggcggggtttaaccctaccttcggcccggcctgggtgcccctctatggctcgccccccggcgcggggctccgggatagtcttcaaggtctcaacgaaggcgttggccaaggcatttggttccgcggccgccttctgctggctgtgtccatgcaggtgttggaagggagagctgaacctgagcctccccaggcccagcaggggtccacgttgtcccggctcacccgaaagaagaaaaagaaagccagaagggatcagaccccaaaggcggttccgcagcacttggacgccagccccggtgccgaggggcctgagatcccccgtgccatggaggtggaggtggaggagctgctgccgctgccagagaatgtcctggcgccctgtgaagatttcctgcttttcggtgtgctcttcgaggccaccatgatcgaccccaccgtggcctcccagcccatcagcttcgagatctccattggtcgcgcaggccgtctggaggagcaattgggccgagggtccagggctggggagggaactgagggtgcagccgtggaggctcagcctctgctgggagccaggccagaggaggagaaagaggaggaagaactggggacccatgctcagcggcctgagcccatggacggcagtgggtgagtgctgccggtggctggaagggggggtttgggaggtctccaggaacccagaatgcccgc

SEQ ID NO: 27374 - DNA, 2610 bp, Homo sapiens
tcttagtcctttcatttattattccccagcttcgagttaatcatccccaatgtgggcttccaggaactggagtaagtatgtggggatgacctggagtcactgagtcagtcttggagttaggagccagtgatatgggggcagccccagggtcttgggtcagaactgaatcagttccagggtcagaggtcagtcctagaatcagaggtcagttctggaattagaaatgtcccagggttaagagtctgtcctgggatcagtgaagtcagccacaaggtcaataactggtcctaggatcagtgggatcagttcaagggtcaggggtcagtccaaggctccaggaagtcaagggattgcctggagatgggtgatgggttccaggcatgtcccttgagggtctttcctatcaggcctggggaggcccagctggagcggcgggcagtggctctaggccgcaggctagctcgaagtctaggccagcaggacgatgaagagaatgagctggagcttgagctggagcaggacctggatgatgagcctgacgtggaactttctggtgttatgttcagccccctcaagagccgcgccagggccctggcccatggggatcccttccaggtgtccagagctcaagacttccaggtgggagtcactgtgctggaagcccagaaactggtgggagtcaacattaacccctatgtggccgtgcaagtgggggggcagcgccgtgtgaccgccacacagcgtgggaccagttgccccttctacaatgagtacttcttgttcgaatttcatgacacgcggcttcgtctccaagacttgctgctggagatcacggtgagtggggtaggggtgaccagtgtccttcagagaaggggggatgagaaagctgcaggactaacaccaccttcccccaaggctttccattcgcagaccctcccctttatggccacccggataggcaccttcaggatggacctgggcatcatcttggaccagccaggtatggaatcgtccccttattgagactctgcacggacaagggccctagagattgaccctgcagtgactccgcatggacccctatacactcacttcggagagggccatctctggcggaggctgaactcttggcacttccgcccctccctgctgagccagagaagccctggccattgtccgtcactccgatagcctcacggccaccctgtgcgtcccgccggtcgccccttacccctggctcgccccttcgcccttagatggccagttctaccaaagatgggttccgctgcatgatccccgagacacccgcgccgggaccaagggtttcattaaggtcaccttgtccgtgagggcgcgcggggacctgccccctccaatgctacccccggccccagggcactgttcggacatcgagaagtgagccgggatgaggtggggaggaggacatggatccgggggtggccgtggggcgcggataaggggaggggccgagatcccagtttctccccccccgctcggtgccccctcccctaggaacctgctcctgccgcgcggggtgcccgccgagaggccatgggcgcggctccgcgtgcgcctgtaccgcgccgaggggcttcccgcgctgcgcctggggctgctgggcagcctggtccgcgccctgcacgaccagcgcgtcctggtggagccctatgtgcgggtgtctttcctggggcaggagggcgagacgtcggtgagcgccgaggcggcggcgcccgaatggaacgagcagctgagcttcgtggagctcttcccgccgctgacgcgcagcctccgcctgcagctgcgggacgacgcgcccctggtcgacgcggcactcgctacgcacgtgccggacctgaggcggatctcccatccgggccgcgcggcggggtttaaccctaccttcggcccggcctgggtgcccctctatggctcgccccccggcgcggggctccgggatagtcttcaaggtctcaacgaaggcgttggccaaggcatttggttccgcggccgccttctgctggctgtgtccatgcaggtgttggaagggagagctgaacctgagcctccccaggcccagcaggggtccacgttgtcccggctcacccgaaagaagaaaaagaaagccagaagggatcagaccccaaaggcggttccgcagcacttggacgccagccccggtgccgaggggcctgagatcccccgtgccatggaggtggaggtggaggagctgctgccgctgccagagaatgtcctggcgccctgtgaagatttcctgcttttcggtgtgctcttcgaggccaccatgatcgaccccaccgtggcctcccagcccatcagcttcgagatctccattggtcgcgcaggccgtctggaggagcaattgggccgagggtccagggctggggagggaactgagggtgcagccgtggaggctcagcctctgctgggagccaggccagaggaggagaaagaggaggaagaactggggacccatgctcagcggcctgagcccatggacggcagtgggtgagtgctgccggtggctggaagggggggtttgggaggtctccaggaacccagaatgcccgc

SEQ ID NO: 27375 - DNA, 1630 bp, Homo sapiens
tcttagtcctttcatttattattccccagcttcgagttaatcatccccaatgtgggcttccaggaactggagtaagtatgtggggatgacctggagtcactgagtcagtcttggagttaggagccagtgatatgggggcagccccagggtcttgggtcagaactgaatcagttccagggtcagaggtcagtcctagaatcagaggtcagttctggaattagaaatgtcccagggttaagagtctgtcctgggatcagtgaagtcagccacaaggtcaataactggtcctaggatcagtgggatcagttcaagggtcaggggtcagtccaaggctccaggaagtcaagggattgcctggagatgggtgatgggttccaggcatgtcccttgagggtctttcctatcaggcctggggaggcccagctggagcggcgggcagtggctctaggccgcaggctagctcgaagtctaggccagcaggacgatgaagagaatgagctggagcttgagctggagcaggacctggatgatgagcctgacgtggaactttctggtgttatgttcagccccctcaagaggtaacttgtacccacggcacacctgctcccacacccatctgccctcacaaacacacagtcccagggggtgtgggaagggtggattctccgtcacttgctcataggcatagacactgccatgttcatacacatagttacagtggctcacacacatgcaggggatgaaagcttgatgagggcaagatttgtctcttcactacagcgtcccagtgcttgggacagtgttagctcatagtaggtactcaataaacctctgttgcatgaatgaatggtttcgggctccaggaatgagtcaaattgtgggtgcagggttgagatggaggcagcaagacatgacctgaaggaccggggtttaaccctaccttcggcccggcctgggtgcccctctatggctcgccccccggcgcggggctccgggatagtcttcaaggtctcaacgaaggcgttggccaaggcatttggttccgcggccgccttctgctggctgtgtccatgcaggtgttggaagggagagctgaacctgagcctccccaggcccagcaggggtccacgttgtcccggctcacccgaaagaagaaaaagaaagccagaagggatcagaccccaaaggcggttccgcagcacttggacgccagccccggtgccgaggggcctgagatcccccgtgccatggaggtggaggtggaggagctgctgccgctgccagagaatgtcctggcgccctgtgaagatttcctgcttttcggtgtgctcttcgaggccaccatgatcgaccccaccgtggcctcccagcccatcagcttcgagatctccattggtcgcgcaggccgtctggaggagcaattgggccgagggtccagggctggggagggaactgagggtgcagccgtggaggctcagcctctgctgggagccaggccagaggaggagaaagaggaggaagaactggggacccatgctcagcggcctgagcccatggacggcagtgggtgagtgctgccggtggctggaagggggggtttgggaggtctccaggaacccagaatgcccgc

SEQ ID NO: 27376 - DNA, 408 bp, Homo sapiens
ccgcccccagggctcaggctgcgtcccccgaggccgggctcccgcgatttccagctccttggggcgctgagctgttttggaggcgccccaggtcgtgttccacagcggcgcgtccgcagctgctggccaacttcttccgtttcagagcggcttagcccccctcccctgccctcacccccgaatacttggaggagatcagggtgaggtgcagagatttaccagcactcgccctccccacgctcccctccaacacgcttctcttgttccccacagcggggtttcggggtttaaccctaccttcggcccggcctgggtgcccctctatggctcgccccccggcgcggggctccgggatagtcttcaaggtctcaacgaaggcgttggccaaggcatttggttccgcggccg

SEQ ID NO: 27377 - DNA, 449 bp, Homo sapiens
taggggctgggagagggtaccacaggggagtatgatctacttgggggccagagaaggttccctgaggaaatagtacctgaacttagacttgaaggataacagatgttaactgggaggagagaatgttccaggcagaggaaaaggcatatgcaaaagtccagcgccttgaaggagcacagctggggtgcctggagtgagatggagctggaaaggttggtggggccagaccaggcagagtagtgaaggccaccgtaagggatttccaacaaaaatgagacaattttggaatcctgttgggcctcaagaggtaacttgcggctgggcacaatggctcatgcctgtaatcccagcactttgggaagctaaagcagaaggatcatttgagctcaggagctcaagaccaacctgggcaaggtacataataagacctcatcaatactaaaaaaaaa

SEQ ID NO: 27378 - DNA, 421 bp, Homo sapiens
gccgccttctgctggctgtgtccatgcaggtgttggaagggagagctgaacctgagcctccccaggcccagcaggggtccacgttgtcccggctcacccgaaagaagaaaaagaaagccagaagggatcagaccccaaaggcggttccgcagcacttggacgccagccccggtgccgaggggcctgagatcccccgtgccatggaggtggaggtggaggagctgctgccgctgccagaggtgggggctggggggtagcaaagggggcggggtcacctcagctctggaaggtggaatccactctcaggcattaaacaccacgacaggggtctcaatttgggggcctgggcgaagagtgaggtgtgtgcccacatgggctctggtatatgcacacatgttgtgggagagaggacccataccca

SEQ ID NO: 27379 - DNA, 291 bp, Homo sapiens
tctgtgatttagtgaccttttagtgcagatacctacttgataaatccttttggctggcacttcccagacttcattttcatataccagtaaaaatattctgttttttaattcagcagtgaaaaagtgtagggagtggagggagaaaatagagaaaaaggcaataaaacatagttctgccacatttttatttttcaaataataaaatgttttataaacctgccatttaccattaacattaaaaaatagaacacttaacaaaaaaaagtaggaaaaagaacatcatgttaaaat

SEQ ID NO: 27380 - DNA, 472 bp, Homo sapiens
ttgagacggagtctctgtcgcctaggctggagtggagtggcccaatcttggctcactgcaacctccgcctcccaggttgcagccattctcctgcctcagcctcccggagtagctgggactacagacatgtgccaccatgcctggctaattttttgtgtgtttttagtagagatggggtttcaccatgttggccaggccggtctcgaactcctgacctcaggtgatctgcccatctctgcctcccaaagtgctgggattacaggagtgagccaccgtgcccagctggtgttaacagataattcatcttagtctacccatgccttgtcctgaactctaagttttacttttcaggttttatggctaggaatttaatgtcatgtcttctgtttttctttgtttgtttgagacagggtctggctctgtcacccaggctggagtgcggtggcacggtcatggctcactgcaacctcca

SEQ ID NO: 27381 - DNA, 408 bp, Homo sapiens
caaaccatacatgctttcttgctgcctgtagactgttccctcaggttatacctaactgtgtctctgttcacaaatttagtctagtcacttttgccacaacatataagagatagaggagagtgtaggtcccctcagtcctcctggtctctggaattgcagaggagtagttaatcaaaatgaaataatgcctccaaaaagttaaatcatcagaaccaaaacttactttggggctagataattcatcttagtctacccatgccttgtcctgaactctaagttttacttttcaggttttatggctaggaatttaatgtcatgtcttctgtttttctttgtttgtttgagacagggtctggctctgtcacccactgcactccatcctgggcgacagagcaagactccatctca

SEQ ID NO: 27382 - DNA, 626 bp, Homo sapiens
ggcatggtggtgcacactgtaataccagctactcgggaggctgaggagggagaatcgcttgaacctgagaggcggaggttgcagtaagccaagatcgcaccactgcactccagcctgggtgacagagctagactccgtctcaaaaaaacaacaaaaaaatcctgtttttgctggttttaaatattgcttttgccacactcatcaaaagtcttattgataaatcaatatattcagtcctcttatttgatctctctgcagcatctgactaccacctagcagtcattctctattcctttttgcaggtagtctttcctcctcttttttcctgtaccttgcatgcatcttatctactattcaaatcttacccattacatttgtgaaatatctctggagtctttccattcctcctctctaccttcactgtctcagttcagaccctcaatatctctcacctaaacaactctggttgcctcctgactggcctttctgcctttggtttcactctgctcaaatccatgctccccattacttagagttatcttttgaagaatgcaaaccagatcaattcacattcatgttcaaatcttaaataagcatttcttcaaaccttctacttcgcataataa

SEQ ID NO: 27383 - DNA, 367 bp, Homo sapiens
caataaaagatatttatgcagataaaatatataatccaaaggaaaatgcaagtcacaaatctttatcaaaataggtttgaaatacatatgacaaaaactatttgtctctaatatagactatggatttgccaaattttccttttatttaactaattctccatagaaattaacagaccaagtgaaccaaaaaactctgtaaagaaaggaggatttgaataacaatgctaagcataattgtatagacataaaatgtacccaatatatgaaaacacatattctttataaatactgactttaagaagactgactaaaatctactacaaaattggccatgttcaaggcctcaaagactacttggtaacctcca

SEQ ID NO: 27384 - DNA, 689 bp, Homo sapiens
aatctttttttatgtctttattaaagtaaactactttggctcacctggctagttcagtcagtaaagcatgagacactgaaagtaaactacttggatttgtataattcagaattaaagggacagtagaaatgttgtgttgttctgtgttaattgtgtaattgtggagctactttgttaaagtagaggtgggaggctcagagtattgtcttctgatccgtttctgttgtgtgtttcttagaacttgataagcacagggttaagaatagccaaggcaatctaggaagaagggacaaggtaggcttgctttataggaaagaaagccctgtcaaaaaactgtagtaattaagacattgtggtgttgaatatagcgatagacaattagacgaatggcacaaaacagaggaaatagagctacccgtatcagaaacttaacatatatgacaaaggtgctattgaaagcatgggccagaataaatcattattaacatgaaaaaaaatactagatccttataaaaaccacacaaaacacatctccagatggattaaatacctaaatttaaaaggcaatttgtttgtttttagaaaaaattctaaaacaattttatgacctttagctagggaagaatgaggcaccaaaagttgagttcagtagttttgtagtttaaaattttgagattctaaagaaaaca

SEQ ID NO: 27385 - DNA, 1407 bp, Homo sapiens
ggagatttcaggggagttacgggtggagggaggacatcagatctaccctggaagttaaacgtgtttcgagtgcattaaatactatgggccacagacgccttgtctccatatctactcttttataaatgaagtaaagttcttgggaaatacttttctcactctaaagctcacaatctatcttgcaaaaaatattttaaattccatctcaaataagccagggtgaaaagggagcctgtgcaccagacactgccagccttgcctggctctcgccttcttgctcttccttccccacctgctggggattttcttaacgatggagatgggtttgggtttgtcctgctgtgctctgctccccattcccggatccaaggtcctgcctctgtcctgtcccctgagccacctcagggatgcagggtcccccacctggtcaagtgcccagtgctgtgttgtcatttgcaagttcttcctgtgactgaactccaaatggcactgggactgctgactccacccactggacaacccgtgttcttgcttttggggtttctgaaacagccccaagactctgggcatcttgattttgctcccattgcttctcaggacaccctgctcctgtggtttgcagccccggccttctcttcgaggacgcctctgctcttctgcctcacactcggattggaccttcttcagcacagccagtggccgaggcttcctccctggggctcagtggagcaggacagatgctgcatccaaactcttccattgggttccagtctgttccagtcatgcccttgagcctctaaagctcctaggtgagagacgtagcagctgacagcacttcccacttgatttgggtggactccagcctccccagcaacaataagagatcaaaagcatcgttgaggaagcagcttgctgaaacgctgagtgcccgccactctcaggtcaggtgggaccggcaggccagcatgagttcctgaacacttggttctcaatactggccacagccacactgtaaggggaaacaagagggcgctgtatgcaaacatctcttgaactctggagtctgctcaccttcctgcctcaagcccctctcccacgtggtccagtcaccattctccacagagactaccctaaaacccagcgactctcgtgtgcctgcagaatggcacagcccgttctcatagcagcactcctgtttaatcagagggatgttaacgaccaagtcatatttgctcgatttgtgttcaatatatttcatttgtaccgataaaacttaaaaatatccccacacatgcattgcctattaaagagtatcttccaggtacacctcccttacacatcagttaacttgataatttcttcccattcttgtgcaataaatttccttcctgatcagaaaatgtccag

SEQ ID NO: 27386 - DNA, 1512 bp, Homo sapiens
tatttatttatttatttatttttgcactccagcctgggcaacggagtgagactccatctcacaaaaaagagaaaagaaaagaaaactttgcttcactaagtttctcttgccattatctcattaattcagatctgtacctcattgctgctcacacatatatgtttcttaccttagcctgaaccttctcaggccttgaagtcattattctactctttttttttcttttccttttttatggcactagagaatgaaaacctaaggtcttagaaaatcttaacttgaaaaagtctctaactggcatgatttgattacttttttcccctgtggacaaataattttctttcctatataatagatttttagtaagtgaaacctttgctgctgctttcctgggtttacattagttttttcctgcccttaagaataatttatctgtgcttctctgatgactgttaatttctaatagtgcaggaagggatgagcttttgatttcttctcactcccctcctcaccctacttccaaattacacactaacttctaactcttacagcctgttggcacatacacaagatccacgagaccatgctcctcagaagctacccatgtcctttctcaccatggtgtggctcttggagccctgagtatctgtgactacccactccaaaggttgactgtaagaggagagcggccttcttaattttgcatttcttaattttgtttttctccattcctgttttatgacttggccttcagatgcttcctactctggcctcctccttttttctcctaggaattgtttccaggtaacctaccatgtgcacttctcagctgctctgctcacctttgcccaccttcccgtgaccctgagagtacagatccgaataatgtggcctgtgcagagctcagagaactgtgaggactacccatgcctgtcagactctgctcagggacagagatggatgggtaaatggtgctgttggagacatttttatcttcataccaggctctgtttcatccctgcaccccgcacccccactcactcccctgagggggtaaaatgcagaggtggttgacctgaagggtctgattccctccttcccaagccttagggcctaccctggagtgctgcagtgtgtgagagctgctgcttgcttgtttctccactaggcctgctccaaatgcttagccaatctctggagccgacacagttgcctacggggtgacttagcaccaggttccattagctctccaagtgactgtttccacccagtacttttggcgcttgaggatggggggagggggattatttaaaataaataaaatccgaggtggcagtagaggattccttttgctttaaaaatctttggactaaaaaaaaaaaaaaaaagttttttatatataaatatataaagtaaattgttatgtaactattattgtttcttgtatgttctaattttgttttatgatgtaattaaagaaagtaagctgtgaagacttttcattttcctgtg

SEQ ID NO: 27387 - DNA, 444 bp, Homo sapiens
aggccgaggcgggcggatcacaaagtgtcaggagtttgagaacagcctggccaacatggtgaaaccccatctctactgaaaatacaaaatcccagctacttgggaggctgaggcaagagaatcgcttgaacctgggaggcggatgttgcagtgagccgagatcacgccactgcactccagcctgggcaacggagtgagactccatctcacaaaaaagagaaaagaaaagaaaactttgcttcactaagtttctcttgccattatctcattaattcagatctgtacctcattgctgctcacacatatatgtttcttaccttagcctgaaccttctcaggccttgaagtcattattctactctttttttttcttttcccatttctatctctgcctgactttgtctgttcgtctgtctctctgtctgcctgcctctatgtcattttc

SEQ ID NO: 27388 - DNA, 1660 bp, Homo sapiens
aggccgaggcgggcggatcacaaagtgtcaggagtttgagaacagcctggccaacatggtgaaaccccatctctactgaaaatacaaaatcccagctacttgggaggctgaggcaagagaatcgcttgaacctgggaggcggatgttgcagtgagccgagatcacgccactgcactccagcctgggcaacggagtgagactccatctcacaaaaaagagaaaagaaaagaaaactttgcttcactaagtttctcttgccattatctcattaattcagatctgtacctcattgctgctcacacatatatgtttcttaccttagcctgaaccttctcaggccttgaagtcattattctactctttttttttcttttccttttttatggcactagagaatgaaaacctaaggtcttagaaaatcttaacttgaaaaagtctctaactggcatgatttgattacttttttcccctgtggacaaataattttctttcctatataatagatttttagtaagtgaaacctttgctgctgctttcctgggtttacattagttttttcctgcccttaagaataatttatctgtgcttctctgatgactgttaatttctaatagtgcaggaagggatgagcttttgatttcttctcactcccctcctcaccctacttccaaattacacactaacttctaactcttacagcctgttggcacatacacaagatccacgagaccatgctcctcagaagctacccatgtcctttctcaccatggtgtggctcttggagccctgagtatctgtgactacccactccaaaggttgactgtaagaggagagcggccttcttaattttgcatttcttaattttgtttttctccattcctgttttatgacttggccttcagatgcttcctactctggcctcctccttttttctcctaggaattgtttccaggtaacctaccatgtgcacttctcagctgctctgctcacctttgcccaccttcccgtgaccctgagagtacagatccgaataatgtggcctgtgcagagctcagagaactgtgaggactacccatgcctgtcagactctgctcagggacagagatggatgggtaaatggtgctgttggagacatttttatcttcataccaggctctgtttcatccctgcaccccgcacccccactcactcccctgagggggtaaaatgcagaggtggttgacctgaagggtctgattccctccttcccaagccttagggcctaccctggagtgctgcagtgtgtgagagctgctgcttgcttgtttctccactaggcctgctccaaatgcttagccaatctctggagccgacacagttgcctacggggtgacttagcaccaggttccattagctctccaagtgactgtttccacccagtacttttggcgcttgaggatggggggagggggattatttaaaataaataaaatccgaggtggcagtagaggattccttttgctttaaaaatctttggactaaaaaaaaaaaaaaaaagttttttatatataaatatataaagtaaattgttatgtaactattattgtttcttgtatgttctaattttgttttatgatgtaattaaagaaagtaagctgtgaagacttttcattttcctgtg

SEQ ID NO: 27389 - DNA, 1606 bp, Homo sapiens
aggccgaggcgggcggatcacaaagtgtcaggagtttgagaacagcctggccaacatggtgaaaccccatctctactgaaaatacaaaatcccagctacttgggaggctgaggcaagagaatcgcttgaacctgggaggcggatgttgcagtgagccgagatcacgccactgcactccagcctgggcaacggagtgagactccatctcacaaaaaagagaaaagaaaagaaaactttgcttcactaagtttctcttgccattatctcattaattcagatctgtacctcattgctgctcacacatatatgtttcttaccttagcctgaaccttctcaggccttgaagtcattattctactctttttttttcttttccttttttatggcactagagaatgaaaacctaaggtcttagaaaatcttaacttgaaaaagtctctaactggcatgatttgattacttttttcccctgtggacaaataattttctttcctatataatagatttttagtaagtgaaacctttgctgctgctttcctgggtttacattagttttttcctgcccttaagaataatttatctgtgcttctctgatgactgttaatttctaatagtgcaggaagggatgagcttttgatttcttctcactcccctcctcaccctacttccaaattacacactaacttctaactcttacagcctgttggcacatacacaagatccacgagaccatgctcctcagaagctacccatgtcctttctcaccatggtgtggctcttggagccctgagtatctgtgactacccactccaaaggttgactgtaagaggagagcggccttcttaattttgcatttcttaattttgtttttctccattcctgttttatgacttggccttcagatgcttcctactctggcctcctccttttttctcctaggaattgtttccaggtaacctaccatgtgcacttctcagctgctctgctcacctttgcccaccttcccgtgaccctgagagtacagatccgaataatgtggcctgtgcagagctcagagaactgtgaggactacccatgcctgtcagactctgctcagggacagagatggatgggtaaatggtgctgttggagacatttttatcttcataccaggctctgtttcatccctgcaccccgcacccccactcactcccctgagggggtaggcctaccctggagtgctgcagtgtgtgagagctgctgcttgcttgtttctccactaggcctgctccaaatgcttagccaatctctggagccgacacagttgcctacggggtgacttagcaccaggttccattagctctccaagtgactgtttccacccagtacttttggcgcttgaggatggggggagggggattatttaaaataaataaaatccgaggtggcagtagaggattccttttgctttaaaaatctttggactaaaaaaaaaaaaaaaaagttttttatatataaatatataaagtaaattgttatgtaactattattgtttcttgtatgttctaattttgttttatgatgtaattaaagaaagtaagctgtgaagacttttcattttcctgtg

SEQ ID NO: 27390 - DNA, 704 bp, Homo sapiens
gacagcccagctgtgctgtggaaagacaaagtggagttttgcacttgagcacaaatgttcccctacaatctctccagtttcggtcagcccaaccctgtggcaccatgggtacagcctagagcatcacccccacagaggcttcgggacggtcctgctggactgctggacgctgctgtggggtcttggggcaggaggggcttccagaagcctggcagttgctgtctggaggccaggaagccaagcccaggaagcccacctgcggctgagttcagaggtggggcctgtgcgttgtgaatgaattgctgtctctctcctcctcatcttgcactaaatctacataacttaaaatttaccattttagccatttttaagtgcacggttctgtggcattaggtacattcgcattgtgcagccaccgccaccctccgccttcagaactttctcatcttcccaaaccgaagctctgtgctcattaaaggctagctcccccgttgctctcccccagccccggcaaccccattccactttgtgtctcgaccataagtgtggctgctctgggaccagtgccagtgggcgcacgctgggtttgcctacgtctggcttacttcactcagcagagtgtccttcggttttatcagttttgtcacaagtgtcagcatttttctcatttttaaggctgaataaaatattgtgtggataagcca

SEQ ID NO: 27391 - DNA, 471 bp, Homo sapiens
tcatacctagcttggcccttctcatatccttgggaggcagtttgctccaagagatgcatcttgctttcagaacacattcccattgacttttttttttaaacacaaaacaatcatttattgttgactgagctcaggaggtggttctcactgggggtctcttgtgaggatgcaataagacattgatgggaggtgcagtcatctcaaaggctgtctgttgatgctgtctgtttgccaggacctccactggggctgaggactagaatgaatatactcagcctctccattgttgcctgggtttcttcacaacatggcagcagggattgaagagcaagcgtcccaagagagagccaggctaaagtacctttcatagtctagccttggaacacatgcagtgtcacttgtgctgttttctgttgtcttccttagaaatgtgtccctaagtccaggccatattcaagactaggggaatag

SEQ ID NO: 27392 - DNA, 1624 bp, Homo sapiens
aacaggcactcctcctcactgtccagtcacctgacgtgctttttctgcgcactcaggtcgtgacaccccaggaggtgcctatcgcgccccaagctcctcacgtgcctcctccccacagtccaggacgcgtcttactaacgcctcaccagagcgcatgcgccctcctcaggagcagcctcaaagcgcgcagcctcagcccattggcctgcgggaagtggagttcccgaacagaagcccctcagtctccggaagccccgcccggcagactgttcccaggatgcaacacgggctcgcgtctaaaagagctgtgctttgttggggctatctgggagtttccgccttccatgaagtgcgcaggcgcacttaggcgaggcggggcgactctaggaagtggagacatcaagagtggtactggaagtggcggaagctctcctcttgccctcttcagcttccggtgtggtgggtcccggatatcgcgtggctgtggcaggtagacagcccgtgctccagaggccttcatcttgtgatggcagatgtacttgagtagacacgacagacggggaaggaccctgatggtccgagggaccttccacagcaagtagaaggcactgctgtgaatatgatggcgtcagaggtgactgcaaaaaaggacagggcagctgggcgaggaagagataccagtgatgtcctaactgagctccctgggtctggtagtgaggagctcagtcttagaatatgagccgtgtcaggggctacagcatcatcactcttgtcctgtcgcagactcaggctccctgttctcaggttcttatgtagacagtgagggctcagggaggctcccaccaccgccaccaccagcaccaccactccatcaaaacggctgaaggaccttcctttagggttcgggggatctcctccttccacaagggatggatgtgaagacaactcattctttgatgttcagatggttgtggccctctgatgagatttttgcacaccttgccaaatgcatatgtctgttgagcctggacattaagtatttcttgatgttcttctgtgtaacaggtgatgtcctaggtgctgcagtgaacagaagagacaaaatatccttgttcccttgaagctaatgtcgtaggggcccaaaacaaagcaaacaaacaaaaaaaaggaatgcaagtcaagtacactttgtatggacagtggtaattcctaagaaggaaaacaaagatgggcttaaggggtgcagagggcctggactatgtgtgtctgtgggatagtctgttactacctctgggactctcatctcgtgagtgtgcttgggtgtgtccaaccgtttttcctagtgacaaagtctgggtaattctgtggggacatatattggtgtatctgggaggtcccatgtgtctcagtggtggtccctgttttcaggaaagagtgtctgtgaatgtccatgtgtctcactgcacagctgtgatttttctgtgtctctgtgttttccagtctttgtgtgatgaaatataaaggcctagcaggctcagagttattaatgaattgtacttaagcgttgagaggcatatatttattgcactattaaattcttccaaaatatagttaaaaaaaaaag

SEQ ID NO: 27393 - DNA, 1344 bp, Homo sapiens
  misc_feature (1069)..(1069): n is a, c, g, or t
  misc_feature (1077)..(1078): n is a, c, g, or t
  misc_feature (1173)..(1173): n is a, c, g, or t
atggaccaccaggacccctactccgtgcaggccacagcggccatagcggcggccatcaccttcctcattctctttaccatcttcggcaacgctctggtcatcctggctgtgttgaccagccgctcgctgcgcgcccctcagaacctgttcctggtgtcgctggccgccgccgacatcctggtggccacgctcatcatccctttctcgctggccaacgagctgctgggctactggtacttccggcgcacgtggtgcgaggtgtacctggcgctcgacgtgctcttctgcacctcgtccatcgtgcacctgtgcgccatcagcctggaccgctactgggccgtgagccgcgcgctggagtacaactccaagcgcaccccgcgccgcatcaagtgcatcatcctcactgtgtggctcatcgccgccgtcatctcgctgccgcccctcatctacaagggcgaccagggcccccagccgcgcgggcgcccccagtgcaagctcaaccaggaggcctggtacatcctggcctccagcatcggatctttctttgctccttgcctcatcatgatccttgtctacctgcgcatctacctgatcgccaaacgcagcaaccgcagaggtcccagggccaagggggggcctgggcagggtgagtccaagcagccccgacccgaccatggtggggctttggcctcagccaaactgccagccctggcctctgtggcttctgccagagaggtcaacggacactcgaagtccactggggagaaggaggagggggagacccctgaagatactgggacccgggccttgccacccagttgggctgcccttcccaactcaggccagggccagaaggagggtgtttgtggggcatctccagaggatgaagctgaagaggaggaggaggaggaggaagagtgtgaaccccaggcagtgccagtgtctccggcctcagcttgcagccccccgctgcagcagccacagggctcccgggtgctggccaccctacgtggccaggtgctcctgggcaggggcgtgggtgctataggtgggcagtggtggcgtcgangggcgcanntgacccgggagaagcgcttcaccttcgtgctggctgtggtcattggcgtttttgtgctctgctggttccccttcttcttcagctacagcctgggngccatctgcccgaagcactgcaaggtgccccatggcctcttccagttcttcttctggatcggctactgcaacagctcactgaaccctgttatctacaccatcttcaaccaggacttccgccgtgccttccggaggatcctgtgccgcccgtggacccagacggcctggtga

SEQ ID NO: 27394 - DNA, 202 bp, Homo sapiens
tacaaatgaggtggtgttcatctctaaaatggtcatcaccagcatataagaaagctactgatttatacatgctcacctctcaacacatactttattgcattcttatttgtcaaatagtttttcagttgattttcttggattttttaggtgaacaattttactattctttgtgaatttatattcagcaaatgttaacagaata

SEQ ID NO: 27395 - DNA, 388 bp, Homo sapiens
agtgagtgtgtttaacaatagatgacccagagattatgctgtgaagaagccaagggcacacgaggaggctgcaagtagatgtccctgctgacagtcccttctgaaatcccagccaacagccagcagcaagcaccagttacatgagtgtggaagctccgggtgactccagcccagccaccaactaactgcaactccatgagaggtcctgcctaagaaccgcccagctgagcccagaaccagatgagattataataataaatgagtgttgatggtttatactaccaagtatgacatggcttgctatacagcaatacaaaaccagaggctcaccttaaaaataagtaactgtggctcaaggttatgaaatgacctgtccaaaggtgaaagg

SEQ ID NO: 27396 - DNA, 1025 bp, Homo sapiens
tcctcagatcgcgaccctgggagtggagtgggggcagcgtggttatgtggctggaccgccgcggatggctcagggttcttggacattggcgctacgaccttaggcgccctagctttaccaggacttggagtggcgataagggcccaatggcagaaacagtgtctacccaggttgggacagagggcgggctgagggcttcgcatcagcaaaacggtgacgctggtggcgacgcgaaggttgagctgtcccccgggcccccgaagccggctggccgggaagtggagccggccccagtaggcggggagcatccctcggctgcagccccaggcccgggcaagcataagaagcggcggggcgcaaccagggagcgtgtcgtgccgcccccgaagaagcggcggaccggggtgagcttcggagatgagcactttgcagaaaccagttattacttcgagggcggcctgcgtaaggtgcggccctattactttgacttccggacctactgcaaaggtcgctgggtgggccacagcttgctgcacgtcttcagtaccgagttccgagctcagcccctggcctactatgaggccgcggtccgggcgggccgcctgcaactcaacgagaagccggtgcaggacctcaacatcgtgctcaaggacaatgatttcttgcggaacacagtgcacaggcatgagccaccagtcacagcagagcccattcgcctgctagctgagaacgaagatgtggtggttgtagacaagccttcctccattcccgttcacccctgtggccgcttccgacacaacacagttatcttcatcctaggcaaggagcaccaactcaaggagctacaccccttgcatcggcttgaccgccttacctcaggggtgcttatgtttgccaagacagctgcagtctctgagagaattcacgagcaggttcgggaccggcaggtgagtcaggcttttgtctcctacaggccacttcttgggctcacgaatgctctgtgtcaaaagggcatcatggagttc

SEQ ID NO: 27397 - DNA, 773 bp, Homo sapiens
tcctcagatcgcgaccctgggagtggagtgggggcagcgtggttatgtggctggaccgccgcggatggctcagggttcttggacattggcgctacgaccttaggcgccctagctttaccaggacttggagtggcgataagggcccaatggcagaaacagtgtctacccaggttgggacagagggcgggctgagggcttcgcatcagcaaaacggtgacgctggtggcgacgcgaaggttgagctgtcccccgggcccccgaagccggctggccgggaagtggagccggccccagtaggcggggagcatccctcggctgcagccccaggcccgggcaagcataagaagcggcggggcgcaaccagggagcgtgtcgtgccgcccccgaagaagcggcggaccggggtgagcttcggagatgagcactttgcagaaaccagttattacttcgagggcggcctgcgtaaggtgcggccctattactttgacttccggacctactgcaaaggtcgctgggtgggccacagcttgctgcacgtcttcagtaccgagttccgagctcagcccctggcctactatgaggccgcggtccgggcgggccgcctgcaactcaacgagaagccggtgcaggacctcaacatcgtgctcaaggtggagtcctgatggggctggccagaagcgggcgaggaaaaggggccgggttttgttttgttttgttttgttttttagtcttagtaaagcataggtactggattaaaatcatggcaattctaa

SEQ ID NO: 27398 - DNA, 1623 bp, Homo sapiens
tcctcagatcgcgaccctgggagtggagtgggggcagcgtggttatgtggctggaccgccgcggatggctcagggttcttggacattggcgctacgaccttaggcgccctagctttaccaggacttggagtggcgataagggcccaatggcagaaacagtgtctacccaggttgggacagagggcgggctgagggcttcgcatcagcaaaacggtgacgctggtggcgacgcgaaggttgagctgtcccccgggcccccgaagccggctggccgggaagtggagccggccccagtaggcggggagcatccctcggctgcagccccaggcccgggcaagcataagaagcggcggggcgcaaccagggagcgtgtcgtgccgcccccgaagaagcggcggaccggggtgagcttcggagatgagcactttgcagaaaccagttattacttcgagggcggcctgcgtaaggtgcggccctattactttgacttccggacctactgcaaaggtcgctgggtgggccacagcttgctgcacgtcttcagtaccgagttccgagctcagcccctggcctactatgaggccgcggtccgggcgggccgcctgcaactcaacgagaagccggtgcaggacctcaacatcgtgctcaaggacaatgatttcttgcggaacacagtgcacaggcatgagccaccagtcacagcagagcccattcgcctgctagctgagaacgaagatgtggtggttgtagacaagccttcctccattcccgttcacccctgtggccgcttccgacacaacacagttatcttcatcctaggcaaggagcaccaactcaaggagctacaccccttgcatcggcttgaccgccttacctcaggggtgcttatgtttgccaagacagctgcagtctctgagagaattcacgagcaggttcgggaccggcagctggagaaggagtacgtgtgccgggtggaaggggagttccccactgaggaagtgacctgtaaagaacccatcttagtggtgtcttacaaagtaggggtgtgccgtgtagatccccggggcaagccctgtgagacagtgttccagaggctaagctacaatggccagtccagtgtggtacggtgccggccactcacaggccgcacacaccagattcgagtccaccttcagttcttgggccatcccattctcaacgaccccatctacaactcagttgcctggggtccttctcgaggccggggcggctacattcccaagacaaacgaggagttgctacgggacctggtagcagagcaccaggccaaacagagcctggatgtgctagatctctgtgagggtgacctgtccccaggactcacagactctacggccccctcctcagagttgggcaaggacgacctggaagagttggctgcagctgcccagaagatggagggattgcttcttgggttgtgacaaggatgggctatagggcaagggctgaccccatgggctagtacttggggtttctataggaatgaggacgggcttctaaagagacctgctcatacttgctacctccttccagtgggaatttggagactttttggtttgtaaatatatccctttttctaacatc

SEQ ID NO: 27399 - DNA, 1883 bp, Homo sapiens
tcctcagatcgcgaccctgggagtggagtgggggcagcgtggttatgtggctggaccgccgcggatggctcagggttcttggacattggcgctacgaccttaggcgccctagctttaccaggacttggagtggcgataagggcccaatggcagaaacagtgtctacccaggttgggacagagggcgggctgagggcttcgcatcagcaaaacggtgacgctggtggcgacgcgaaggttgagctgtcccccgggcccccgaagccggctggccgggaagtggagccggccccagtaggcggggagcatccctcggctgcagccccaggcccgggcaagcataagaagcggcggggcgcaaccagggagcgtgtcgtgccgcccccgaagaagcggcggaccggggtgagcttcggagatgagcactttgcagaaaccagttattacttcgagggcggcctgcgtaaggtgcggccctattactttgacttccggacctactgcaaaggtcgctgggtgggccacagcttgctgcacgtcttcagtaccgagttccgagctcagcccctggcctactatgaggccgcggtccgggcgggccgcctgcaactcaacgagaagccggtgcaggacctcaacatcgtgctcaaggacaatgatttcttgcggaacacagtgcacaggcatgagccaccagtcacagcagagcccattcgcctgctagctgagaacgaagatgtggtggttgtagacaagccttcctccattcccgttcacccctgtggccgcttccgacacaacacagttatcttcatcctaggcaaggagcaccaactcaaggagctacaccccttgcatcggcttgaccgccttacctcaggggtgcttatgtttgccaagacagctgcagtctctgagagaattcacgagcaggttcgggaccggcagctggagaaggagtacgtgtgccgggtggaaggggagttccccactgaggaagtgacctgtaaagaacccatcttagtggtgtcttacaaagtaggggtgtgccgtgtagatccccggggcaagccctgtgagacagtgttccagaggctaagctacaatggccagtccagtgtggtacggtgccggccactcacaggccgcacacaccagattcgagtccaccttcagttcttgggccatcccattctcaacgaccccatctacaactcagttgcctggggtccttctcgaggccggggcggctacattcccaagacaaacgaggagttgctacgggacctggtagcagagcaccaggccaaacagagcctggatgtgctagatctctgtgagggtgacctgtccccaggactcacagactctacggccccctcctcagagttgggcaaggacgacctggaagagttggctgcagctgcccagaagatggaggaagtagctgaggcagcccctcaggagttggacacaatagccttggcatcagagaaggcagttgaaacagatgtcatgaatcaagagacagacccactctgtgcagagtgccggctggtgcgacaggatcccttgccccaagaccttgtgatgttcctacatgccctacgctataaagggccaggctttgagtacttttcaccaatgcctgcctgggcacaggatgactggcaaaaggactgagggtgtggccaatggagggattgcttcttgggttgtgacaaggatgggctatagggcaagggctgaccccatgggctagtacttggggtttctataggaatgaggacgggcttctaaagagacctgctcatacttgctacctccttccagtgggaatttggagactttttggtttgtaaatatatccctttttctaacatc

SEQ ID NO: 27400 - DNA, 2562 bp, Homo sapiens
tcctcagatcgcgaccctgggagtggagtgggggcagcgtggttatgtggctggaccgccgcggatggctcagggttcttggacattggcgctacgaccttaggcgccctagctttaccaggacttggagtggcgataagggcccaatggcagaaacagtgtctacccaggttgggacagagggcgggctgagggcttcgcatcagcaaaacggtgacgctggtggcgacgcgaaggttgagctgtcccccgggcccccgaagccggctggccgggaagtggagccggccccagtaggcggggagcatccctcggctgcagccccaggcccgggcaagcataagaagcggcggggcgcaaccagggagcgtgtcgtgccgcccccgaagaagcggcggaccggggtgagcttcggagatgagcactttgcagaaaccagttattacttcgagggcggcctgcgtaaggtgcggccctattactttgacttccggacctactgcaaaggtcgctgggtgggccacagcttgctgcacgtcttcagtaccgagttccgagctcagcccctggcctactatgaggccgcggtccgggcgggccgcctgcaactcaacgagaagccggtgcaggacctcaacatcgtgctcaaggacaatgatttcttgcggaacacagtgcacaggcatgagccaccagtcacagcagagcccattcgcctgctagctgagaacgaagatgtggtggttgtagacaagccttcctccattcccgttcacccctgtggccgcttccgacacaacacagttatcttcatcctaggcaaggagcaccaactcaaggagctacaccccttgcatcggcttgaccgccttacctcaggggtgcttatgtttgccaagacagctgcagtctctgagagaattcacgagcaggttcgggaccggcagctggagaaggagtacgtgtgccgggtggaaggggagttccccactgaggaagtgacctgtaaagaacccatcttagtggtgtcttacaaagtaggggtgtgccgtgtagatccccggggcaagccctgtgagacagtgttccagaggctaagctacaatggccagtccagtgtggtacggtgccggccactcacaggccgcacacaccagattcgagtccaccttcagttcttgggccatcccattctcaacgaccccatctacaactcagttgcctggggtccttctcgaggccggggcggctacattcccaagacaaacgaggagttgctacgggacctggtagcagagcaccaggccaaacagagcctggatgtgctagatctctgtgagggtgacctgtccccaggactcacagactctacggccccctcctcagagttgggcaaggacgacctggaagagttggctgcagctgcccagaagatggaggaagtagctgaggcagcccctcaggagttggacacaatagccttggcatcagagaaggcagttgaaacagatgtcatgaatcaagagacagacccactctgtgcagagtgccggctggtgcgacaggatcccttgccccaagaccttgtgatgttcctacatgccctacgctataaagggccaggctttgagtacttttcaccaatgcctgcctgggcacaggatgactggcaaaaggactgagggtgtggccaatggagggattgcttcttgggttgtgacaaggatgggctatagggcaagggctgaccccatgggctagtacttggggtttctataggaatgaggacgggcttctaaagagacctgctcatacttgctacctccttccagtgggaatttggagactttttggtttgtaaatatatccctttttctaacatctttgatgtctggttttcttccggcttcttttttattactgatgtaaaattcacataacataaaattaaccactttaactagccaggcacagtggctcatggctataatcctagtactttgggaggtagaagtgaaaggatcactggaggccaagagttcaaggttaaagtgaactgtgattgtgctgctgcactccagagcctaggtgacagagtgagaccctgtctcttaaaaaaaaaaaaaattaaccaatttaagatgtacagcgtagtcacatttagtacattcacagtgttgtacaaccataacctcatatatttccaaaacattttcatcaccccaaaaggaaacctgtacccattaagtaagtggtcactttccactccccttccaccagcctctggcaaccactaatctactttctgtctgtttggatttgcctgtttattctggacattttatataaatggaatgataaaacatgtgacctatgtctctgtttcccttggcataatgttttcaaggtttattcaacttgtagcatgtatcggtacttcattctttttttatggcagaataagctgttgtatggatataccacgatttgtctatctgttcatcagttaatggacatttgggttgtttccaccatttcattattgtggatagtgctgctgtg

SEQ ID NO: 27401 - DNA, 715 bp, Homo sapiens
attctgtcgtctgggaacggctggtttcgcggtcagacgccgagggccctcgaagtccctagcaacggctgcggagggagattccacctaggtccgtgcaggttacaaatggcaaccagaacagggactccaagcacgcccaactagcagcatccaaacatgggacttcaaggacgtgaatgaagaaggtctgctggagcagaggaactgaaattgacaaggcgaaaggggaccctgggaagagtctgccggcagcagatataagtctgtaaaatcggatggaccaccaattggagaatgagagcctcccagcccagccttacattctttcaattaatacataaacagaaagggggatatgcagggagccaaaggcctgtgggacgtgaccaactcagcattctgctggaggctatatgatcaaacagcaaactgtttatcatgaatacaggatgtgagcaaactcaggactgctcctgccaacataaggtttgctggaggcaatcactccctggcaccgaggttatctactgcgacatctagagaatgcagtcttgcaagcctactctgaactgagcagccgaccccttcttccacccccccccaccctcctatctcttttgcctaataaatacggagggctgtgtaaagctcagggcccttgtccactagaggtaaggtgctccctgaccccttctcccaaatataaactttt

SEQ ID NO: 27402 - DNA, 748 bp, Homo sapiens
gggctgtgtaaagctcagggcccttgtcccctagaggcaaagcgcccccgatcccttcttccaaatacactcttttgtctcatctttattcccgtgttcaccccactttgtttagtccacctaggtccgtgcaggttacaaatggcaaccagaacagggactccaagcacgcccaactagcagcatccaaacatgggacttcaaggacgtgaatgaagaaggtctgctggagcagaggaactgaaattgacaaggcgaaaggggaccctgggaagagtctgccggcagcagatataagtctgtaaaatcggatggaccaccaattggagaatgagagcctcccagcccagccttacattctttcaattaatacataaacagaaagggggatatgcagggagccaaaggcctgtgggacgtgaccaactcagcattctgctggaggctatatgatcaaacagcaaactgtttatcatgaatacaggatgtgagcaaactcaggactgctcctgccaacataaggtttgctggaggcaatcactccctggcaccgaggttatctactgcgacatctagagaatgcagtcttgcaagcctactctgaactgagcagccgaccccttcttccacccccccccaccctcctatctcttttgcctaataaatacggagggctgtgtaaagctcagggcccttgtccactagaggtaaggtgctccctgaccccttctcccaaatataaactttt

SEQ ID NO: 27403 - DNA, 571 bp, Homo sapiens
caaacatccaaaccatttcagaactcattctataaaatatataaacagctttctattttttttctagctgcataatattccattgtgtggatgagccataatttatcaatttcctattatttctaatcttttacaatagatagtgtttcagtccttaatcttatacatataggtggccataaatttttaaggttctttggctatttggccaacatgtgggaagaaagccttgaattttataataaggcaaatatagggagttttaacagtggaaggatgcctgggacattttaaaacaagatttccttatcctgagaatgttcatattgtctaaattgtcatcccacagggagatatagacagaatagatgctgaagctaaccaatttaatttttgaatcaatttgatcataaaatatataagtgctaagttttccttattgttgccagtggatataataattatttttatgtcagaaaacgtaattttcttcatttgctttatttcaagtagcagaactttgcggtgtgtagtgaatacgaagactatactttgtaccgtttatgtttac

SEQ ID NO: 27404 - DNA, 352 bp, Homo sapiens
gtaattacttaggaagaccaaatggcaccagagataagactcccttagatccccacttagatcaccaccctttctcagggggtaataaagtcatcttccttggaatgtagcaatctataaccaatcaaagcactgtaacatacgcactggtcttgtatggaaaatgttgtaatcctgctaaaattcctctctctttgcctgtggaagtgaaaccttaacttctccagtttggaatgctcaccccatgcctttggagtcaatgcttactgggtggctattctcaaactttgcactcaaagaaactctatacttagtcttattttctgaatctcattatttaaggttgacataa

SEQ ID NO: 27405 - DNA, 400 bp, Homo sapiens
cctccgggttcaagtgattctcctgcctcagcctcccgagtagctgggattacaggcgtaagccaccacgcctggctaatttttgtatttttagtagagatggggtttcaccaaattggccaggctggtctcgacctgctgaccttgtgatccgcctgccttggcctcccaaagtgctgggattacagacgtgagccaccgcgccggcctgtataagtatcttataatcatattgtatcccactttttcccacaaatgatacacacgttacctacatcgttcagtgttatgttttcagatcttggaagctgtttcgtttcagtacatttgagcttcctgggatcttttctgtggctacataattttccgttgtagaactgtatgtgatttaattaaacag

SEQ ID NO: 27406 - DNA, 200 bp, Homo sapiens
ggaggttgcagtgagctgagatcacaccactgcactccagcctgggagacacagtgagactccagctcaaaaaaaaaaaaaaaaaaaaaaaaaaagagaaagcaagacagtcatcatacttgatggatggagggtatttaagcaaagtatagtgaccatgcttgaggggatggataccccattttccacgatatgattat

SEQ ID NO: 27407 - DNA, 843 bp, Homo sapiens
ttgagatggagtcttgctcttgtcacccaggcaggagtgcagtggcgcaatcttggctcactgcaacctctgcctcctgggttcaagctgttctccttactcagcctcccatgtagctgggattacaggcgtccgcaaccacgcccggctgatattagtagttttagtagaggcgggtttcaccatgtggccaggctgatctcgaactcctgacctcaggcagttcacccgtctcagcctcccaaagtgctgggattagaggcgtgagccactgcgcccggccaaccacattttcaaaacaggtcatgtggtgtcaggttggagtgtacttccagggataaccgtgggacattcttgaaatctgaactatcctgggaagtcttgaagtaatggatgcctatagtggacactcaggactcctgtccttggagcgagattggaggggcatctagcacttaacatatgccacaatgctttctgtggccattatttaacctctggttaaacaagcttaggaggctgacttactagtagtaaaaggagtgtgctttgagtcacagatcctggttgaactccagcatgttacaaacctcagccctgttctatgaaaggtcataactacgaggattattgtaaaacattaatttagaaatgtaaagtggtccccaatctctggatctggtcaggatttattggagctgccactgaggggattaaataagtggggtcaaagccccacagcctagtcaaccaagttgctcctcttttgtctatcctgtggttcccaagcaagactgcaattgaaaaaaaggctgctgttattaaagtcagaacaccaaataa

SEQ ID NO: 27408 - DNA, 1723 bp, Homo sapiens
attctagattgggttgaaataacccccttggtatactttcactcccttcatcacctgctccaattggctggatgtttgtggcctctcaaacacaacaaaatgaaatcttttcttgaatgaaatcatagccataaaacaacgcaaaggaaaaaaatgacaaaactgcctgccatcactatgccccctacacactcatgtagtaaagttctgagttctatcagggagctcgtgtcccagggcattcccactgcccagtgatcttgccacactccagcaacttgatcatggccattatcatcactaatagtagcatcttcctcctcattattacagcatctatatcaggagggaagaggggcttctgagtgaggccttggaatatatccaagacaccacctttttgcttgagaaaagagcttgtctcaactttgcctctgtccagggctcacaccttccatgtcatcaggagagagtcagtttccaaattgacccagaagggatctcacctaaagagaatctggaataagtaggctctagagggcagaaatgtaacagagaataaggctcaaggtggcaggtagagaaaaaaaaaagtgaaagttgtagggtcaaaatgccagctagaagctgggagtgcccgtttacagtggctgaaaccacagcagttcttgaacttggaagggaaatcccatgtgacatgcagagagaagagctaaagggtgtgaaaacctatgtgtctgtgggtaggaggagggaagatgctgcagcctgtgtgggtgttggagtgagcatgtgtgtgtgcatacacacacacagggaagagatgacagatgcaagtggcatggagatgatgttagggacagtttaatcttgcaaggctatatgcaggatcagggagaagggtgaaggagaaaaggagaaaatctggaaagaatgatgctgtcctcatcattacatacatgatccacctcagaactcctggcttggatttgtcagtgatccaagtcctggtgtgaaggtgtgctttttgttttatctgcctgatatccccatccagaagtcctggtttggaggagggttccatcctcattccccacccatcacccttttaaggctggcctgcttctgctcacccactgactcattttagcaatgaccttccatctggaatctgagtggccgagtggccagccgcagctaattcccttcacccactgcatttcccaccttactcactgcctcttggtattccaggcgactttccttttatagtgtacacacacacacacacacacacacacacacacgacctgacagctcagtcaagtcaggccctccaagcagaatactgcattttacctaaatccaagcagggcgtggcagggagccggttgccctccttttgggctctctataacaagagcagaaaatccactcctttcacctcttcttttcctgcaggcctttagatacgcagcctctccaagaattgcagaaagcatccagtcctacccaaacagcctaggggagtagaacagagcccccccccacccgccccccacaatttcactgaagcactttcatcatccttcctctccttttctgtcttctctgacatttaagatatccacctaaaccccaaagtggggcctgaagaaggagataagtgttccattcggcaacataagagaagttaaaggtaccaggacagggaaaaaaaaaa

SEQ ID NO: 27409 - DNA, 395 bp, Homo sapiens
tcggtaccaccaattccattgccagcgtacactaaatccaagcagggcgtggcagggagccggttgccctccttttgggctctctataacaagagcagaaaatccactcctttcacctcttcttttcctgcaggcctttagatacgcagcctctccaagaattgcagaaagcatccagtcctacccaaacagcctaggggagtagaacagagcccccccccacccgccccccacaatttcactgaagcactttcatcatccttcctctccttttctgtcttctctgacatttaagatatccacctaaaccccaaagtggggcctgaagaaggagataagtgttccattcggcaacataagagaagttaaaggtaccaggacagggaaaaaaaaaa

SEQ ID NO: 27410 - DNA, 467 bp, Homo sapiens
atacagatgtgaataattctgaaaagtagaaacaaatataatgaatttagccctgttcctatccttcatgtgcacatgaaacttataaataatacaataacatattattggctctgtttcttctctctttctggatcttggttgtcgatgacagaattaggagaaagactaagggaggggtcagtggaaaaaattcttggagatcatatttgaggattttgagatataggttttatgtgggaatgtcacttatgagatgttggagagaatagttaatatacacatatcccttagaatatgtctttttatccaggataggttttataagttttagagtaaaatgctgtgatagagaaaaagaggtatcagtcaggcagatatatgtgtgttaccaacatgggtgataaacatgggaatgtattttatcacatatttctacattatattaataattttaccatggagaa

SEQ ID NO: 27411 - DNA, 802 bp, Homo sapiens
caaattaaaaattaaaaaattaaccacacacctgtggtcttagctacttgcaggctgaggtgggaggattgcttgagtccagaaggttgaggctacagtgagctacgattgtacccctgcactccagcctgggtgacagagcgagaccctatctctacaaaaaaacaaacaaaacagattgcccatcaggggaactatccataaggcccagaaaaatctctgttggcctcatgtgcaagtcccccacagtaacacaccatttcccacctcccagctttacctgtgctgtgccctctgtctggcacagtcttttcacattttagggacaaattcctaattgttctttgagactcgtcttgggagtcacctcctctaggaagcctttgggtccccagcctgggccaggtaggcctgggtaccctgatggttccctctctgtgacacattgggaacttgacgccccctgcctgccgctgtctccctgagggccaggactgcacccaacccctctctttgtccctagcacccaggacagagtcaggctcatagcagatgtcagcccaccgcactctggaaagaaaacacaagtggtaggcgctgtggctcatgcctgtcatcccagcactttgggaggccgaggcaggtgaatcacttgagctcgagagttcgagaccagcctggccaacatggtgaaaccccgtctctacaaaaatacaaaaattaactgggcgtggcatggtggcatgcacctgtaatcttagctactttgggaggctgaggcagaagaatcacttgaacccgg

SEQ ID NO: 27412 - DNA, 546 bp, Homo sapiens
cacagagaaggacagaaggctgatgccgggagaaattcttgatagggtcacccatgtgggcgactggagacctcctgaggagtcttcaaggagcgtcttcagaatgttcctctacagggaggagagagggaggcctgtaaccactgctcctgtcccccatggccttgccccagtggacattaattatctgtatttccatgcatagaatatagaactgctgggcgcctcagctggagcccagagcaggggcaagagatacagaatgcacaaaatcaccccagaacctctcctaagtcactcgtaaagtgcacccagggcctacttagtccttttttatgtagcatcctgcagaacacttgcctcagtccctgtaactctccatcaaccaaggcttccctgaccttcagttgattcatctatttcttcctgaagaagtcaacagagcaacggccaccgacttgcctaacgccagaacattgtgtttcatttgtctgtcaattgttcatcaattcctggataattcccattcttttcatacatttcact

SEQ ID NO: 27413 - DNA, 455 bp, Homo sapiens
ggttgggttgttctgatctgttttgatacaataagcaatgacatagtatacaactttgtccatatttatttatttatttattttttgagatggagtttcactcttgttgcccaggctggagtgcaatggcacgatctcagctcactgcaacctcggcctcctaggttcaagcgattctcctgcctcagcctctcgagtagccgggactacaggcgcatgccaccacgtgcagctaatttttttgcatttttagtagagatggagttttgccatgttggccaggttgctctcgaactcctgacctcagaagatcttcccaccttggcctcctaaagtgccgagattacaggtgtgagccactgtgcccagccactaaagcttctaaaaagtatatataatttttgtgtgtgtgtttagccatcaacaattatatctcattacaatttaaagttcta

SEQ ID NO: 27414 - DNA, 804 bp, Homo sapiens
cggaaagagaagagagaagagtgagcagagagattgagagattgagagagagagagagagatagacggagatctctggagcagacctcaaggtgacttctatttctatctggttctcgtctgggggggccctggccgggcagccccccaacacttctcctgccctgaaacacggctctagccaacctgctccgctgcttcacctgcgaccgtctctgcgggggctgcacggcgccagcccctccagcccaccagggcattgtcctccagcccgtcatgcccagctgtgaccccggtccgggccctgcctgcctccccaccaagactttccgcagctatctgccccgctgtcaccgcacttacagctgtgtccactgccgtgcacacctggccaaacacgatgagcttatttccaagtccttccaagggagccatggccgagcctacctgtttaactccgtgtgagtctacctctttccttgtgcgtgtgcttgtgcttgtgtgtgagtgagtaattttcctctgtggagaaaggggggaatccatcaggtgatcttgtgccttcagtctttgcctccccttttgcaaagagggtctcaatctgaagttctcacatggggagccgggggagaattgaaatcataacggtggaaaaagaaggcccaggctctagtcttaaaggggtggattatcaaaggcaggggctgtccagttctctccagatggaagttcccttgggctgtctggggactggactgacagtgcaaccccactgggtgctgggtccttcctgtttcctgagaca

SEQ ID NO: 27415 - DNA, 2100 bp, Homo sapiens
tataagattattagtataaaagggaagacaggcaggtgcttattctgggccagaatgagtgaaccaaggtgcgagaatgggcggccacacgtgagggctttggtactgttggaaacatctataaagttctagtgaagagtcccagagcacaggaccctgacctcaggagagaaccgaatcagggtttgtatacctgcctgcatgctctccctcccctcaccttacacctcctgcccccctccccaaaatgtataaaggaccaattgtattgcaaacaaagaccatgtaaaagaaagaccttcaggcatccccaactcttaaaaggctctgatcccctgagacacagtgcctgtgcgatgcagagcctcacgaagaactgaaaaccaaggagagggcacttgcagatgacgttgctcccatggcagcgtctgtgcccgtgggcttctctctgtggaaaatggtggaggctgcttctgccccaggagggagaaacaccgactccctggctttggcgccagaagcctggatcggctgccaggtttgccagagcagaatggggatccaggggacagggcgacaatgcaactggatgctgtgggggggtcgatggtgatggggaaagtagaggtgacttctatttctatctggttctcgtctgggggggccctggccgggcagccccccaacacttctcctgccctgaaacacggctctagccaacctgctccgctgcttcacctgcgaccgtctctgcgggggctgcacggcgccagcccctccagcccaccagggcattgtcctccagcccgtcatgcccagctgtgaccccggtccgggccctgcctgcctccccaccaagactttccgcagctatctgccccgctgtcaccgcacttacagctgtgtccactgccgtgcacacctggccaaacacgatgagcttatttccaagtccttccaagggagccatggccgagcctacctgtttaactccgtggtcaacgtgggttgcgggccagctgaacagcgcctcttgctcacggggctccactcggtagctgacattttctgtgagagctgcaaaaccacactgggctggaaatatgagcaagcttttgagacgagccagaagtacaaggaagggaaatacatcattgaaatgtcacacatggtgaaggacaacggctgggactgaggggctcaggcagggtgtgcccttcctccgcatgcccctccctccccacggccctgccaagcagtctataccagcatgagtactgccccacccctgggggaaacctggctccaaccaacccctcccctgcctccaccatatccactaccaggcaccctttagaacaggggtctgggggtaccccaggggtgttaaggctcaggagtgggcagcagtcagggagagacagaactgggggaaagggatggttgtgggtctttctgttcccaagatcctgaacatggaagcgatggcagggcatagactcaggcagagaggattgtgggaggaatccgtttttgctccacctctttttgagtgaacagaggacaaaccttgggtcacagggcaagtagatcatggaccacagaacagcagatgagaaaagacttgggttggagtgaaattctggtctcagacaccaggagaccagagtctctgaggatgaagtttcctacccctatttgtagggaaaaggacttgagtgcagggaaaactcaaatcccaggccctgggaaatagtaaaataatcaaagggttttccatttcactccacttgttagtttatcttggcactgaagaggcactttcgagtatctaacttttgccattgggtggggtggggacagctgctcgcggaacagcccctagtcggctgcttccagagtaagcagtctttatgggctttctctgaggcccagtcactgctcctgggacccagtcccctggaggggaggtggaaaatcagtgctacggggccagtctttcccgtggctgccaccagcgaatgaaacttttgtatgatacataaagtgcttgagtctatttttaataaaaagggaaaaagcaacttgaggcaacctgtc

SEQ ID NO: 27416 - DNA, 1564 bp, Homo sapiens
cggaaagagaagagagaagagtgagcagagagattgagagattgagagagagagagagagatagacggagatctctggagcagacctcaaggtgacttctatttctatctggttctcgtctgggggggccctggccgggcagccccccaacacttctcctgccctgaaacacggctctagccaacctgctccgctgcttcacctgcgaccgtctctgcgggggctgcacggcgccagcccctccagcccaccagggcattgtcctccagcccgtcatgcccagctgtgaccccggtccgggccctgcctgcctccccaccaagactttccgcagctatctgccccgctgtcaccgcacttacagctgtgtccactgccgtgcacacctggccaaacacgatgagcttatttccaagtccttccaagggagccatggccgagcctacctgtttaactccgtggtcaacgtgggttgcgggccagctgaacagcgcctcttgctcacggggctccactcggtagctgacattttctgtgagagctgcaaaaccacactgggctggaaatatgagcaagcttttgagacgagccagaagtacaaggaagggaaatacatcattgaaatgtcacacatggtgaaggacaacggctgggactgaggggctcaggcagggtgtgcccttcctccgcatgcccctccctccccacggccctgccaagcagtctataccagcatgagtactgccccacccctgggggaaacctggctccaaccaacccctcccctgcctccaccatatccactaccaggcaccctttagaacaggggtctgggggtaccccaggggtgttaaggctcaggagtgggcagcagtcagggagagacagaactgggggaaagggatggttgtgggtctttctgttcccaagatcctgaacatggaagcgatggcagggcatagactcaggcagagaggattgtgggaggaatccgtttttgctccacctctttttgagtgaacagaggacaaaccttgggtcacagggcaagtagatcatggaccacagaacagcagatgagaaaagacttgggttggagtgaaattctggtctcagacaccaggagaccagagtctctgaggatgaagtttcctacccctatttgtagggaaaaggacttgagtgcagggaaaactcaaatcccaggccctgggaaatagtaaaataatcaaagggttttccatttcactccacttgttagtttatcttggcactgaagaggcactttcgagtatctaacttttgccattgggtggggtggggacagctgctcgcggaacagcccctagtcggctgcttccagagtaagcagtctttatgggctttctctgaggcccagtcactgctcctgggacccagtcccctggaggggaggtggaaaatcagtgctacggggccagtctttcccgtggctgccaccagcgaatgaaacttttgtatgatacataaagtgcttgagtctatttttaataaaaagggaaaaagcaacttgaggcaacctgtc

SEQ ID NO: 27417 - DNA, 2011 bp, Homo sapiens
tataagattattagtataaaagggaagacaggcaggtgcttattctgggccagaatgagtgaaccaaggtgcgagaatgggcggccacacgtgagggctttggtactgttggaaacatctataaagttctagtgaagagtcccagagcacaggaccctgacctcaggagagaaccgaatcagggtttgtatacctgcctgcatgctctccctcccctcaccttacacctcctgcccccctccccaaaatgtataaaggaccaattgtattgcaaacaaagaccatgtaaaagaaagaccttcaggcatccccaactcttaaaaggctctgatcccctgagacacagtgcctgtgcgatgcagagcctcacgaagaactgaaaaccaaggagagggcacttgcagatgacgttgctcccatggcagcgtctgtgcccgtgggcttctctctgtggaaaatggtggaggctgcttctgccccaggagggagaaacaccgactccctggctttggcgccagaagcctggatcggctgccaggtgacttctatttctatctggttctcgtctgggggggccctggccgggcagccccccaacacttctcctgccctgaaacacggctctagccaacctgctccgctgcttcacctgcgaccgtctctgcgggggctgcacggcgccagcccctccagcccaccagggcattgtcctccagcccgtcatgcccagctgtgaccccggtccgggccctgcctgcctccccaccaagactttccgcagctatctgccccgctgtcaccgcacttacagctgtgtccactgccgtgcacacctggccaaacacgatgagcttatttccaagtccttccaagggagccatggccgagcctacctgtttaactccgtggtcaacgtgggttgcgggccagctgaacagcgcctcttgctcacggggctccactcggtagctgacattttctgtgagagctgcaaaaccacactgggctggaaatatgagcaagcttttgagacgagccagaagtacaaggaagggaaatacatcattgaaatgtcacacatggtgaaggacaacggctgggactgaggggctcaggcagggtgtgcccttcctccgcatgcccctccctccccacggccctgccaagcagtctataccagcatgagtactgccccacccctgggggaaacctggctccaaccaacccctcccctgcctccaccatatccactaccaggcaccctttagaacaggggtctgggggtaccccaggggtgttaaggctcaggagtgggcagcagtcagggagagacagaactgggggaaagggatggttgtgggtctttctgttcccaagatcctgaacatggaagcgatggcagggcatagactcaggcagagaggattgtgggaggaatccgtttttgctccacctctttttgagtgaacagaggacaaaccttgggtcacagggcaagtagatcatggaccacagaacagcagatgagaaaagacttgggttggagtgaaattctggtctcagacaccaggagaccagagtctctgaggatgaagtttcctacccctatttgtagggaaaaggacttgagtgcagggaaaactcaaatcccaggccctgggaaatagtaaaataatcaaagggttttccatttcactccacttgttagtttatcttggcactgaagaggcactttcgagtatctaacttttgccattgggtggggtggggacagctgctcgcggaacagcccctagtcggctgcttccagagtaagcagtctttatgggctttctctgaggcccagtcactgctcctgggacccagtcccctggaggggaggtggaaaatcagtgctacggggccagtctttcccgtggctgccaccagcgaatgaaacttttgtatgatacataaagtgcttgagtctatttttaataaaaagggaaaaagcaacttgaggcaacctgtc

SEQ ID NO: 27418 - DNA, 1556 bp, Homo sapiens
tataagattattagtataaaagggaagacaggcaggtgcttattctgggccagaatgagtgaaccaaggtgcgagaatgggcggccacacgtgagggctttggtactgttggaaacatctataaagttctagtgaagagtcccagagcacaggaccctgacctcaggagagaaccgaatcagggtttgtatacctgcctgcatgctctccctcccctcaccttacacctcctgcccccctccccaaaatgtataaaggaccaattgtattgcaaacaaagaccatgtaaaagaaagaccttcaggcatccccaactcttaaaaggctctgatcccctgagacacagtgcctgtgcgatgcagagcctcacgaagaactgaaaaccaaggagagggcacttgcagatgacgttgctcccatggcagcgtctgtgcccgtgggcttctctctgtggaaaatggtggaggctgcttctgccccaggagggagaaacaccgactccctggctttggcgccagaagcctggatcggctgccaggtttgccagagcagaatggggatccaggggacagggcgacaatgcaactggatgctgtgggggggtcgatggtgatggggaaagtagaggtgacttctatttctatctggttctcgtctgggggggccctggccgggcagccccccaacacttctcctgccctgaaacacggctctagccaacctgctccgctgcttcacctgcgaccgtctctgcgggggctgcacggcgccagcccctccagcccaccagggcattgtcctccagcccgtcatgcccagctgtgaccccggtccgggccctgcctgcctccccaccaagactttccgcagctatctgccccgctgtcaccgcacttacagctgtgtccactgccgtgcacacctggccaaacacgatgagcttatttccaagtccttccaagggagccatggccgagcctacctgtttaactccgtggtcaacgtgggttgcgggccagctgaacagcgcctcttgctcacggggctccactcggtagctgacattttctgtgagagctgcaaaaccacactgggctggaaatatgagcaagcttttgagacgagccagaagtacaaggaagggaaatacatcattgaaatgtcacacatggtgaaggacaacggctgggactgaggggctcaggcagggtgtgcccttcctccgcatgcccctccctccccacggccctgccaagcagtctataccagcatgagtactgccccacccctgggggaaacctggctccaaccaacccctcccctgcctccaccatatccactaccaggcaccctttagaacaggggtctgggggtaccccaggggtgttaaggctcaggagtgggcagcaagtcccctggaggggaggtggaaaatcagtgctacggggccagtctttcccgtggctgccaccagcgaatgaaacttttgtatgatacataaagtgcttgagtctatttttaataaaaagggaaaaagcaacttgaggcaacctgtc

SEQ ID NO: 27419 - DNA, 241 bp, Homo sapiens
tagaccaaaaagacaaaagagacagtaagaaaataaggtaacaggatcattcctgtgggtctaacatccaaatagtagatgttccagaaaagaatagaaaaaatataagaaaggaagtcatcaattaatataagaaaatttccttacgaaggacacagctgccatactgtaaagggctggcaagtaccctgcacaaggaatgactgtggaccgacactaggttacatcatagataaatacc

SEQ ID NO: 27420 - DNA, 581 bp, Homo sapiens
gcagcacccgccttggagcccctttcccgcctgcgagggagacctggcgtctgcccgctgctcgcagagtcacgttgccggcgattcaaagggcgaggaaaggatgaggaagcgctttgtggtctgaggcagcccctctgtcatgtggtgctccctattcctcctcctcgtcttcctcgtcttccccctcctcctcgcgcccggcagcaccctcgctactcaggagttctgtccatcctcgttttgtgtggctgactcagttctcgagcccccttcctcccatgcagaaaggggacagtgtggcaacccgcccccaacctctattcttggtgaatttaaaatgggggttcccagagtgggtgctggcaccccaggggacaccacacagaccaccaggctgcaggagggagacacaggccgtgctgtctgtgttatggagtgcaccctttaaaagttccgaggtggtctagccaggggcggtggctcacacctgtaatcccagcactttgggaggccgaggcgagttcaggagatcgagactattctggcttggctaacgtggtgaaaccccgtctctacta

SEQ ID NO: 27421 - DNA, 707 bp, Homo sapiens
gttgccaggactggtctcaaattctcccgtattggattaatttcagtgatgtaagttgaggccactgacccacatgactccttcagaaccgagagcaggaaggacagcatgacatagataaagtcccaagccatgctgattattgtttaaaaacttcaggctttccccaaattgcatgatatcttaatctttgatttcttcttattttaagtgtaaaaatccatccctttattttataaatcctgattttgccatgaagcggtctctgaactcctcagctgttactgcccagtttatcccttaattccaattccacctaccatgtggttcatctcttgtttatctccccagctagatattaagcccattgagagcagggatgtaacatatgccacttttgatttctctaaaggaccaggtcagtgctaggcacacggtcgatgtttaattaatccttcattaatataacaagtcacctgatgatttagatctttccttcaaaacccacctacagacacacacacacacacacacacacacacacacacttacacactctgatcatttagtctttccctgaatgactccggtggtgaagagctcacttcctcccaaaacagcccttccatcttcagtcaactgctaatgtaatgagctaagatttactgagtgcctactatgttccaggcatggtgctaagcccttta

SEQ ID NO: 27422 - DNA, 601 bp, Homo sapiens
aagtgattttaggttgtttcttttgtgaaagtgtttagcttcaagactagagagggaatatgagtgtacacctactatatataaagttaagatgtacatttacaggaataaccctggtttgagtaactgatctgaaattagtagttccctgtaaatggcagatctttcaggaaaaaaagagaaaggtaagggctctattgaataaactgtggttttatttgtggtataactgatcttggaaataagtatttttaataagaaatgaatgatcatttcttgccagaatttgctaccataaggtgatatggataattctgttacaagaacattaacatttagtatgacttttttactgtattcttgcagttaataactgcagctattatgttaataacaagttgtttacattttatttttgtttatactagtcttaaaacaaagatccaggttctgaataaaaaaaattaattcatacaattgatacatgctggggcttggaactaagaagtagtttcaaaagtacttgggttatggcatttcttatgtttccttatttatgtggttacttagtagttaattttaagatgtcccaatgatcatt

SEQ ID NO: 27423 - DNA, 553 bp, Homo sapiens
aggctgcagtgagctatgatcacaccactgtactccagcctgggcaatagaatgaaaccctgtctcaaaaaagaaaagaaaaaaaaaaagaaagaataaaaaatggctttgtccagtctcttaattatagtatgtgaaatatgtaaaatgtatgaacacaacatacatgattatccaatcactctttaacagcggtactacttttcagttatcataaattccacacttatgtaatatttgtggttgttttaaaagttgacccttaaaaataaatgcccaaatgatcgctgacggagccagactccagcacatacccaattaagtgaagtgtttccctaggtgctggggtaggagcaaacatatttctctagcccctgagagagacaaaggtttatagagtaggtccagatgctgaacataaatgaacgctcaatgcaccatggcatgattaggacaattcatagaccaaaccagcagccaggagtggggcaaaagctcaagtttgcacagataacaaataattgacaaaaatctcattaaacattattgcttg

SEQ ID NO: 27424 - DNA, 530 bp, Homo sapiens
taaaaaaaaggcttttgcaggagatatttcttctctgttaaaacccagaaaaatatcccagcaaagtacaaaataatgagagcagagaaaacaaaagtaagagaatgggaatgaaagagagaaactacattttgcaaggctgtaaactatagggtttgtactggaagcattgctttatagcaatatgtttgataatggttttccttagaaacaatattaactgacttgtagatgactcactcattttgaagaatgaatatgcagtttaaatttaaaagtctcttattcaaaaacagaattactgaggagaaacttaactagcacctaacatctaattagttcaatagctccagtaatatggtatatctgtttcctctcttaaagaaatcccaaatgacaaataatctgacaataaatctttctttaacattttaccacaatttagcaactctgttttgaaattttactatttattttttcaaaaagtttcttattagtaaagaagttcaaaattaagtcactattttgat

SEQ ID NO: 27425 - DNA, 1017 bp, Homo sapiens
acggggagtcatagatgggtctaagactccctgaccaggaagcttgtgatgtggttgacttgatgaaaggaacaagggagcaaaagtagatttgggtgggaaaagaaggagctcagagtaaaacatgttatattttaggtccctgtgggaaaatcaagtgtaagttcttagtaggcagatcaaaaggcagaactggaactcaagagaggacagggtgagaaatttagcattagaatcatctcaaaacgagatataacaggcaccaactgagtcatcattcaaaggtatttcttaacctagagtccactgacccccaaagagtctgtggatagaaatgtactttgatatcatcagcttcttttataatcctgttttgtattttacatactgaaaaccatgattctgagaagagatccatagagttcaccagactgcagaaggggctgtggcacaaacaaaattagaaacccctcagttggagggaagtgagactgggaagggaggtcagtaaaatgattgccacggggcacccagatccttgctgaggttggaaaccgcaaaggtgcagcagcaacaagccacatgggtgggtgttgtctcctgtgagagcaagatgtgataggtaatctttgaagagggctttcctttcctagaattcgtgctgccacaggagtgtttagaaaacggttctacaagttcttgtttcttttctgaggttgtggcctctccattgtttggtcagatttgtagtgcactctatatcctggtggtttgaaaacattgtcagcacaataacttttctttcttcacatgagatttcatacaaaatcccagtgtatggacatggtaggctttgattaaaataggggtgaagggccctgccagctcggccttccgagaggctgtcccacctctccttacttccctatcaggagctgctggaggtcttttgaatgcttctgcctacacaaaatgatgtgaaaatcactgctttaatttaaacacccttctttaaaa

SEQ ID NO: 27426 - DNA, 848 bp, Homo sapiens
aatcctcaagtcccaagatccaatcatattttctgtagggtggaggaggtttcagaccatcctgctctattatatcgaagaccacaatggaagacaaaggcttctaaagtatacgccacagcatatccattgtggagccgccttttgggcctgattttcagatagctgccacaggagttgtccttgatctggataaatccataaaaattgtgaagaaattaaagctaactggttttccatataaaattttcaagaacacttcatttattaagggaatgtttaattctgccttggaagtggccaaatttgaagatgctgtgattcgaactgtcagtgggataagggggcagatcaagagagcactctgagctccagaaggagctttccaggatagctttgaggataagctgcggatgagcgatattgtcttcatgcgaacttggtatcctgtttccatcccagccttctataacccagtaacatctttgttgaaaccagtgggtgagaaagacacctggtcaggaatgtggaccacgggccaactcaggctcgcccatggtgtcagactaaagacaaacaaggactctctgtataaggtactggtcgtgtgtgtgttagtggagatgaagcctgtgctctacagacagggagtcacacagacacttttctataatttcttacatactttgaatgttcaagtataaagtctaatgttaaatttgattgaacaattgtatatttgtgggatattttggaatggaacaccaaaaaatggtaatagtggttctttctggattgaaggaaaacttttcttttttaaaataaattttattttatataaatgaggt

SEQ ID NO: 27427 - DNA, 806 bp, Homo sapiens
aatcctcaagtcccaagatccaatcatattttctgtagggtggaggaggtttcagaccatcctgctctattatatcgaagaccacaatggaagacaaaggcttctaaagtatacgccacagcatatccattgtggagccgccttttgggcctgattttcagatagctgccacaggagttgtccttgatctggataaatccataaaaattgtgaagaaattaaagctaactggttttccatataaaattttcaagaacacttcatttattaagggaatgtttaattctgccttggaagtggccaaatttgaagatgctgtgattcgaactgtcagtgggataagggggcagatcaagagagcactctgagctccagaaggagctttccaggatagctttgaggataagctgcggatgagcgatattgtcttcatgcgaacttggtatcctgtttccatcccagccttctataacccagtaacatctttgttgaaaccagtgggtgagaaagacacctggtcaggaatgtggaccacgggccaactcaggctcgcccatggtgtcagactaaagacaaacaaggactctctgtataagaacatacatatgatagttgagaaagacacatattctgatcatgaagaaataaacacaagttaaatatgactaagcagaaagatggaaggaccaggaacggtgatgctaacttggaaccacgatgcaggctctaaactcctctacaatcatccccccttgtgagaaaaatacgtaagtcacttttaaaataaatagaaacctgaacacaaa

SEQ ID NO: 27428 - DNA, 1090 bp, Homo sapiens
aatcctcaagtcccaagatccaatcatattttctgtagggtggaggaggtttcagaccatcctgctctattatatcgaagaccacaatggaagacaaaggcttctaaagtatacgccacagcatatccattgtggagccgccttttgggcctgattttcagatagctgccacaggagttgtccttgatctggataaatccataaaaattgtgaagaaattaaagctaactggttttccatataaaattttcaagaacacttcatttattaagggaatgtttaattctgccttggaagtggccaaatttgaagatgctgtgattcgaactgtcagtgggataagggggcagatcaagagagcactctgagctccagaaggagctttccaggatagctttgaggataagctgcggatgagcgatattgtcttcatgcgaacttggtatcctgtttccatcccagccttctataacccagtaacatctttgttgaaaccagtgggtgagaaagacacctggtcaggaatgtggaccacgggccaactcaggctcgcccatggtgtcagactaaagacaaacaaggactctctgtataagaacatacatatgatagttgagaaagacacatattctgatcatgaagaaataaacacaagttaaatatgactaagcagaaagatggaaggaccaggaacggtgatgctaacttggaaccacgatgcaggctctaaactcctctacaatcatccccccttgtgagaaaaatacgtaagatctaaggcacatgagatgatatgctttctgtttgagtttctcctttatgttacgcatactgataaaattgttgatgccagttgatctgaaggtcccagcaaggagccgactcacagaagaatgaagttttcacatcatgatgatttaatcttccttgacctgagcaattgacaaccccaattctccagaacctcacccgccacaatccccttaaaaaccctggcccagaacccctcaagcagacagatgtgaagcttgaggattccttcatctctttgcccaatggcattgtgattattaaactctttttctgctgc

SEQ ID NO: 27429 - DNA, 2511 bp, Homo sapiens
gaggcaaagtctactttctggtacctcaaagaaatcattgttcaatcttccataaggaagagattctttaccaggctgtgagccagtgttagataacttgtgaatggatataagttacttttaacaacccctcttacttttttatttgaatcctctgaatacctgtcagtattttaaagttggcaatccaggacattataagtaggatggagcaggagaagaatcctattgaaaggacaaattaaaatagtaaatcctctcctctcccttctgtaggtactagctgccttgatttttttttgtgggtgggggggattttttcattccttattgaacttattttgcacaatagtgtttacaaatcttatacatcttactttgacagaagacttataataccttgtggtcttgagactggttgtctcctttgcctttcttcaaggattttcctttttctttttaccccccagtgaccactctgctctttaggattctagtggcagtattcttgtaacctgttagacgtgggtggatatacctcttcaggatggcctccttgctgtctttattgaagagctgcccacccagagtcttgactctagggcaggctagtgctattgtggtgtcagttgatatttagtttcatttgctgaaccccaaatttgagtgttagttagggagcctccattctgtgggagagtgtggaaaggcactctttttttctccatattagttaacaagaggtgtctttaggccctggatgttaccatctcatttggtcaagcccctgatacctagtttcacatggatgctaacgtggatgtaatatagttgtgacagcctatgcacaaaagcattacctgatcttaaggtttggtattctaaccaaagttgacagactgtgcgtctgtcttaatggatgtcttaggagttggttattctctctttttttttgagacggagtttcgctgttgttgcccaggctggagtgcaatggcgtatctccactcaccacaacctccgcctcctgggttcaagggattctcctgtcttagcctcctgagtagctgtgattacaggcatgcgccaccatgcctggctaatttcatattttttagtagagacaggatttctccatgttggtcaggctggtcttgaactcctgacctcaggtgatctgcccacctcggcctcctaaagtgctgggattacaggcatgagccactgcacctggccggttattctctctttacagatagctatagacatcattttaggaagtgttgcagtctggcatttgtgctattgttcattctctgtgaaggctgttcatagttgctatagcctgtgtttagttttgtgatttcatcaatcccatctttctgtgtgagtaatgcattctaaacatcctaccccactttagaaacggacgtggggaacgcttggtcatttaagccaacaataaatttaggtgaatgtccctaagtgtttactgtttttatccagtcaaggatttgcttttccttgaacatttgttttaaattctggggccaaaatgcaaaggagaagttctattcaaaggcagtagttgaaatctattattttagttagcctacttggcatttactacatcggtcacttctccaggctgccctaaattaggttgatggagtgagacatgccaaacatccacctttgggaccatagcatagttaaaattaaatgtagttggaatagctagcattgcagctacagtagggaactgtagtctagttccctacagaaaacccaaggagtgaagggacaggattttgcctaggcaaaaatctaagactcgtgccctcctggtacatggggttttaagactgaatgtgtaataggagcactgcctttgccaaatcaaatgagtgacaggttaactagaaaatgtgacaatcacatttcctcttagctcaaataattctgtttttccaaagctttagcagcttaattaaatctgttggactgggggaggagagagctgttctctagtggttaacatggtattctttaagaagaaaaaacaaagccaaagaaaactcattatctggcatgttcgccttaaagatggtagtgggtagaatctggagttttcatctcttttcaaagctgcatatctcttatatttggtattggcctctaagtctaatattgcagttggaattcttgctgtattattttttaagcaagtgttaggtgcatttaactgctttcttcatccatgacgacattcccaccatgggggtcttgacaaagcagagtaaaaatatgctgtttacattgtttacttacaagtaaggagcctgaaataacctgtagtttcgaatgcaggccctgatttactggcgttgtcagtttcaattatgaaactgaagtttggtgcctcctctttatcatgttttttcccttgtagcagttgtgtttaatgtcattaaaaagaaataaaagttctttgtcagtgaaaaaaaaaat

SEQ ID NO: 27430 - DNA, 1915 bp, Homo sapiens
gaggcaaagtctactttctggtacctcaaagaaatcattgttcaatcttccataaggaagagattctttaccaggctgtgagccagtgttagataacttgtgaatggatataagttacttttaacaacccctcttacttttttatttgaatcctctgaatacctgtcagtattttaaagttggcaatccaggacattataagtaggatggagcaggagaagaatcctattgaaaggacaaattaaaatagtaaatcctctcctctcccttctgtaggtactagctgccttgatttttttttgtgggtgggggggattttttcattccttattgaacttattttgcacaatagtgtttacaaatcttatacatcttactttgacagaagacttataataccttgtggtcttgagactggttgtctcctttgcctttcttcaagggattctcctgtcttagcctcctgagtagctgtgattacaggcatgcgccaccatgcctggctaatttcatattttttagtagagacaggatttctccatgttggtcaggctggtcttgaactcctgacctcaggtgatctgcccacctcggcctcctaaagtgctgggattacaggcatgagccactgcacctggccggttattctctctttacagatagctatagacatcattttaggaagtgttgcagtctggcatttgtgctattgttcattctctgtgaaggctgttcatagttgctatagcctgtgtttagttttgtgatttcatcaatcccatctttctgtgtgagtaatgcattctaaacatcctaccccactttagaaacggacgtggggaacgcttggtcatttaagccaacaataaatttaggtgaatgtccctaagtgtttactgtttttatccagtcaaggatttgcttttccttgaacatttgttttaaattctggggccaaaatgcaaaggagaagttctattcaaaggcagtagttgaaatctattattttagttagcctacttggcatttactacatcggtcacttctccaggctgccctaaattaggttgatggagtgagacatgccaaacatccacctttgggaccatagcatagttaaaattaaatgtagttggaatagctagcattgcagctacagtagggaactgtagtctagttccctacagaaaacccaaggagtgaagggacaggattttgcctaggcaaaaatctaagactcgtgccctcctggtacatggggttttaagactgaatgtgtaataggagcactgcctttgccaaatcaaatgagtgacaggttaactagaaaatgtgacaatcacatttcctcttagctcaaataattctgtttttccaaagctttagcagcttaattaaatctgttggactgggggaggagagagctgttctctagtggttaacatggtattctttaagaagaaaaaacaaagccaaagaaaactcattatctggcatgttcgccttaaagatggtagtgggtagaatctggagttttcatctcttttcaaagctgcatatctcttatatttggtattggcctctaagtctaatattgcagttggaattcttgctgtattattttttaagcaagtgttaggtgcatttaactgctttcttcatccatgacgacattcccaccatgggggtcttgacaaagcagagtaaaaatatgctgtttacattgtttacttacaagtaaggagcctgaaataacctgtagtttcgaatgcaggccctgatttactggcgttgtcagtttcaattatgaaactgaagtttggtgcctcctctttatcatgttttttcccttgtagcagttgtgtttaatgtcattaaaaagaaataaaagttctttgtcagtgaaaaaaaaaat

SEQ ID NO: 27431 - DNA, 2457 bp, Homo sapiens
gaggcaaagtctactttctggtacctcaaagaaatcattgttcaatcttccataaggaagagattctttaccaggctgtgagccagtgttagataacttgtgaatggatataagttacttttaacaacccctcttacttttttatttgaatcctctgaatacctgtcagtattttaaagttggcaatccaggacattataagtaggatggagcaggagaagaatcctattgaaaggacaaattaaaatagtaaatcctctcctctcccttctgtaggtactagctgccttgatttttttttgtgggtgggggggattttttcattccttattgaacttattttgcacaatagtgtttacaaatcttatacatcttactttgacagaagacttataataccttgtggtcttgagactggttgtctcctttgcctttcttcaaggattttcctttttctttttaccccccagtgaccactctgctctttaggattctagtggcagtattcttgtaacctgttagacgtgggtggatatacctcttcaggatggcctccttgctgtctttattgaagagctgcccacccagagtcttgactctagggcaggctagtgctattgtggtgtcagttgatatttagtttcatttgctgaaccccaaatttgagtgttagttagggagcctccattctgtgggagagtgtggaaaggcactctttttttctccatattagttaacaagaggtgtctttaggccctggatgttaccatctcatttggtcaagcccctgatacctagtttcacatggatgctaacgtggatgtaatatagttgtgacagcctatgcacaaaagcattacctgatcttaaggtttggtattctaaccaaagttgacagactgtgcgtctgtcttaatggatgtcttaggagttggttattctctctttttttttgagacggagtttcgctgttgttgcccaggctggagtgcaatggcgtatctccactcaccacaacctccgcctcctgggttcaagggattctcctgtcttagcctcctgagtagctgtgattacaggcatgcgccaccatgcctggctaatttcatattttttagtagagacaggatttctccatgttggtcaggctggtcttgaactcctgacctcaggtgatctgcccacctcggcctcctaaagtgctgggattacaggcatgagccactgcacctggccggttattctctctttacagatagctatagacatcattttaggaagtgttgcagtctggcatttgtgctattgttcattctctgtgaaggctgttcatagttgctatagcctgtgtttagttttgtgatttcatcaatcccatctttctgtgtgagtaatgcattctaaacatcctaccccactttagaaacggacgtggggaacgcttggtcatttaagccaacaataaatttaggtgaatgtccctaagtgtttactgtttttatccagtcaaggatttgcttttccttgaacatttgttttaaattctggggccaaaatgcaaaggagaagttctattcaaaggcagtagttgaaatctattattttagttagcctacttggcatttactacatcggtcacttctccaggctgccctaaattaggttgatggagtgagacatgccaaacatccacctttgggaccatagcatagttaaaattaaatgtagttggaatagctagcattgcagctacagtagggaactgtagtctagttccctacagaaaacccaaggagtgaagggacaggattttgcctaggcaaaaatctaagactcgtgccctcctggtacatggggttttaagactgaatgtgtaataggagcactgcctttgccaaatcaaatgagtgacaggttaactagaaaatgtgacaatcacatttcctcttagctcaaataattctgtttttccaaagctttagcagcttaattaaatctgttggactgggggaggagagagctgttctctagtggttaacatggtattctttaagaagaaaaaacaaagccaaagattttcatctcttttcaaagctgcatatctcttatatttggtattggcctctaagtctaatattgcagttggaattcttgctgtattattttttaagcaagtgttaggtgcatttaactgctttcttcatccatgacgacattcccaccatgggggtcttgacaaagcagagtaaaaatatgctgtttacattgtttacttacaagtaaggagcctgaaataacctgtagtttcgaatgcaggccctgatttactggcgttgtcagtttcaattatgaaactgaagtttggtgcctcctctttatcatgttttttcccttgtagcagttgtgtttaatgtcattaaaaagaaataaaagttctttgtcagtgaaaaaaaaaat

SEQ ID NO: 27432 - DNA, 1191 bp, Homo sapiens
agaagcagaggagaccaacggaccggacagagacgaggagaggaacaggaagagagaagctgggagaatcgggaacctgggggctagtgacctgcacacagggcaggggcactcggcagttcccagaggccacccctcccaccccagacatccagacatctggaactttgggtgccaagagtccagcttaatgcaggcagcctggcttttgggggctttggtggtcccccagctcttgggctttggccatggggctcggggagcagagagggagtgggagggaggctggggaggtgcccaggaggaggagcgggagagggaggccctgatgctgaagcatctgcaggaagccctaggactgcctgctgggaggggggatgagaatcctgccggaactgttgagggaaaagaggactgggagatggaggaggaccagggggaggaagaggaggaggaagcaacgccaaccccatcctccggccccagcccctctcccacccctgaggacatcgtcacttacatcctgggccgcctggccggcctggacgcaggcctgcaccagctgcacgtccgtctgcacgcgttggacacccgcgtggtcgagctgacccaggggctgcggcagctgcggaacgcggcaggcgacacccgcgatgccgtgcaagccctgcaggaggcgcagggtcgcgccgagcgcgagcacggccgcttggagggctgcctgaaggggctgcgcctgggccacaagtgcttcctgctctcgcgcgacttcgaaggcgcccagcccagcgcctcgccgcatccgctcagcccggaccagcccaacggtggcacgctcgagaactgcgtggcgcaggcctctgacgacggctcctggtgggaccacgactgccagcggcgtctctactacgtctgcgagttccccttctagcggggccggtaccccgcctccctgcccatcccaccacccggcctttccctgcgccgtgcccaccctcctccggaatcgcccttcccttcctggccacgaatggcagcgtcctccccgacccccagtctgggcgcttctgggagggctcttgcggtgccggcactcctccttgttagtgtctttccttgaaggggcgggcaccaggctaggtccggtgccaataaatccttgtggaatctgacttgaggggcaaaaaggca

SEQ ID NO: 27433 - DNA, 1250 bp, Homo sapiens
agaagcagaggagaccaacggaccggacagagacgaggagaggaacaggaagagagaagctgggagaatcgggaacctgggggctagtgacctgcacacagggcaggggcactcggcagttcccagaggccacccctcccaccccagacatccagacatctggaactttgggtgccaagagtccagcttaatgcaggcagcctggcttttgggggctttggtggtcccccagctcttgggctttggccatggggctcggggagcagagagggagtgggagggaggctggggaggtgcccaggaggaggagcgggagagggaggccctgatgctgaagcatctgcaggaagccctaggactgcctgctgggaggggggatgagaatcctgccggaactgttgagggaaaagaggactgggagatggaggaggaccagggggaggaagaggaggaggaagcaacgccaaccccatcctccggccccagcccctctcccacccctgaggacatcgtcacttacatcctgggccgcctggccggcctggacgcaggcctgcaccagctgcacgtccgtctgcacgcgttggacacccgcgtggtcgagctgacccaggggctgcggcagctgcggaacgcggcaggcgacacccgcgatgccgtgcaagccctgcaggaggcgcagggtcgcgccgagcgcgagcacggccgcttggagggctgcctgaaggggctgcgcctgggccacaagtgcttcctgctctcgcgcgacttcgaagctcaggcggcggcgcaggcgcggtgcacggcgcggggcgggagcctggcgcagccggcagaccgccagcagatggaggcgctcactcggtacctgcgcgcggcgctcgctccctacaactggcccgtgtggctgggcgtgcacgatcggcgcgccgagggcctctacctcttcgaaaacggccagcgcgtgtccttcttcgcctggcatcgctcaccccgccccgagctcggcgcccagcccagcgcctcgccgcatccgctcagcccggaccagcccaacggtggcacgctcgagaactgcgtggcgcaggcctctgacgacggctcctggtgggaccacgactgccagcggcgtctctactacgtctgcgagttccccttctagcggggccggtaccccgcctccctgcccatcaggctaggtccggtgccaataaatccttgtggaatctgacttgaggggcaaaaaggca

SEQ ID NO: 27434 - DNA, 1170 bp, Homo sapiens
agaagcagaggagaccaacggaccggacagagacgaggagaggaacaggaagagagaagctgggagaatcgggaacctgggggctagtgacctgcacacagggcaggggcactcggcagttcccagaggccacccctcccaccccagacatccagacatctggaactttgggtgccaagagtccagcttaatgcaggcagcctggcttttgggggctttggtggtcccccagctcttgggctttggccatggggctcggggagcagagagggagtgggagggaggctggggaggtgcccaggaggaggagcgggagagggaggccctgatgctgaagcatctgcaggaagccctaggactgcctgctgggaggggggatgagaatcctgccggaactgttgagggaaaagaggactgggagatggaggaggaccagggggaggaagaggaggaggaagcaacgccaaccccatcctccggccccagcccctctcccacccctgaggacatcgtcacttacatcctgggccgcctggccggcctggacgcaggcctgcaccagctgcacgtccgtctgcacgcgttggacacccgcgtggtcgagctgacccaggggctgcggcagctgcggaacgcggcaggcgacacccgcgatgccgtgcaagccctgcaggaggcgcagggtcgcgccgagcgcgagcacggccgcttggagggctgcctgaaggggctgcgcctgggccacaagtgcttcctgctctcgcgcgacttcgaagctcaggcggcggcgcaggcgcggtgcacggcgcggggcgggagcctggcgcagccggcagaccgccagcagatggaggcgctcactcggtactgccagcggcgtctctactacgtctgcgagttccccttctagcggggccggtaccccgcctccctgcccatcccaccacccggcctttccctgcgccgtgcccaccctcctccggaatcgcccttcccttcctggccacgaatggcagcgtcctccccgacccccagtctgggcgcttctgggagggctcttgcggtgccggcactcctccttgttagtgtctttccttgaaggggcgggcaccaggctaggtccggtgccaataaatccttgtggaatctgacttgaggggcaaaaaggca

SEQ ID NO: 27435 - DNA, 1422 bp, Homo sapiens
agaagcagaggagaccaacggaccggacagagacgaggagaggaacaggaagagagaagctgggagaatcgggaacctgggggctagtgacctgcacacagggcaggggcactcggcagttcccagaggccacccctcccaccccagacatccagacatctggaactttgggtgccaagagtccagcttaatgcaggcagcctggcttttgggggctttggtggtcccccagctcttgggctttggccatggggctcggggagcagagagggagtgggagggaggctggggaggtgcccaggaggaggagcgggagagggaggccctgatgctgaagcatctgcaggaagccctaggactgcctgctgggaggggggatgagaatcctgccggaactgttgagggaaaagaggactgggagatggaggaggaccagggggaggaagaggaggaggaagcaacgccaaccccatcctccggccccagcccctctcccacccctgaggacatcgtcacttacatcctgggccgcctggccggcctggacgcaggcctgcaccagctgcacgtccgtctgcacgcgttggacacccgcgtggtcgagctgacccaggggctgcggcagctgcggaacgcggcaggcgacacccgcgatgccgtgcaagccctgcaggaggcgcagggtcgcgccgagcgcgagcacggccgcttggagggctgcctgaaggggctgcgcctgggccacaagtgcttcctgctctcgcgcgacttcgaagctcaggcggcggcgcaggcgcggtgcacggcgcggggcgggagcctggcgcagccggcagaccgccagcagatggaggcgctcactcggtacctgcgcgcggcgctcgctccctacaactggcccgtgtggctgggcgtgcacgatcggcgcgccgagggcctctacctcttcgaaaacggccagcgcgtgtccttcttcgcctggcatcgctcaccccgccccgagctcggcgcccagcccagcgcctcgccgcatccgctcagcccggaccagcccaacggtggcacgctcgagaactgcgtggcgcaggcctctgacgacggctcctggtgggaccacgactgccagcggcgtctctactacgtctgcgagttccccttctagcggggccggtaccccgcctccctgcccatcccaccacccggcctttccctgcgccgtgcccaccctcctccggaatcgcccttcccttcctggccacgaatggcagcgtcctccccgacccccagtctgggcgcttctgggagggctcttgcggtgccggcactcctccttgttagtgtctttccttgaaggggcgggcaccaggctaggtccggtgccaataaatccttgtggaatctgacttgaggggcaaaaaggca

SEQ ID NO: 27436 - DNA, 1375 bp, Homo sapiens
agaagcagaggagaccaacggaccggacagagacgaggagaggaacaggaagagagaagctgggagaatcgggaacctgggggctagtgacctgcacacagggcaggggcactcggcagttcccagaggccacccctcccaccccagacatccagacatctggaactttgggtgccaagagtccagcttaatgcaggcagcctggcttttgggggctttggtggtcccccagctcttgggctttggccatggggctcggggagcagagagggagtgggagggaggctggggaggtgcccaggaggaggagcgggagagggaggccctgatgctgaagcatctgcaggaagccctaggactgcctgctgggaggggggatgagaatcctgccggaactgttgagggaaaagaggactgggagatggaggaggaccagggggaggaagaggaggaggaagcaacgccaaccccatcctccggccccagcccctctcccacccctgaggacatcgtcacttacatcctgggccgcctggccggcctggacgcaggcctgcaccagctgcacgtccgtctgcacgcgttggacacccgcgtggtcgagctgacccaggggctgcggcagctgcggaacgcggcaggcgacacccgcgatgccgtgcaagccctgcaggaggcgcagggtcgcgccgagcgcgagcacggccgcttggagggctgcctgaaggggctgcgcctgggccacaagtgcttcctgctctcgcgcgacttcgaagctcaggcggcggcgcaggcgcggtgcacggcgcggggcgggagcctggcgcagccggcagaccgccagcagatggaggcgctcactcggtacctgcgcgcggcgctcgctccctacaactggcccgtgtggctgggcgtgcacgatcggcgcgccgagggcctctacctcttcgaaaacggccagcgcgtgtccttcttcgcctggcatcgctcaccccgccccgagctcggcgcccagcccagcgcctcgccgcatccgctcagcccggaccagcccaacggtggcacgctcgagaactgcgtggcgcaggcctctgacgacggctcctggtgggaccacgactgccagcggcgtctctactacgtctgcgagttccccttctagcggggccggtaccccgcctccctgcccatcgcccttcccttcctggccacgaatggcagcgtcctccccgacccccagtctgggcgcttctgggagggctcttgcggtgccggcactcctccttgttagtgtctttccttgaaggggcgggcaccaggctaggtccggtgccaataaatccttgtggaatctgacttgaggggcaaaaaggca

SEQ ID NO: 27437 - DNA, 1043 bp, Homo sapiens
agaagcagaggagaccaacggaccggacagagacgaggagaggaacaggaagagagaagctgggagaatcgggaacctgggggctagtgacctgcacacagggcaggggcactcggcagttcccagaggccacccctcccaccccagacatccagacatctggaactttgggtgccaagagtccagcttaatgcaggcagctgggccgcctggccggcctggacgcaggcctgcaccagctgcacgtccgtctgcacgcgttggacacccgcgtggtcgagctgacccaggggctgcggcagctgcggaacgcggcaggcgacacccgcgatgccgtgcaagccctgcaggaggcgcagggtcgcgccgagcgcgagcacggccgcttggagggctgcctgaaggggctgcgcctgggccacaagtgcttcctgctctcgcgcgacttcgaagctcaggcggcggcgcaggcgcggtgcacggcgcggggcgggagcctggcgcagccggcagaccgccagcagatggaggcgctcactcggtacctgcgcgcggcgctcgctccctacaactggcccgtgtggctgggcgtgcacgatcggcgcgccgagggcctctacctcttcgggcgcccagcccagcgcctcgccgcatccgctcagcccggaccagcccaacggtggcacgctcgagaactgcgtggcgcaggcctctgacgacggctcctggtgggaccacgactgccagcggcgtctctactacgtctgcgagttccccttctagcggggccggtaccccgcctccctgcccatcccaccacccggcctttccctgcgccgtgcccaccctcctccggaatcgcccttcccttcctggccacgaatggcagcgtcctccccgacccccagtctgggcgcttctgggagggctcttgcggtgccggcactcctccttgttagtgtctttccttgaaggggcgggcaccaggctaggtccggtgccaataaatccttgtggaatctgacttgaggggcaaaaaggca

SEQ ID NO: 27438 - DNA, 740 bp, Homo sapiens
tttttgtccaatttgaaaaccagtacgacaaatatgacaaatattaatggatttgtgatttatgccagagaaaataaaaatttgtggattaaactgaaaaaccaacaagggctgtcaataaaagtggcctaatatcctctgaatttctgaaaacttgcccatctttgtatacttcagaaactctcaatgggatgtgcacagtagagtcatctgtaggaatcgttgctataccctgctctagagagtgaatcagaatctcctcagtagtttgattcccaaaaatacttctttaagtttttgagatgttcattctttggctaagaatcattttccctctaatgctacattgaagttaaactgtgaaaattcttacttaattttgtctttttactatcctgaaaatgttttgtacattacttatgaatgttatcctaacatttaagtaagcatctggccgggagcggtggctcatgcctgtaataccagcactttgggaggccaaggcgggaggatcacgaggtcaggagatggagactatcctggccaacacggtgaaaccgcgtctctactaaaaaaatacaaaaaaattagccgggcgtggtggcgggcaccagtagtcccagctactcaggaggctgaggcaggagagtggtgtgaacccgggaggcggagcttgcagtgagccgagatcgcgccactgcactccagcctgggtggcagccagactccgtctcaaaaaa

SEQ ID NO: 27439 - DNA, 3188 bp, Homo sapiens
  misc_feature (30)..(30): n is a, c, g, or t
  misc_feature (154)..(154): n is a, c, g, or t
  misc_feature (170)..(170): n is a, c, g, or t
  misc_feature (411)..(411): n is a, c, g, or t
ggggattgtggaagggtaggggaaggaganttctctctccccaggccactagataaaaggccatgtttgtccacattgggaggctgatgggaagaaaggatgccagaccagttggcctgtccctggggcttgtctcaggacctccaggaagtgnttctgaactgcaggcnctcgtgtgtgtctcccatttgtcaaaactttgacctgatcttttcagaatccaccttgtgaggccccagccttggaagccactgcccattgccagaacacggggagtagagcagtgagcactgagtgggcctgaggctgcctttcttccctggcacacgtcctgaggaggggaggttgtggcggcaccaggcagaagctatgccactgctgcgctgggtctccctccccagaagccctcantcttgatttgctcaagctgttcctgcttatcaacaaacaccttaatttatcaaacacagcaaagctagtgacagctgagaggtccatgtctgggtagaaccaggcccacgatgctgcctctcccgtgttctggagttcagctgcagggattctgctgatgtgcccagcaccatcgttctgtttgtgcttaaatggcacagcatttggtcagcacatctgaaaaggaaggtgtgagaagcaaagcccatggccacgttcccctgccagttatgtggcaagacgttcctcaccctggagaagttcacgattcacaattattcccactccagggagcggccgtacaagtgtgtgcagcctgactgtggcaaagcctttgtttccagatataaattgatgaggcatatggctacccattctccccagaaatctcaccagtgtgctcactgtgagaagacgttcaaccggaaagaccacctgaaaaaccacttccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagggtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaaatcactgtgtaaccagggttaagtggttaaaataatccagggcgtcagtcaaaggcattttgctgactttaatattgattatatttttaacagggaatttaaggaaaatattaccggggaattaaaaaatatatatatattaaaacaagaattttcctttgcccctgtccagcctaaacctacctacctcaaggctgcctaagttcctaagtattgtttgtaatcacccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgc

SEQ ID NO: 27440 - DNA, 129 bp, Homo sapiens
agtttcctttaacctggctttcagattaattcaggatttgggtaagctcttagcctcacactgactcaaaaatccaaacaaatatttatggcctagagagcatgtaaagcaaaacacctcactagaggg

SEQ ID NO: 27441 - DNA, 240 bp, Homo sapiens
catctcccactctggctcttcgcaggtccctaggagcccccatggtctcccctcaagcacattagactggttctccttgaagggtcttctgagtctagagtgaagatctctgagctccattcccagccactgccctgagattgtgagggcaatgcctttgtgatcctcagtttgcttaactataaagtggggctagaggaatccctaagatcccctccagctataatactctgtccttta

SEQ ID NO: 27442 - DNA, 383 bp, Homo sapiens
aaaaaaaaaaaaagctgtcaaaagaaaatgactttaaatgagtgtagatgttggagttagcagacaaagacttcaaagtagctattacaaatatgatcaaaagctaaaggaaaccatatttaaaagattaaaaggaaaatttatgacaatgactcaacaaataaggaatatcactgaagaaatagatactaaagaaccaaattgaaattctagtcaaattctctacccctgagccatacacccagtcatccaaactgaaattctagaggagaaaagtccaataagcaaaatgcaaaattcacaagattaattcaacagaagatttgagaacacagacgaatcaaagaacttaagatatatcaatggaaattatccaatttaaa

SEQ ID NO: 27443 - DNA, 1796 bp, Homo sapiens
gaactccgcctcatgcaggatgcccagggctcggaagcagtaaggaggatgctacagaaaggaactgcagaaagaaaaaaagccacatggttaacttttcccctggagggcaaaggggtccggctctcaaaaagaaaagccaggcacagatcccaacaccaagtgtaaggcagcacaaagtgggtctgaaaccccaggaccgggtcaaaggccttccgaaggcccgaggttcttgaggaggaggggaagctgatagggccctggtctttctgcaccagcgtggctctttaaaatacaaaacacccacaaagccaaaaaccctgaaacatgttctttagctaaccccttccctgcccagatgcctgcaattctgagaattcacttcagttttgccagatccaacccctaggcttgagggtggagagccaggcctcctcagggtcccttctaggctcccaggcccaccttaggctttaattgcattggctgtttcttatggtgttagtgaattttgcaaagaaagccctgagcattgcataaatgcttgggggcgtgtcatttaaatggaagttctccaatagtggctgaaggcagagtttactgttatccctccctcttgctggctttgctggagggcttttatcagagagattggaggtgggagagcacttttaaagcacaccccaccccctgcacccgagcggcacctaagcttcccagagaccatgaccttgtatgtggctggaggcctcaggcttagggagcagcctgaagcctttgctgtcaaccctcccaggaaagaagccgggcctcaggctgaggaaaaacagagtttcctctccagagggctcaatgagcagccgggtagtggcctcgggcagtcctcaccagggggacacctccctgctttgcattaactcatcagcaagctcatcgagagctaacgtgggcccagcagtcctgtgcttggaaatgatgccgtcacctccacactcctgctgttccagcctctgcaggtgaagctgcaaggtgagcagaggcaggcgtggggacacactcttcaaggactgcactgccccttctccctcctgagagctctgtgcactgggtttggggatgaggcgccagcctggtcaggggaggtgactgtggtccttctgaccagcttggatctttaaaataatcacaaaaaagctcagcctgagcaggtgggtgcaaggctcaggggcctgtgtttttcatcaatcagttttcttcctgcaagattcttagagctggatgttcacgggatcatggggcatggaggtggtcacgctcagacagtcatgcaccaccctcaatcccaggccctgcagagataggaagaatcccaaccagagggattcttccccaaacgttcccttgtggcccaagagtgagttccggcctgagtgctgttatgactgccggcgtctctccgactgcctctcgcctcagtttaaccatctataggttaggaacaaagaagggcttaggcagccatcgtttccccatttctgtcagagccaagggcttggaggaaagaagggagagggaggttccattcaccgttttctgggttagcgcttgattggatgtttcaagcaagggacaaggtgatggtggctgtaataggctcctcgtgggcaccgtcaccccagaaggcctgggcacccatgagaacctgtggccagcccttttcattggctgagttccctgctgttgtgcgtggtgccattttttttttaaacaacatatataaaaacaaaacaactggt

SEQ ID NO: 27444 - DNA, 3253 bp, Homo sapiens
gaactccgcctcatgcaggatgcccagggctcggaagcagtaaggaggatgctacagaaaggaactgcagaaagaaaaaaagccacatggttaacttttcccctggagggcaaaggggtccggctctcaaaaagaaaagccaggcacagatcccaacaccaagtgtaaggcagcacaaagtgggtctgaaaccccaggaccgggtcaaaggccttccgaaggcccgaggttcttgaggaggaggggaagctgatagggccctggtctttctgcaccagcgtggctctttaaaatacaaaacacccacaaagccaaaaaccctgaaacatgttctttagctaaccccttccctgcccagatgcctgcaattctgagaattcacttcagttttgccagatccaacccctaggcttgagggtggagagccaggcctcctcagggtcccttctaggctcccaggcccaccttaggctttaattgcattggctgtttcttatggtgttagtgaattttgcaaagaaagccctgagcattgcataaatgcttgggggcgtgtcatttaaatggaagttctccaatagtggctgaaggcagagtttactgttatccctccctcttgctggctttgctggagggcttttatcagagagattggaggtgggagagcacttttaaagcacaccccaccccctgcacccgagcggcacctaagcttcccagagaccatgaccttgtatgtggctggaggcctcaggcttagggagcagcctgaagcctttgctgtcaaccctcccaggaaagaagccgggcctcaggctgaggaaaaacagagtttcctctccagagggctcaatgagcagccgggtagtggcctcgggcagtcctcaccagggggacacctccctgctttgcattaactcatcagcaagctcatcgagagctaacgtgggcccagcagtcctgtgcttggaaatgatgccgtcacctccacactcctgctgttccagcctctgcaggtgaagctgcaaggtgagcagaggcaggcgtggggacacactcttcaaggactgcactgccccttctccctcctgagagctctgtgcactgggtttggggatgaggcgccagcctggtcaggggaggtgactgtggtccttctgaccagcttggatctttaaaataatcacaaaaaagctcagcctgagcaggtgggtgcaaggctcaggggcctgtgtttttcatcaatcagttttcttcctgcaagattcttagagctggatgttcacgggatcatggggcatggaggtggtcacgctcagacagtcatgcaccaccctcaatcccaggccctgcagagataggaagaatcccaaccagagggattcttccccaaacgttcccttgtggcccaagagtgagttccggcctgagtgctgttatgactgccggcgtctctccgactgcctctcgcctcagtttaaccatctataggttaggaacaaagaagggcttaggcagccatcgtttccccatttctgtcagagccaagggcttggaggcccagccccatccgggcaagggctgtccgctcctgcccaggcctcacctcctcgctgcagctggcaagattctttctagcagaacagaaacactggcccccaattccactctcccctcctgatgctaccgcagagggcagaaaggtgccctgtagcgtccaccatgtgtgtgtcctgagtttccagtgcaagtcatctggatttgcatttagctagggaaactcggccctcaaaccctctccctctctgcctgaatttgccaaaatgccaaccatccgggcaggtgtggatgccacagtccatccccattgcatttcacccccacatggacagaggcacacactcgcacacattcccagcacctttgactgctgggggatgcaggccagggtctgcctggagcctcagggttgggacttatctccaaaggagcccacaccccctcttccaggatgggcactggctggcagcacttttttccctcatcacatccctgacccctgcccagcccacatgcacatgctgtttcctgtctccagggccctagcctgtggatctcttcctcccatgcactcctagggtgaatgggctcagcaccaaacctggctgtgcccattccccacaaccccagcttggcctcctgtgggaaggagaaggcagacctgcccagaggagaggggcagtgttcccacccacctgctccagcacaggaaccagggaggaaagaagggagagggaggttccattcaccgttttctgggttagcgcttgattggatgtttcaagcaagggacaaggtgatggtggctgtaataggctcctcgtgggcaccgtcaccccagaaggcctgggcacccatgagaacctgtggccagcccttttcattggctgagttccctgctgttgtgcgtggtgccattttttttttaaacaacatatataaaaacaaaacaactggttctgtgtgtatcaacttaatttgcatatgaatgagtgttgtgttgtgatttgcagtgttttgacaccgtgattggctttgtttgggtctctcttctttctgtgaaattaactgctgtgcgttttcactgttcttagagaagaccctgagctcctggggttttcttgtctcacttctaccctgacctgctgggagcccaccccaccccagtccagccatgagggtatttccagcctattccaatgactgaaacccttcttggaagaaaacgtctaatgtcggggacgtagggacgcttccagacttgccctggccggaaccctgcagcctggggccccagcccgcctgcagctcagctttccccaacaccctcaggacccagccccagccccggcagaccttccctgggagctgcttaggtggtctccacagcgccctctaggggccaagcagggttccagattctccagccttctgccagctttaaaacccttcactcaagcagcattactgtacatgcaatgaaaaatactatatatgacagtcaaaacctgtgtacatatttccatgtacatatttatacatacacacaccttcctattataaatatataaagcatgacatctctttggcattccaagtttgtgtttttttaaatccttggaaatacggctttggaaacctttttcttcctttccctcttttctatgttgtaataaacattcatgtgaccttt

SEQ ID NO: 27445 - DNA, 3151 bp, Homo sapiens
gaactccgcctcatgcaggatgcccagggctcggaagcagtaaggaggatgctacagaaaggaactgcagaaagaaaaaaagccacatggttaacttttcccctggagggcaaaggggtccggctctcaaaaagaaaagccaggcacagatcccaacaccaagtgtaaggcagcacaaagtgggtctgaaaccccaggaccgggtcaaaggccttccgaaggcccgaggttcttgaggaggaggggaagctgatagggccctggtctttctgcaccagcgtggctctttaaaatacaaaacacccacaaagccaaaaaccctgaaacatgttctttagctaaccccttccctgcccagatgcctgcaattctgagaattcacttcagttttgccagatccaacccctaggcttgagggtggagagccaggcctcctcagggtcccttctaggctcccaggcccaccttaggctttaattgcattggctgtttcttatggtgttagtgaattttgcaaagaaagccctgagcattgcataaatgcttgggggcgtgtcatttaaatggaagttctccaatagtggctgaaggcagagtttactgttatccctccctcttgctggctttgctggagggcttttatcagagagattggaggtgggagagcacttttaaagcacaccccaccccctgcacccgagcggcacctaagcttcccagagaccatgaccttgtatgtggctggaggcctcaggcttagggagcagcctgaagcctttgctgtcaaccctcccaggaaagaagccgggcctcaggctgaggaaaaacagagtttcctctccagagggctcaatgagcagccgggtagtggcctcgggcagtcctcaccagggggacacctccctgctttgcattaactcatcagcaagctcatcgagagctaacgtgggcccagcagtcctgtgcttggaaatgatgccgtcacctccacactcctgctgttccagcctctgcaggtgaagctgcaaggtgagcagaggcaggcgtggggacacactcttcaaggactgcactgccccttctccctcctgagagctctgtgcactgggtttggggatgaggcgccagcctggtcaggggaggtgactgtggtccttctgaccagcttggatctttaaaataatcacaaaaaagctcagcctgagcaggtgggtgcaaggctcaggggcctgtgtttttcatcaatcagttttcttcctgcaagattcttagagctggatgttcacgggatcatggggcatggaggtggtcacgctcagacagtcatgcaccaccctcaatcccaggccctgcagagataggaagaatcccaaccagagggattcttccccaaacgttcccttgtggcccaagagtgagttccggcctgagtgctgttatgactgccggcgtctctccgactgcctctcgcctcagtttaaccatctataggttaggaacaaagaagggcttaggcagccatcgtttccccatttctgtcagagccaagggcttggaggcccagccccatccgggcaagggctgtccgctcctgcccaggcctcacctcctcgctgcagctggcaagattctttctagcagaacagaaacactggcccccaattccactctcccctcctgatgctaccgcagagggcagaaaggtgccctgtagcgtccaccatgtgtgtgtcctgagtttccagtgcaagtcatctggatttgcatttagctagggaaactcggccctcaaaccctctccctctctgcctgaatttgccaaaatgccaaccatccgggcaggtgtggatgccacagtccatccccattgcatttcacccccacatggacagaggcacacactcgcacacattcccagcacctttgactgctgggggatgcaggccagggtctgcctggagcctcagggttgggacttatctccaaaggagcccacaccccctcttccaggatgggcactggctggcagcacttttttccctcatcacatccctgacccctgcccagcccacatgcacatgctgtttcctgtctccagggccctagcctgtggatctcttcctcccatgcactcctagggtgaatgggctcagcaccaaacctggctgtgcccattccccacaaccccagcttggcctcctgtgggaaggagaaggcagacctgcccagaggagaggggcagtgttcccacccacctgctccagcacaggaaccagggaggaaagaagggagagggaggttccattcaccgttttctgggttagcgcttgattggatgtttcaagcaagggacaaggtgatggtggctgtaataggctcctcgtgggcaccgtcaccccagaaggcctgggcacccatgagaacctgtggccagcccttttcattggctgagttccctgctgttgtgcgtggtgccattttttttttaaacaacatatataaaaacaaaacaactggttctgtgtgtatcaacttaatttgcatatgaatgagtgttgtgttgtgatttgcagtgttttgacaccgtgattggctttgtttgggtctctcttctttctgtgaaattaactgctgtgcgttttcactgttcttagagaagaccctgagctcctggggttttcttgtctcacttctaccctgacctgctgggagcccaccccaccccagtccagccatgagggtatttccagcctattccaatgactgaaacccttcttggaagaaaacgtctaatgtcggggacgtagggacgcttccagacttgccctggccggaaccctgcagcctggggccccagcccgcctgcagctcagctttccccaacaccctcaggacccagccccagccccggcagaccttccctgggagctgcttaggtggtctccacagcgccctctaggggccaagcagggttccagattctccagccttctgccagctttaaaacccttcactcaagcagcattactgtacatgcaatgaaaaatactatatatgacagtcaaaacctgtgtacatatttccatgtacatatttatacatacacacaccttcctattataaatatataaagcatgacatctctttggca

SEQ ID NO: 27446 - DNA, 2518 bp, Homo sapiens
gaactccgcctcatgcaggatgcccagggctcggaagcagtaaggaggatgctacagaaaggaactgcagaaagaaaaaaagccacatggttaacttttcccctggagggcaaaggggtccggctctcaaaaagaaaagccaggcacagatcccaacaccaagtgtaaggcagcacaaagtgggtctgaaaccccaggaccgggtcaaaggccttccgaaggcccgaggttcttgaggaggaggggaagctgatagggccctggtctttctgcaccagcgtggctctttaaaatacaaaacacccacaaagccaaaaaccctgaaacatgttctttagctaaccccttccctgcccagatgcctgcaattctgagaattcacttcagttttgccagatccaacccctaggcttgagggtggagagccaggcctcctcagggtcccttctaggctcccaggcccaccttaggctttaattgcattggctgtttcttatggtgttagtgaattttgcaaagaaagccctgagcattgcataaatgcttgggggcgtgtcatttaaatggaagttctccaatagtggctgaaggcagagtttactgttatccctccctcttgctggctttgctggagggcttttatcagagagattggaggtgggagagcacttttaaagcacaccccaccccctgcacccgagcggcacctaagcttcccagagaccatgaccttgtatgtggctggaggcctcaggcttagggagcagcctgaagcctttgctgtcaaccctcccaggaaagaagccgggcctcaggctgaggaaaaacagagtttcctctccagagggctcaatgagcagccgggtagtggcctcgggcagtcctcaccagggggacacctccctgctttgcattaactcatcagcaagctcatcgagagctaacgtgggcccagcagtcctgtgcttggaaatgatgccgtcacctccacactcctgctgttccagcctctgcaggtgaagctgcaaggtgagcagaggcaggcgtggggacacactcttcaaggactgcactgccccttctccctcctgagagctctgtgcactgggtttggggatgaggcgccagcctggtcaggggaggtgactgtggtccttctgaccagcttggatctttaaaataatcacaaaaaagctcagcctgagcaggtgggtgcaaggctcaggggcctgtgtttttcatcaatcagttttcttcctgcaagattcttagagctggatgttcacgggatcatggggcatggaggtggtcacgctcagacagtcatgcaccaccctcaatcccaggccctgcagagataggaagaatcccaaccagagggattcttccccaaacgttcccttgtggcccaagagtgagttccggcctgagtgctgttatgactgccggcgtctctccgactgcctctcgcctcagtttaaccatctataggttaggaacaaagaagggcttaggcagccatcgtttccccatttctgtcagagccaagggcttggaggcccagccccatccgggcaagggctgtccgctcctgcccaggcctcacctcctcgctgcagctggcaagattctttctagcagaacagaaacactggcccccaattccactctcccctcctgatgctaccgcagagggcagaaaggtgccctgtagcgtccaccatgtgtgtgtcctgagtttccagtgcaagtcatctggatttgcatttagctagggaaactcggccctcaaaccctctccctctctgcctgaatttgccaaaatgccaaccatccgggcaggtgtggatgccacagtccatccccattgcatttcacccccacatggacagaggcacacactcgcacacattcccagcacctttgactgctgggggatgcaggccagggtctgcctggagcctcagggttgggacttatctccaaaggagcccacaccccctcttccaggatgggcactggctggcagcacttttttccctcatcacatccctgacccctgcccagcccacatgcacatgctgtttcctgtctccagggccctagcctgtggatctcttcctcccatgcactcctagggtgaatgggctcagcaccaaacctggctgtgcccattccccacaaccccagcttggcctcctgtgggaaggagaaggcagacctgcccagaggagaggggcagtgttcccacccacctgctccagcacaggaaccagggaggaaagaagggagagggaggttccattcaccgttttctgggttagcgcttgattggatgtttcaagcaagggacaaggtgatggtggctgtaataggctcctcgtgggcaccgtcaccccagaaggcctgggcacccatgagaacctgtggccagcccttttcattggctgagttccctgctgttgtgcgtggtgccattttttttttaaacaacatatataaaaacaaaacaactggt

SEQ ID NO: 27447 - DNA, 3095 bp, Homo sapiens
gaactccgcctcatgcaggatgcccagggctcggaagcagtaaggaggatgctacagaaaggaactgcagaaagaaaaaaagccacatggttaacttttcccctggagggcaaaggggtccggctctcaaaaagaaaagccaggcacagatcccaacaccaagtgtaaggcagcacaaagtgggtctgaaaccccaggaccgggtcaaaggccttccgaaggcccgaggttcttgaggaggaggggaagctgatagggccctggtctttctgcaccagcgtggctctttaaaatacaaaacacccacaaagccaaaaaccctgaaacatgttctttagctaaccccttccctgcccagatgcctgcaattctgagaattcacttcagttttgccagatccaacccctaggcttgagggtggagagccaggcctcctcagggtcccttctaggctcccaggcccaccttaggctttaattgcattggctgtttcttatggtgttagtgaattttgcaaagaaagccctgagcattgcataaatgcttgggggcgtgtcatttaaatggaagttctccaatagtggctgaaggcagagtttactgttatccctccctcttgctggctttgctggagggcttttatcagagagattggaggtgggagagcacttttaaagcacaccccaccccctgcacccgagcggcacctaagcttcccagagaccatgaccttgtatgtggctggaggcctcaggcttagggagcagcctgaagcctttgctgtcaaccctcccaggaaagaagccgggcctcaggctgaggaaaaacagagtttcctctccagagggctcaatgagcagccgggtagtggcctcgggcagtcctcaccagggggacacctccctgctttgcattaactcatcagcaagctcatcgagagctaacgtgggcccagcagtcctgtgcttggaaatgatgccgtcacctccacactcctgctgttccagcctctgcaggtgaagctgcaaggtgagcagaggcaggcgtggggacacactcttcaaggactgcactgccccttctccctcctgagagctctgtgcactgggtttggggatgaggcgccagcctggtcaggggaggtgactgtggtccttctgaccagcttggatctttaaaataatcacaaaaaagctcagcctgagcaggtgggtgcaaggctcaggggcctgtgtttttcatcaatcagttttcttcctgcaagattcttagagctggatgttcacgggatcatggggcatggaggtggtcacgctcagacagtcatgcaccaccctcaatcccaggccctgcagagataggaagaatcccaaccagagggattcttccccaaacgttcccttgtggcccaagagtgagttccggcctgagtgctgttatgactgccggcgtctctccgactgcctctcgcctcagtttaaccatctataggttaggaacaaagaagggcttaggcagccatcgtttccccatttctgtcagagccaagggcttggaggcccagccccatccgggcaagggctgtccgctcctgcccaggcctcacctcctcgctgcagctggcaagattctttctagcagaacagaaacactggcccccaattccactctcccctcctgatgctaccgcagagggcagaaaggtgccctgtagcgtccaccatgtgtgtgtcctgagtttccagtgcaagtcatctggatttgcatttagctagggaaactcggccctcaaaccctctccctctctgcctgaatttgccaaaatgccaaccatccgggcaggtgtggatgccacagtccatccccattgcatttcacccccacatggacagaggcacacactcgcacacattcccagcacctttgactgctgggggatgcaggccagggtctgcctggagcctcagggttgggacttatctccaaaggagcccacaccccctcttccaggatgggcactggctggcagcacttttttccctcatcacatccctgacccctgcccagcccacatgcacatgctgtttcctgtctccagggccctagcctgtggatctcttcctcccatgcactcctagggtgaatgggctcagcaccaaacctggctgtgcccattccccacaaccccagcttggcctcctgtgggaaggagaaggcagacctgcccagaggagaggggcagtgttcccacccacctgctccagcacaggaaccagggaggaaagaagggagagggaggttccattcaccgttttctgggttagcgcttgattggatgtttcaagcaagggacaaggtgatggtggctgtaataggctcctcgtgggcaccgtcaccccagaaggcctgggcacccatgagaacctgtggccagcccttttcattggctgagttccctgctgttgtgcgtggtgccattttttttttaaacaacatatataaaaacaaaacaactggttctgtgtgtatcaacttaatttgcatatgaatgagtgttgtgttgtgatttgcagtgttttgacaccgtgattggctttgtttgggtctctcttctttctgtgaaattaactgctgtgcgttttcactgttcttagagaagaccctgagctcctggggttttcttgtctcacttctaccctgacctgctgggagcccaccccaccccagtccagccatgagggtatttccagcctattccaatgactgaaacccttcttggaagaaaacgtctaatgtcggggacgtagggacgcttccagaattctccagccttctgccagctttaaaacccttcactcaagcagcattactgtacatgcaatgaaaaatactatatatgacagtcaaaacctgtgtacatatttccatgtacatatttatacatacacacaccttcctattataaatatataaagcatgacatctctttggcattccaagtttgtgtttttttaaatccttggaaatacggctttggaaacctttttcttcctttccctcttttctatgttgtaataaacattcatgtgaccttt

SEQ ID NO: 27448 - DNA, 424 bp, Homo sapiens
aggatcataggatagggaatggtgactttccaaaggagaacttaaccactttaagaaaaccacagctctccaggctctcccaggtaaccaaagtttataatggcactgctctccccaactccctgtcccttgactgagtattgaacgtaaccgtataattgagctcctgcgtgtagcaggtggcatgggtgccagacccttccaccccacactcacccccagcatctgtgatttaatcacagcagagcttttctttctctggcatgtgttctcccaagtctgaagcccagactgtaagtggcagccgtgcagaacgtagctgcctcagggcttcccttgcctccttggctgagtgaagctgagctgccagggttcaggttggttgaacacattcagagagagtgtgtgtgtctgtctgtctgtc

SEQ ID NO: 27449 - DNA, 290 bp, Homo sapiens
atcattttattcaaaagtacacgtactcccaaattccagtgactttaggaacattgctgaggccaagagggagggcagggaagggtaactcatgtgttgtatgacccccgttgtgctcaaaaggccttctattttttttccttcctacattttccgtttgcgcttcatgttctccttcccagaccccccagccgctgcatagtctcctctcttcttcagaataactgctccctgatgagaaatctcaactcaagctgaattacccaagcaggcttattaagctattttcc

SEQ ID NO: 27450 - DNA, 396 bp, Homo sapiens
gctattgtaattttcaccatttacaatgccaagttttgtttcagaaataatgcagcaatatccaacttgtagaaaatgtatgttagtgcattttattagttgctgtagggtaaaaacattaaatacaaaaaagtagagatgagaatgttgattatatgtatcaattatatataatatgtaaatttgaagatctaatccttaccaaaagatttcaggtagtctcattaaaacagtaaggaattatgtagggcagtattatagtaatactagaaaatcactcatgtggctaggtgctgtggctcatgcctgtaatcccagcactttgggaggccgaggcaggcgaatcacgaggtcaggagttcgagaccagcctgaccaatatggtgatgccctgtc

SEQ ID NO: 27451 - DNA, 172 bp, Homo sapiens
gggacctccaccattcaggacaagcagtgctctaattatttgctagagctgatcggaaatctgggcttaaggcaccatctggtagtgaaaaagagatgacctagtaagaaattaaaaaaaaagaaagaaagccaacaagtaaattaaaaggaatgtctaaccaaatatagac

SEQ ID NO: 27452 - DNA, 3928 bp, Homo sapiens
  misc_feature (1)..(8): n is a, c, g, or t
  misc_feature (16)..(16): n is a, c, g, or t
  misc_feature (2425)..(2425): n is a, c, g, or t
  misc_feature (2496)..(2496): n is a, c, g, or t
  misc_feature (3922)..(3922): n is a, c, g, or t
nnnnnnnngaaggatntgcgccgaaagcctcgggcggccttttgaggggctcgggctagcttcagcgccgtggggtctgacctggctggatatagtgtaccggcccggcaggaggggcggcccggtccgggttgcgcctcctggagccgcccccgggacgtcagtcctggaggaggcgagggttgctccggttgctaagaagactatgaacaagtcagagaacctgctgtttgctggttcatcattagcatcacaagtccatgctgctgccgttaatggagataagggtgctctacagaggctcatcgtaggaaactctgctcttaaagacaaagaagatcagtttgggagaacaccacttatgtattgcgtgttggctgacagattggattgtgcagatgctcttctgaaggcaggagcagatgtgaataaaactgaccatagccagagaacagccctccatcttgcagcccagaagggaaattatcgtttcatgaaactcttacttacacgcagagcaaactggatgcaaaaggatctggaagagatgactcctttgcacttgaccacccggcacaggagccctaagtgtttggcacttctgctgaagtttatggcaccaggagaagtggatacacaggataaaaacaagcaaacagctctgcattggagtgcctactacaataaccctgagcatgtgaagctgctcatcaagcatgattctaacattgggattcctgatgttgaaggcaagatcccacttcactgggcagccaaccataaagatccaagtgctgttcacacagtgagatgcattctggatgctgctccaacagagtctttactgaactggcaagactacgagggtcgaactcctcttcactttgcagttgctgatgggaatgtgaccgtggttgatgtcttgacctcatatgaaagctgcaatataacgtcttatgataacttatttcgaaccccactgcactgggcagctttattaggccatgcacagattgtccatctccttttagaaagaaataagtctggaactatcccatctgacagccaaggagccacacctttgcactatgctgctcagagtaactttgctgaaacggttaaagtgtttttaaaacatccttcagtgaaagatgattcagacctggaaggaagaacatcctttatgtgggcagctggcaaaggcagtgatgatgtccttagaactatgctgagcttaaaatcggacatagatattaacatggctgacaaatatggaggtacagctttgcatgctgctgctctttctggccatgtcagcaccgtgaagttattactggaaaataatgctcaagtagatgctactgatgttatgaaacatactccacttttccgagcctgtgagatgggacacaaagatgtgattcagacactcattaaaggtggagcaagggtagatctagttgaccaagatggacattctcttctacattgggcagcactgggaggaaatgctgatgtttgccagatattaatagaaaataagatcaatccaaatgtccaggattatgcaggaagaacccctttgcagtgtgcagcatatggaggctatatcaactgcatggcagttctcatggaaaacaatgcagaccctaacattcaagacaaagagggaagaacagctttgcattggtcctgcaacaatggataccttgatgccattaaattactgctagactttgctgctttccctaatcagatggaaaacaatgaagagagatacacaccccttgattatgctttgcttggtgagcgccatgaagtgatccagttcatgttggagcacggtgccctgtccatcgcagccatacaagacatcgccgccttcaaaatccaagctgtctacaaagggtacaaggtcagaaaagccttccgagacaggaaaaatctcctcatgaagcatgaacagttgagaaaagatgctgctgccaaaaagcgagaggaagaaaacaaacgaaaagaggcagaacagcaaaaaggaaggcggagcccagattcctgcagaccccaggcccttccctgtctgcctagcacccaggatgtgcccagcaggcagagccgggcccccagcaagcagcctcctgctggcaacgtggcccaaggccctgagccaagagacagcagaggatctccaggagggtctctaggcggagccctccagaaggagcagcatgtttcctcagatttgcagggaacaaactccagaaggccaaatgaaacagccagagaacattctaaaggccaatctgcttgtgtccacttcagacccaatgaaggcagtgatggaagcaggcatccaggagttccctctgttgagaagtccagaggtgagacagctggcgatgagcggtgtgcaaaggggaaaggnttcgtgaagcagccctcctgtatcagggtggctgggcctgatgagaaaggagaggactccaggcgggcagntgcaagccttccaccgcacgatagccactggaagcccagcaggcggcatgacacagaacccaaggccaaatgtgccccccagaaaaggcgcactcaagagctcagaggaggaaggtgctctccggctggttctagccgccctggcagtgcccggggggaggcggtccatgctgggcagaatcctccccaccatcgtacaccaagaaacaaagtgacacaagccaagctcacaggagggctctattcacatttgccacagagcacagaggagttgaggtcaggagctaggaggctggagacatctaccctgtccgaggactttcaggtatctaaggagactgatccagcacctggtcccctctctgggcagagtgtgaatattgaccttctccccgtagagctccgactgcagataattcagagagaacgaaggaggaaggagctgtttcgcaaaaagaacaaggcagcagcagtcatccagcgcgcctggcgaagctaccagctcaggaagcacctgtcccaccttcggcatatgaagcagcttggagctggagatgtggacagatggaggcaagagtctacagcattgctcctccaggtttggaggaaggaactggaactaaaattcccccaaaccactgcagtaagcaaggcccccaagagtccatccaagggcacctcaggcacaaagtccaccaagcactcagtgcttaagcaaatctatggttgttctcacgaagggaaaatacatcatcctacaagatctgtaaaagcctcttctgtgctgcgtctcaactcagtgagcaacctacagtgtatacatctccttgagaacagtggaagatcaaagaacttttcttataacctgcaatcagctactcagccaaaaaacaaaacaaaaccttgactgcctatggaggaagactgtgttcgggggagctggcatagctagtgcagagttcagattttctgctgataatcttttacaccttgggaaaactttaatatccgtacctgaaggctgattcacctaaaaatgtgttaactgaaagaaaatgtcagaatgtttcctttctgctcttacacagcattgttttgtcaatcaacacagcctgcactgaaaggacctgcatagactatgtctgtgcaaagtgcctgagtgtctgctttcacctcagtctgtacagttggaaatgagaattcataattaacagcaaaatctaaggaaaactaccgctgctgggttgggatttctgccagctagcctggtactggcttcttgtttcaagagatgaacctaaatgagataggaagcctgtcccatagcagccttcctctcactactttcctggcatctaatgcaacaaacttatcacactcactcacccaccacattaacaacataaaaccctcattcacacgaganaacacc

SEQ ID NO: 27453 - DNA, 3529 bp, Homo sapiens
  misc_feature (1)..(8): n is a, c, g, or t
  misc_feature (16)..(16): n is a, c, g, or t
  misc_feature (3523)..(3523): n is a, c, g, or t
nnnnnnnngaaggatntgcgccgaaagcctcgggcggccttttgaggggctcgggctagcttcagcgccgtggggtctgacctggctggatatagtgtaccggcccggcaggaggggcggcccggtccgggttgcgcctcctggagccgcccccgggacgtcagtcctggaggaggcgagggagtagaagaccaccaggctgcctaagaaggaatgaactggtccacgtcaaaactcctatgctgatcgtagtgggattgcacctatgaatagccactgccctccagcctaggttgctccggttgctaagaagactatgaacaagtcagagaacctgctgtttgctggttcatcattagcatcacaagtccatgctgctgccgttaatggagataagggtgctctacagaggctcatcgtaggaaactctgctcttaaagacaaagaagatcagtttgggagaacaccacttatgtattgcgtgttggctgacagattggattgtgcagatgctcttctgaaggcaggagcagatgtgaataaaactgaccatagccagagaacagccctccatcttgcagcccagaagggaaattatcgtttcatgaaactcttacttacacgcagagcaaactggatgcaaaaggatctggaagagatgactcctttgcacttgaccacccggcacaggagccctaagtgtttggcacttctgctgaagtttatggcaccaggagaagtggatacacaggataaaaacaagcaaacagctctgcattggagtgcctactacaataaccctgagcatgtgaagctgctcatcaagcatgattctaacattgggattcctgatgttgaaggcaagatcccacttcactgggcagccaaccataaagatccaagtgctgttcacacagtgagatgcattctggatgctgctccaacagagtctttactgaactggcaagactacgagggtcgaactcctcttcactttgcagttgctgatgggaatgtgaccgtggttgatgtcttgacctcatatgaaagctgcaatataacgtcttatgataacttatttcgaaccccactgcactgggcagctttattaggccatgcacagattgtccatctccttttagaaagaaataagtctggaactatcccatctgacagccaaggagccacacctttgcactatgctgctcagagtaactttgctgaaacggttaaagtgtttttaaaacatccttcagtgaaagatgattcagacctggaaggaagaacatcctttatgtgggcagctggcaaaggcagtgatgatgtccttagaactatgctgagcttaaaatcggacatagatattaacatggctgacaaatatggaggtacagctttgcatgctgctgctctttctggccatgtcagcaccgtgaagttattactggaaaataatgctcaagtagatgctactgatgttatgaaacatactccacttttccgagcctgtgagatgggacacaaagatgtgattcagacactcattaaaggtggagcaagggtagatctagttgaccaagatggacattctcttctacattgggcagcactgggaggaaatgctgatgtttgccagatattaatagaaaataagatcaatccaaatgtccaggattatgcaggaagaacccctttgcagtgtgcagcatatggaggctatatcaactgcatggcagttctcatggaaaacaatgcagaccctaacattcaagacaaagagggaagaacagctttgcattggtcctgcaacaatggataccttgatgccattaaattactgctagactttgctgctttccctaatcagatggaaaacaatgaagagagatacacaccccttgattatgctttgcttggtgagcgccatgaagtgatccagttcatgttggagcacggtgccctgtccatcgcagccatacaagacatcgccgccttcaaaatccaagctgtctacaaagggtacaaggtcagaaaagccttccgagacaggaaaaatctcctcatgaagcatgaacagttgagaaaagatgctgctgccaaaaagcgagaggaagaaaacaaacgaaaagaggcagaacagcaaaaaggaaggcggagcccagattcctgcagaccccaggcccttccctgtctgcctagcacccaggatgtgcccagcaggcagagccgggcccccagcaagcagcctcctgctggcaacgtggcccaaggccctgagccaagagacagcagaggatctccaggagggtctctaggcggagccctccagaaggagcagcatgtttcctcagatttgcagggaacaaactccagaaggccaaatgaaacagccagagaacattctaaaggccaatctgcttgtgtccacttcagacccaatgaaggcagtgatggaagcaggcatccaggagttccctctgttgagaagtccagagagctccgactgcagataattcagagagaacgaaggaggaaggagctgtttcgcaaaaagaacaaggcagcagcagtcatccagcgcgcctggcgaagctaccagctcaggaagcacctgtcccaccttcggcatatgaagcagcttggagctggagatgtggacagatggaggcaagagtctacagcattgctcctccaggtttggaggaaggaactggaactaaaattcccccaaaccactgcagtaagcaaggcccccaagagtccatccaagggcacctcaggcacaaagtccaccaagcactcagtgcttaagcaaatctatggttgttctcacgaagggaaaatacatcatcctacaagatctgtaaaagcctcttctgtgctgcgtctcaactcagtgagcaacctacagtgtatacatctccttgagaacagtggaagatcaaagaacttttcttataacctgcaatcagctactcagccaaaaaacaaaacaaaaccttgactgcctatggaggaagactgtgttcgggggagctggcatagctagtgcagagttcagattttctgctgataatcttttacaccttgggaaaactttaatatccgtacctgaaggctgattcacctaaaaatgtgttaactgaaagaaaatgtcagaatgtttcctttctgctcttacacagcattgttttgtcaatcaacacagcctgcactgaaaggacctgcatagactatgtctgtgcaaagtgcctgagtgtctgctttcacctcagtctgtacagttggaaatgagaattcataattaacagcaaaatctaaggaaaactaccgctgctgggttgggatttctgccagctagcctggtactggcttcttgtttcaagagatgaacctaaatgagataggaagcctgtcccatagcagccttcctctcactactttcctggcatctaatgcaacaaacttatcacactcactcacccaccacattaacaacataaaaccctcattcacacgaganaacacc

SEQ ID NO: 27454 - DNA, 391 bp, Homo sapiens
cactttcataactaggcatcaattctggccataatggcttattttaaactaatttgcctgtcaaaaaaatctgtaaaaactgaataaaatactatatacattgtttgaaggcattgagaacaatcagcacaggcaggatctaagagactacaatcattcaaagaagagaaacacgtaaagtgagtaccacattcatcctggccttttcctttatgacattttccaaactggaatgcaaaagaatacaaccctaacaggaagcagcagccttaccaggctgaagaaactgaggcagagtttggagataatagtggctggaacttgaaagtcaaaatcctggagaggagggaattgcagagaaagaatgcaagaatctggatacaaattcctc

SEQ ID NO: 27455 - DNA, 496 bp, Homo sapiens
aagtgcctgctctctcttaatcaagtctcccttgaagagatgtcccatatcttgagactgcaggaaatataaagctattatattaagtcatcctgcctctacagtaaactggcccatcatcccagggatagcctaaaccgaaatccttcttcctcaacaccaatgaactattcccttcagccttaaaattaataaccttaatatctatctggtatttgtttttaacagtgagcaacctacagtgtatacatctccttgagaacagtggaagatcaaagaacttttcttataacctgcaatcagctactcagccaaaaaacaaaacaaaaccttgactgcctatggaggaagactgtgttcgggggagctggcatagctagtgcagagttcagattttctgctgataatcttttacaccttgggaaaactttaatatccgtacctgaaggctgattcacctaaaaatgtgttaactgaaagaaaatgtcagaatgtt

SEQ ID NO: 27456 - DNA, 444 bp, Homo sapiens
agatacattatggaggcagaagtgttcattcaacaagcgtttgttaaatatctactatgtaatcatgattatacaactagagagaatatgaaaaaaatgaattacgtatgttagcttatagatggatgctctcagtacccatccctattaatcgtcatttccctttgtttagtgaaccttctgatatattggatatcaaatatcctttccaagtattgtctgtcccacttaattctggtatccatgaatgcagaagtgtgctatttatgtaatcatgaacactcatgtatatgtgtataccttcattcattcaacatgtgttaaaactattatgtaacaggcatcatgttaggccttggaacacaaaggtgaacaacatgattcctgctcttaagttgcttacaaagatcatggatgaagatattaaatgataattaaagctga

SEQ ID NO: 27457 - DNA, 1704 bp, Homo sapiens
  misc_feature (1)..(8): n is a, c, g, or t
  misc_feature (16)..(16): n is a, c, g, or t
nnnnnnnngaaggatntgcgccgaaagcctcgggcggccttttgaggggctcgggctagcttcagcgccgtggggtctgacctggctggatatagtgtaccggcccggcaggaggggcggcccggtccgggttgcgcctcctggagccgcccccgggacgtcagtcctggaggaggcgagggttgctccggttgctaagaagactatgaacaagtcagagaacctgctgtttgctggttcatcattagcatcacaagtccatgctgctgccgttaatggagataagggtgctctacagaggctcatcgtaggaaactctgctcttaaagacaaagaagatcagtttgggagaacaccacttatgtattgcgtgttggctgacagattggattgtgcagatgctcttctgaaggcaggagcagatgtgaataaaactgaccatagccagagaacagccctccatcttgcagcccagaaggcattgagaacaatcagcacaggcaggatctaagagactacaatcattcaaagaagagaaacacgtaaagtgagtaccacattcatcctggccttttcctttatgacattttccaaactggaatgcaaaagaatacaaccctaacaggaagcagcagccttaccaggctgaagaaactgaggcagagtttggagataatagtggctggaacttgaaagtcaaaatcctggagaggagggaattgcagagaaagaatgcaagaatctggatacaaattcctcacaagtttttaacagattcctaaactgtgcttgtatagggtggtgctctaagaaacctagtattaaacaacagctgggagactagacagctgagtagagattattttaaattatcctatattttcttttatgtttaaatctcttaatatataacacattgatttttgtatggggatccattctcattttaaagcatatggataactaattttcccaacacaacctagttcattaatttttggccatttagtatctgctctctgtcagttccaggcttttgtactacgaactccctatgcatttctgtttttttaaatgagggatcctgaatactagggagcctttgggaaatttgaaaataaaagttacatgatcagtgtattttagggggactaatatggcaactaaagctactttggaagagaaagagtggagatacatagattgctattatagttcaggccaatagagaggaattgggtttaagagatacattatggaggcagaagtgttcattcaacaagcgtttgttaaatatctactatgtaatcatgattatacaactagagagaatatgaaaaaaatgaattacgtatgttagcttatagatggatgctctcagtacccatccctattaatcgtcatttccctttgtttagtgaaccttctgatatattggatatcaaatatcctttccaagtattgtctgtcccacttaattctggtatccatgaatgcagaagtgtgctatttatgtaatcatgaacactcatgtatatgtgtataccttcattcattcaacatgtgttaaaactattatgtaacaggcatcatgttaggccttggaacacaaaggtgaacaacatgattcctgctcttaagttgcttacaaagatcatggatgaagatattaaatgataattaaagctgattgatctaccttgt

SEQ ID NO: 27458 - DNA, 2794 bp, Homo sapiens
  misc_feature (1)..(8): n is a, c, g, or t
  misc_feature (16)..(16): n is a, c, g, or t
nnnnnnnngaaggatntgcgccgaaagcctcgggcggccttttgaggggctcgggctagcttcagcgccgtggggtctgacctggctggatatagtgtaccggcccggcaggaggggcggcccggtccgggttgcgcctcctggagccgcccccgggacgtcagtcctggaggaggcgagggagtagaagaccaccaggctgcctaagaaggaatgaactggtccacgtcaaaactcctatgctgatcgtagtgggattgcacctatgaatagccactgccctccagcctaggttgctccggttgctaagaagactatgaacaagtcagagaacctgctgtttgctggttcatcattagcatcacaagtccatgctgctgccgttaatggagataagggtgctctacagaggctcatcgtaggaaactctgctcttaaagacaaagaagatcagtttgggagaacaccacttatgtattgcgtgttggctgacagattggattgtgcagatgctcttctgaaggcaggagcagatgtgaataaaactgaccatagccagagaacagccctccatcttgcagcccagaagggaaattatcgtttcatgaaactcttacttacacgcagagcaaactggatgcaaaaggatctggaagagatgactcctttgcacttgaccacccggcacaggagccctaagtgtttggcacttctgctgaagtttatggcaccaggagaagtggatacacaggataaaaacaagcaaacagctctgcattggagtgcctactacaataaccctgagcatgtgaagctgctcatcaagcatgattctaacattgggattcctgatgttgaaggcaagatcccacttcactgggcagccaaccataaagatccaagtgctgttcacacagtgagatgcattctggatgctgctccaacagagtctttactgaactggcaagactacgagggtcgaactcctcttcactttgcagttgctgatgggaatgtgaccgtggttgatgtcttgacctcatatgaaagctgcaatataacgtcttatgataacttatttcgaaccccactgcactgggcagctttattaggccatgcacagattgtccatctccttttagaaagaaataagtctggaactatcccatctgacagccaaggagccacacctttgcactatgctgctcagagtaactttgctgaaacggttaaagtgtttttaaaacatccttcagtgaaagatgattcagacctggaaggaagaacatcctttatgtgggcagctggcaaaggcagtgatgatgtccttagaactatgctgagcttaaaatcggacatagatattaacatggctgacaaatatggaggtacagctttgcatgctgctgctctttctggccatgtcagcaccgtgaagttattactggaaaataatgctcaagtagatgctactgatgttatgaaacatactccacttttccgagcctgtgagatgggacacaaagatgtgattcagacactcattaaaggtggagcaagggtagatctagttgaccaagatggacattctcttctacattgggcagcactgggaggaaatgctgatgtttgccagatattaatagaaaataagatcaatccaaatgtccaggattatgcaggaagaacccctttgcagtgtgcagcatatggaggctatatcaactgcatggcagttctcatggaaaacaatgcagaccctaacattcaagacaaagagggaagaacagctttgcattggtcctgcaacaatggataccttgatgccattaaattactgctagactttgctgctttccctaatcagatggaaaacaatgaagagagatacacaccccttgattatgctttgcttggtgagcgccatgaagtgatccagttcatgttggagcacggtgccctgtccatcgcagccatacaagacatcgccgccttcaaaatccaagctgtctacaaagggtacaaggtcagaaaagccttccgagacaggaaaaatctcctcatgaagcatgaacagttgagaaaagatgctgctgccaaaaagcgagaggaagaaaacaaacgaaaagaggcagaacagcaaaaaggaaggcggagcccagattcctgcagaccccaggcccttccctgtctgcctagcacccaggatgtgcccagcaggcagagccgggcccccagcaagcagcctcctgctggcaacgtggcccaaggccctgagccaagagacagcagaggatctccaggagggtctctaggcggagccctccagaaggagcagcatgtttcctcagatttgcagggaacaaactccagaaggccaaatgaaacagccagagaacattctaaaggccaatctgcttgtgtccacttcagacccaatgaaggcagtgatggaagcaggcatccaggagttccctctgttgagaagtccagagagctccgactgcagataattcagagagaacgaaggaggaaggagctgtttcgcaaaaagaacaaggcagcagcagtcatccagcgcgcctggcgaagctaccagctcaggaagcacctgtcccaccttcggcatatgaagcagcttggagctggagatgtggacagatggaggcaagagtctacagcattgctcctccaggtttggaggaaggaactggaactaaaattcccccaaaccactgcagtaagcaaggtggcaagagccagctctggcctgggcgttttctacgtcgtgcct

SEQ ID NO: 27459 - DNA, 342 bp, Homo sapiens
ccccaagcccacttttcccctggtaagaattttagagatcatcactaaaataataattcagcttattgactgcctattctaagccagctcctgtgtcaaatccaatacatgcacggtcccatttaatctccacatcaaccccatgaggaagacactcttatcacccccactttacagatgagaaaactcaggcttagagagttggtgaacctaactcaaggtcatgcagccactaagcaatagagctgaacccaagtctggtctcacgtctagtcccagcttcatcaccaggccttagtgctgctcatattgtattcatgtgcacaggagacaaaaaaaaaa

SEQ ID NO: 27460 - DNA, 433 bp, Homo sapiens
ggaaaacaaagttgcaggactaacacagcctgatttaaagcctgcagacagtgtggtgttggtgtcagtattgaggtttacatcttcatgttatgcaatgaaattgtgtcagttaggttttgctgtgtaacaaactttcccacaacttaatagcttaacaaagtgttaatcatttatttgctcagagttctgcgggtcaggagtttgggtgattgttttagtcttggccgcatttgctgagcctcagtggtctaggataacctcactctcatgtctggcagttggcaggttagttgatctgggggctcagctggagcagttcatctgtattccacttgctctcgtccttcacacttcttcacacagtagtgtcggggttccagagagtagcaagagagggcaagcctcagtgaacaggcacctgtcaagcctc

SEQ ID NO: 27461 - DNA, 397 bp, Homo sapiens
gagccgggaggatcatttgagcccaggatattgaggctacagtgagccatgatcacaccactgcactccagcctggagagaagagtgacaccctgtctccttaaaaaaaataataatatattgcaacaagctacattttcttttgattattttctctagcacttaaattaacatttgctagacatacatttcctttggtaatatgtcttaatacaaaatgtattatacgtgtgtgtatagtgctacaacgtatcccatgtccttaaatatttctgccacattcatttcccccataaaacatttattgagcacctactacataccaagtaatgttttaggtgttgcagataataaagacagcaacacaagatggctgtcctggagtttagactgatac

SEQ ID NO: 27462 - DNA, 243 bp, Homo sapiens
ttcagcttttattcagcacttaccatatggtgggcactatggtaggattcattaattaatttattgaaaataattattgagattatatagtcttgtgaaaagatttatcagaggctgttctgtgaattttagaggttttttgtttttgttttttttttgaaatggcttgaaacctgggaggcagaggtggcagtgagccgagatcatgccattgcactccagcctgggtgacaagagcgagac

SEQ ID NO: 27463 - DNA, 477 bp, Homo sapiens
tgattatggcattttaaaattagattttccagcagctgggccattttactgattcttttcaaagacgttctctgagattcactatctattcatgccattgtgcgttttcctgctgctaattttactttttgtttttatattttaatatatttatttctgcttcctttgttccttttttcttcactttttagttgaaattattttctcttgcttttacttttaaaaatgtaacatgcatttaatactacaatttattgagaacaactttacgcatattccataatcttaaatgtgaattattctgattctcattatttttcaattagctgttttcaaatccctttatttcctcattaatcagaaatttattcaaaagagtattcataaaatttgtttaatcttttggtgttgtttccagttgttatactttcctttgagaacatagattgcatatattcatctttctgacttatgatt

SEQ ID NO: 27464 - DNA, 457 bp, Homo sapiens
gtagcatgaaaatggactaatacaacatgtgtataactccccaagggaaaaatcagggacagacacaagactccaaaattatgctaacatataaaaccctacatcaaagttcaaatcatgcacttgctttcacaggtcacctgcttggccttcctgcaagagtgctttatttctttttccttctccaaagctttttaatgaaccatattagcccatgtttgcattgctataaagaactacctgagactgggtaatttataaagaaaatggtttaattggctcatggttctacaggtgcacggtttttgggagacctcagaaacattgcaattatggcagaagaggaagcaggtatgacttatgtggctagagcaggaagaaaagagtgaaggggaaggtgtcacacactgttaaacaagcaggtctcatgagaactcattcactatcacgaaaacag

SEQ ID NO: 27465 - DNA, 365 bp, Homo sapiens
gatggttttacctcagggattctgagataactcccacctatttgagctggcatttgtcaaaagatctctttgaggctggtgcagtggctgacccttgtaattccagcactttgcaaggctgagatgggtggaagtcttgaggtcaggagtttgagaccagcctggtcaacatagtgaaacccagtgtctactaataatacaaaaattagctgggcatggtgctgtgtgcctgtagtcccagctactcaggaagctgaggcacaagaattgcttgaacccaggaggcagaggtagcaatgagccaaaaatcatgtcactgcactctagcctggacgacaccatgagccctcatctcaaaaaaaaaa

SEQ ID NO: 27466 - DNA, 360 bp, Homo sapiens
caagtctcaaactcctaggtcctcccagctcactcattcccttatccccactaccccatcagttagctcgtgaaggtgtccagatcctagactcttccttatccacacagtctacattccctcctggcttatcccccatcctcatggtcatctggactgttttctcattcacatccttagcagtatttatgcccatatccaccttttcttcctcctattttggagaatgaagcatctctccttccttcaaaatcaatatttcaacctgtgcactccatgcctgctctcgcttctcaaggttcttccttccctgccaatcattccctctctgccctatgtattcaccttcctccatgtctc

SEQ ID NO: 27467 - DNA, 5544 bp, Homo sapiens
gcgggactcaagagtagccttcctcgaggacctgcctttcccatttgctgcctgaagttaatgtttcttgctggccaaatcagggacatgccggcattagcgggatgagtgggtgttccggcagggatgtggtcattgacggccagtgagggcgagagtaccacggcccacttcttccttggagctggagatgaggggctgggcacccgtggaataggcatgaggccagaagagagtgacagcgagctccttgaggatgaggaggatgaagtgcctcctgaacctcagatcattgttggcatctgtgccatgaccaagaaatccaagtccaagccaatgactcaaatcctagagcgactctgcagatttgactacctgactgttgtcattctgggagaagatgtaatccttaatgaacctgtggaaaactggccatcctgccactgcctcatctctttccactccaaaggctttcctctggacaaagctgttgcttactccaagcttcgaaacccctttcttatcaatgatctggccatgcagtattacatccaagataggagggaggtgtaccggatcctgcaggaagagggtattgatctgcctcgatatgctgtgctcaaccgtgatcctgcccggcctgaggaatgcaacctgatagaaggtgaagaccaagtagaggtcaatggagctgtctttcccaagccctttgtggagaagccagtgagtgcagaagaccacaatgtttacatctactaccccagctcagctggaggaggaagccagcgtctctttcgtaagattggcagccgaagcagtgtttactctcctgagagcagcgtccgaaagacggggtcgtacatctatgaggagtttatgccaacagatggcacagatgtcaaggtgtatacagtggggccagattatgcccatgctgaagctagaaaatctccagctttggatgggaaggttgaacgagacagtgaggggaaagagattcgatatccagtcatgctgactgccatggaaaagctggtggccaggaaagtctgcgtagctttcaagcaaacagtttgtggatttgaccttcttcgtgccaatggtcattcctttgtgtgtgatgtcaatggctttagttttgtcaagaactcgatgaaatactacgatgactgtgccaagattctggggaacaccataatgcgggagcttgccccacagttccagattccatggtccatccccacggaggctgaggacattcccattgttcccaccacatctggcactatgatggaacttcgttgtgtcattgcaattattcgtcatggggatcgtactcccaagcagaagatgaagatggaagtgaaacacccaaggttttttgctctgtttgaaaaacatggtggctacaagacagggaaattaaaactcaagcgacctgagcagctccaggaggtgctggatatcacaaggctgttgttggctgaactggagaaagaaccaggtggtgagatcgaggagaagactggaaaactagagcagctgaagtctgtactggagatgtatggtcacttctcaggtataaaccggaaggtacaattgacttactaccctcatggagtaaaagcttctaatgaggggcaagatccacagagggaaactctggccccatctctgttgctggtactgaagtggggtggagaactgactcctgctggccgtgttcaggctgaggagctggggcgagcttttcgctgcatgtaccctggaggacagggtgactatgctggcttccctggttgtgggctgcttcgtctccatagcactttccgccacgatctcaagatctatgcctctgatgagggtcgtgttcagatgactgctgctgccttcgccaagggccttctggctctagaaggggagctgacacccattttggtgcaaatggtgaagagtgccaacatgaatgggctactggacagcgatggggattccttgagcagctgccagcaccgggtgaaggctcggctgcaccatattctacagcaggatgcaccctttggccctgaggactacgatcagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggagtacgggatcagtcgggaggagaaactggaaattgctgtgggcttctgtcttccactgttgcggaagatactacttgacctgcagagaacccacgaggatgagtctgtcaacaagctgcatcccctgtactcccgaggcgtgctctccccaggtcgccacgttcgaacgcgtctctatttcaccagtgagagccatgtccactccctgctcagtgtcttccgttatggaggacttcttgatgagacccaggatgcacaatggcagcgagctttggattatcttagtgccatctcagagcttaactacatgacccagattgtcatcatgctttatgaggacaacacacaggatcccttatcagaggaacggttccatgtggagctacacttcagccccggagtgaaaggtgttgaggaagaaggcagtgccccggctggctgtggattccgtccagcctcttctgagaatgaggagatgaaaaccaaccaaggcagtatggagaacctgtgtccaggaaaggcatcagatgaaccagaccgggcattgcagacttcaccccagcctcctgagggccctggccttccgaggagatcacccctcattcgtaaccgaaaagctggttccatggaggtactttctgagacttcatcctcgaggcctggtggctaccggctcttttcatcttcacggccacccacagaaatgaagcagagtggcctagggtttgaagggtgttccatggtgcctaccatctaccctctggaaacactgcataatgccctttccctacgtcaagtgagtgaattcttgagtagagtctgccagcgccacactgatgcccaggcacaggcatctgcagccctctttgattccatgcacagcagccaggcctcagataacccattttctccaccacgtactcttcattcacctcccctgcaactccagcagcgctctgagaagcccccttggttagagacaaggttttgccatgttggccaggctggtttagagctcctgacctcaagtgatctgcctgcctcggcctcccaaagtgctgggattacaggcgtgagccaccgcacccagccagacagcagtggcccttctagcactgtgtccagtgctggtccttcttcccctactacagtagatggtaactcccaatttggcttcagtgatcaaccctccctaaattcacacgtggctgaagaacatcaaggccttgggctgctccaggagacccctgggagtggagcacaagagctctccatagaaggggagcaagagctttttgaaccaaatcagtccccacaggtgccacctatggaaaccagccagccatacgaggaggtcagccagccatgtcaggaggtccctgacatcagccagccatgccaggacatttctgaggcgctcagccagccatgtcagaaggtccctgacatcagccagcaatgccaggagaaccatgacaatggtaaccacacatgccaggaggtccctcacatcagccagccatgccagaagtccagccaactgtgccagaaagtctctgaggaagtttgccagctatgtctggagaactccgaggaggtcagccagccatgccagggggtctctgtggaggttggcaagctggtccataagttccatgtaggggttggtagcttggtccaggaaacccttgtagaagttggcagcccagctgaagagatccctgaggaggtcatccagccataccaggagttctctgtggaggttggcaggctggcccaggagacttctgcgatcaatctgttatctcagggcatccctgagattgataaaccatcccaggagttccctgaggagattgatctgcaggcccaggaggtccctgaggagataaattagaagtcctgggtggtccctgaagtgattgatcagctgcctggagagggtattcctcaagcccagcatccatctggtgatccaaaccctcagagccagtctctagcccatgaccagcactcaccccttccaccagcaacatgtgattaattttctcattagtggtatcacactataccagccatttgagccagcaaccttttctgttggctaactcactggccagctctcaccagcggtgtctggggaagtagttctctttgtatgaagcatacctgtgccagagctgtggttgaggaggagccagttttaggttcgaagaagccattggctcctcacttagccattagacttgaataggatttccttggggtgggttggtctgtcattacccagccttctctgagcatcctaggaaatcacagattgttaaaggaaatgccgcttcactgctgaagacaccatctggcgacagcaaatgcaaaagaggggactctagggtcttcacttttctggggaaatgttcacgacttctcaaggtacgcttagaccatatgtgcattcaggggactcttgtctttgccagcactcctcaggtgagcccgggatggctatctgaaatgtctggaaaatagagtcccttccccaaacatctgacatggccactaaatctttagacttgccttatagatccttccatatcatccccaagtgccccttctgcctcagtcctgttcctctgggcaatagctctagggaaaagtaggtattagactgctgtgcaaaattcagagcaactacttaaaatgctctagaggattcttagccagtctgtgaaagtgggcctcctctgtggtggggctgtttggcttaggagatgctgtagtagtagagataatcaggttctattttaagcaatcagcagagatcaatattgtacagatacaagcaaaggtttaataaatatatatatatatatttatttctgtagttgtgccagggacagactggccaaagaccaaacactgcagggtccccaagaaatttgtccttatatcattgtgtctgagggccagatatgattatgaagctttttccaaagatccagggatgggaatgggagtgggtaggaggggtaatgcggtcattggagtcgggggctggaacattatgagtgctcaataaatataaactaatgag

SEQ ID NO: 27468 - DNA, 421 bp, Homo sapiens
ccttttcttaaatctgtttgcatcaatgaatatacctcctacagattaaaacaaatctccttggtattgtaaagtttatgttttatttaggaaatctcttagaagaaacaattattaaagaaatttaatgtcagacgctatggctcatgactctagtcccagtactttgggaggccaagatgggaggattgcttgaggccaggagttagaaaccagcttgggtaatatagcgagaccttgtctctaaaaaaaaaatttttttaattatccagacatagtggtgtgtacctgtagtcctagctacttgggaggctgaggtgggaggatcgcttgagcccaggagttcaaggttgttacaatgagttatgaccatgccactgcactccagcctgggtgacagagcagaccctgtctcgaaaaa

SEQ ID NO: 27469 - DNA, 421 bp, Homo sapiens
ccttttcttaaatctgtttgcatcaatgaatatacctcctacagattaaaacaaatctccttggtattgtaaagtttatgttttatttaggaaatctcttagaagaaacaattattaaagaaatttaatgtcagacgctatggctcatgactctagtcccagtactttgggaggccaagatgggaggattgcttgaggccaggagttagaaaccagcttgggtaatatagcgagaccttgtctctaaaaaaaaaatttttttaattatccagacatagtggtgtgtacctgtagtcctagctatcgggaggctgaggcaggagaatggcgtgaacctgggaggcagagcttgcagtgagccgagattgcatcagtgcactccagcctgggctacagagcgagactcttgtctccaaaaaaa

SEQ ID NO: 27470 - DNA, 383 bp, Homo sapiens
tctccgcctccttccatctcatctcatggtgcatccaccagagcaaggccccttcgaccttcatggacagacccttctccactctgccagccgtggctgctgtgtggccgagctcttccgattctggaggccgatgtccagatgcagcaacagggtcttcctggggccagacacgcagtcttgcagccacaccttggaccagctcctcactctgaggccagggcttcctccgagcatctttctcagcgagagagactggaaacgcgtggcagttttctttccagcctggcatatccacactctcgcatatggctcctaagttctgcttgaaaaccaaacaggtcttcctgcagcatcgcctgggaccaaccacacaggccaca

SEQ ID NO: 27471 - DNA, 386 bp, Homo sapiens
gtccgctttaaaacccttttcttacacacacacacacacacacacacagaatatatagtattgtttttggtgtatgagtgtgtgcgtcggaataaatggtttcatactctatatacttactgttttataatttaccttcttcactcaacactgtatctcagatgtcttagagatctaagacaccatatcttagagaatgagcagcctcattgttttattccgtaatatgaatttactaaatttattgggcctttttttttgagacagagtcttactctgtcactcaggctggagtgcaatggcacaaaatcgggctcactggcaagctccgcctcctgggttcaagtgattctcttgcctcacgcccagataattttttgtatttt

SEQ ID NO: 27472 - DNA, 259 bp, Homo sapiens
gtcggtcgtgatgtatccccaaactgtatctcagatgtcttagagatctaagacaccatatcttagagaatgagcagcctcattgttttattccgtaatatgaatttactaaatttattgggcctttttttttgagacagagtcttactctgtcactcaggctggagtgcaatggcacaaaatcgggctcactggcaagctccgcctcctgggttcaagtgattctcttgcctcacgcccagataattttttgtatttt

SEQ ID NO: 27473 - DNA, 964 bp, Homo sapiens
ccttgatagcttctttgtaagctcatgtgcctgtcttgccatcagagaggttgagatttctaaacacttaaacctagatcccctcttctttccaagtgatcacatccactttcgtgacatcatgccacttaaaaacagatgactcacacttatctccgatccttactcacccatactactctgagctggctctgtagattctgcactgatttgacatcttcatggtatctgatgcactcagattcaacatgatctttcttcctcctctcccaccctacacctatatgcatcaaaacctggttcttgaaccaggcacagttctgcctgtaatcccagcaacttgggaggctgaggtggcagcatcacttgagcccaggagttcgaggctgcagtaagcaatgtttgcgccactgtactccagcctggattacagagcaagatcccaactcaaaaacacacacacacacaacttggttctcctcttttgttccccatttccgtgactagtatttatatccaattatctatataattcagaaacgtgagtccttctcaatattctttctccctcattacgcacattcactgcatcaccaaatcctgttacctcctaacatctcttaagtccattcacttcttcccttcaaaatgcctggtccaggctactagcatgtattgactagtccatggcagttagccttctaattggtgtgtctgtataccctggcccccacaggcccattctccacagtgttgccagagttttttggaacaaaaatctattataaaagccccacccaaccaggcacggtggctcacacccgtaatcccagcactttgggaggccaaggcaggcagatcacgaggtcagcagtttgagaccagcctggccaatatggtgaaaccccatctctactaaaaaatacaaaaattagctgggtgtggtggcacacacctctagtct

SEQ ID NO: 27474 - DNA, 465 bp, Homo sapiens
gcttcacaaagctgcctcaagtggcattaacagctagggcaaacaagaagctcaccaataaatggaaaaggaaaagctgggccatgagatgtcataggggactttgaaaagctccatcgtattcctgggaatctccaaccccactcacacgatcagggctgtgggcatgccagagaagacttgagaaggccctgtgctcttggttcttaccgagtaagcaggcagcgaaaaccaaggcagagttgcaaactgcctgcctgggtgatgagaacattccctaacaaaaacacagagccccttgacaaaggctgggaggcttaccagttggaagcatttaaggatatctctgtccattaacgagctgaccactaagctaaccaaacagagacttcagtggccaaacacaacaatgaatatcggatttacaaaattatttcagcaaaaataaacacaacaaacagcaaa

SEQ ID NO: 27475 - DNA, 531 bp, Homo sapiens
gattgcatgagaggcagaggcacaattcctctccacttgaaacatcaacattcctgcagatgaattttctgccagcctgacaagggagctaaggtggctccagtccctccctctggtaagacctcagtgtgtttcactgagagcttcctcggccacctctgtcaaggctgggacctttccccaccattgggtattgcatttacccacctgctttagccaaagctggtttttacctgtggacacctcctgtattggcctgaagcctaaaatattcaatccagtaaataaaatactggggaaaaaataaataaaaaagtgcacatcacaggggaatgagattaagcgtcaagagacctctaccatttcaaccctatgggagacagtgaacttgctcacatgaccaacatattgctactacaaccagcagcagagaaagctatcatacaaagactcttaataaccaaggaactcagagtttccacccctgaaagcaccaagaactgaattctctctttgagagataaacaaaat

SEQ ID NO: 27476 - DNA, 428 bp, Homo sapiens
gagtttcataattttcttactgatgagtgcacacagtttaaattagagagtgttgaaaaaatattcatttacttatggtcctaatattaaacccatagcagtccccataaaatattcattgtcggatttatacacttttgaactttgaagctatttgactattttgaccaattttacaagagaaacaatgatttacattaccttatcagtttgaaatgcaaactgtaagaaaatataaagcgcttaattctacaaagttaagtgaaatcattaatttgataatcattgatttttgcatttaacttttaccttatctcatcagaaaaatcttaagtatgcttaaaataataatgcataagctaaacatacgcagagaaaaactgcataaaatataacaaaatgacgtgaattaaaaagagtaaaaaaaa

SEQ ID NO: 27477 - DNA, 533 bp, Homo sapiens
agatttctaaatatgctgataaaatcactgacatctcagtaaatatagtttattcctaggaagtgactagaatgattgatttagctatatgtaagttatttaatactgtttgaaaggtacttcatcaacaccatttactgtgatcaatagcattttcaggaacacttcagacttggggaggttactcctttgggtaaccttttaggattatctgttgtgggaacaagaagtagccatcaaaagccactgagcaggctgggtgctataatcccagcattttgggaggctgaagtgggaggactgcttgaacccaggggtttgagaccagcctggacaacatggtgagatcccctatctacaaaaactatattaaaaaaatttagcttgttgtagtgtacacacctattgtcccagttgctcaggaggctggggtgggagaatcacttgaccccaggaggtcaaggctgcagttagcattgcttgtgccactgcagtccagcctaggtgaaagagtgagaccctgtctcaaaaaa

SEQ ID NO: 27478 - DNA, 517 bp, Homo sapiens
cagacgcgcaggcagctctgtaatgagcaaaggcacagaatctcaactttacaaccgacctttccagccggctaagcttccacaatgtcctgcttcctctgacaaaggaaaactgtaaatatagagtgtgagcaagtgggaaacgctgcacttttgccattcaaagatgagcccggccattcccctgccttgctaggcaagtgggcgactcttcccagcagcctgagccctcatccccaggaccttcctagggcaccccgaccctctgtcctcattccctcgcccccatcttgaaatggaccctggcacagggtcgggtgagaggccctggagggcttggctctcctagcttttgagaaagaaatgtcaggcagcaaggaaaatgaggagagagagaagaagaaagggagggagggtgacagaggagggagaaagagagacagaatagcgaacaaacttaatgttaaaattccaagacaaatggagttaaataaatttacgaggatcgaacccatta

SEQ ID NO: 27479 - DNA, 84 bp, Homo sapiens
cctgcaaaaatgccattgggattttgataaggattgcattgatcctgtagatcactttgaatattatggacatttaaacaattt

SEQ ID NO: 27480 - DNA, 747 bp, Homo sapiens
gagaggcactctgcaaacacttcctcaaactttaggaaagcaaaaacattccttctgctcaacacggcagaaaacagggtctctgccccttggcgctgggtgaggagttcccaaagaccagccagccatgaacagcggcgtgtgcctgtgcgtgctgatggcggtactggcggctggcgccctgacgcagccggtgcctcccgcagatcccgcgggctccgggctgcagcgggcagaggaggcgccccgtaggcagctgagggtatcgcagagaacggatggcgagtcccgagcgcacctgggcgccctgctggcaagatacatccagcaggcccggaaagctccttctggacgaatgtccatcgttaagaacctgcagaacctggaccccagccacaggataagtgaccgggactacatgggctggatggattttggccgtcgcagtgccgaggagtatgagtacccctcctagaggacccagccgccatcagcccaacgggaagcaacctcccaacccagaggaggcagaataagaaaacaatcacactcataactcattgtctgtggagtttgacattgtatgtatctatttattaagttctcaatgtgaaaaatgtgtctgtaagattgtccagtgcaaccacacacctcaccagaattgtgcaaatggaagacaaaatgttttcttcatctgtgactcctggtctgaaaatgttgttatgctattaaagtgatttcattctg

SEQ ID NO: 27481 - DNA, 449 bp, Homo sapiens
  misc_feature (43)..(43): n is a, c, g, or t
aggagctttccgggcctgctggatgtatcttgccagcaggcanctccttctggacgaatgtccatcgttaagaacctgcagaacctggaccccagccacaggataagtgaccgggactacatgggctggatggattttggccgtcgcagtgccgaggagtatgagtacccctcctagaggacccagccgccatcagcccaacgggaagcaacctcccaacccagaggaggcagaataagaaaacaatcacactcataactcattgtctgtggagtttgacattgtatgtatctatttattaagttctcaatgtgaaaaatgtgtctgtaagattgtccagtgcaaccacacacctcaccagaattgtgcaaatggaagacaaaatgttttcttcatctgtgactcctggtctgaaaatgttgttatgctattaaagtgatttcattctg

SEQ ID NO: 27482 - DNA, 1483 bp, Homo sapiens
ccagagcggaatacggattccgattttaaaataagcgcttctaaatctttctcctgcatctaagacgggtgggggaaaaaaaggaaaggagttaggtcccaaggttcaaggcctgggatctccaggtcccaggctggcgggcctcggtgcccggaaagggccagggcgtgttgtgaacctttggcaaggcgctgctattcctcgcgcctcggtttgcggtctgtgaaatggggtggcagtgcctttgcagggacgcggcgaactcaagcaccagcaagcggactcgaactcaaagggtttcagggtgtagacgaccagagcgcactgaggggctccaggtcggcccgctccggagccgggagagtaaccgcgtgcagggaaaggcgcacggcagcctcggtgcctcccttccctccaccggacgggtgactgactaggggtgaggtcctcacctccaggctgcgcagctgagttctggaagctgcgtcaagagaggcccaggacaccaagagccagctgtggccagagccctttcactgacccagaacactggccctcggaaacctggagaactgcgagggcttttaatgcggctgagaagaaagtgaagaccccgactcctcctctctccttcgaaagagccgacacaggagccacttcaaccggttgtcgccccagtggccgccctctgagcacgtgttactgccagtctgcgtcagcgttgggtaaatacatgactggccgacgccgccgggcggggctatttaagagacagccgcccgctggtcctccctgaacttggctcagctgccgggctgctccggttggaaacgccaagccagctgcgtcctaatccaaaagccatgaacagcggcgtgtgcctgtgcgtgctgatggcggtactggcggctggcgccctgacgcagccggtgcctcccgcagatcccgcgggctccgggctgcagcgggcagaggaggcgccccgtaggcagctgagggtatcgcagagaacggatggcgagtcccgagcgcacctgggcgccctgctggcaagatacatccagcaggcccggaaagctccttctggacgaatgtccatcgttaagaacctgcagaacctggaccccagccacaggataagtgaccgggactacatgggctggatggattttggccgtcgcagtgccgaggagtatgagtacccctcctagaggacccagccgccatcagcccaacgggaagcaacctcccaacccagaggaggcagaataagaaaacaatcacactcataactcattgtctgtggagtttgacattgtatgtatctatttattaagttctcaatgtgaaaaatgtgtctgtaagattgtccagtgcaaccacacacctcaccagaattgtgcaaatggaagacaaaatgttttcttcatctgtgactcctggtctgaaaatgttgttatgctattaaagtgatttcattctg

SEQ ID NO: 27483 - DNA, 1645 bp, Homo sapiens
  misc_feature (1519)..(1520): n is a, c, g, or t
  misc_feature (1522)..(1522): n is a, c, g, or t
ccagagcggaatacggattccgattttaaaataagcgcttctaaatctttctcctgcatctaagacgggtgggggaaaaaaaggaaaggagttaggtcccaaggttcaaggcctgggatctccaggtcccaggctggcgggcctcggtgcccggaaagggccagggcgtgttgtgaacctttggcaaggcgctgctattcctcgcgcctcggtttgcggtctgtgaaatggggtggcagtgcctttgcagggacgcggcgaactcaagcaccagcaagcggactcgaactcaaagggtttcagggtgtagacgaccagagcgcactgaggggctccaggtcggcccgctccggagccgggagagtaaccgcgtgcagggaaaggcgcacggcagcctcggtgcctcccttccctccaccggacgggtgactgactaggggtgaggtcctcacctccaggctgcgcagctgagttctggaagctgcgtcaagagaggcccaggacaccaagagccagctgtggccagagccctttcactgacccagaacactggccctcggaaacctggagaactgcgagggcttttaatgcggctgagaagaaagtgaagaccccgactcctcctctctccttcgaaagagccgacacaggagccacttcaaccggttgtcgccccagtggccgccctctgagcacgtgttactgccagtctgcgtcagcgttgggtaaatacatgactggccgacgccgccgggcggggctatttaagagacagccgcccgctggtcctccctgaacttggctcagctgccgggctgctccggttggaaacgccaagccagctgcgtcctaatccaaaagccatgaacagcggcgtgtgcctgtgcgtgctgatggcggtactggcggctggcgccctgacgcagccggtgcctcccgcagatcccgcgggctccgggctgcagcgggcagaggaggcgccccgtaggcagctgagggtatcgcagagaacggatggcgagtcccgagcgcacctgggcgccctgctggcaagatacatccagcaggcccggaaagctccttctggacgaatgtccatcgttaagaacctgcagaacctggaccccagccacaggataagtgaccgggactacatgggctggatggattttggccgtcgcagtgccgaggagtatgagtacccctcctagaggacccagccgccatcagcccaacgggaagcaacctcccaacccagaggaggcagaataagaaaacaatcacactcataactcattgtctgtggagtttgacattgtatgtatctatttattaagttctcaatgtgaaaaatgtgtctgtaagattgtccagtgcaaccacacacctcaccagaattgtgcaaatggaagacaaaatgttttcttcatctgtgactcctggtctgaaaatgttgttatgctattaaagtgatttcattctgaaaaaaaaaaaccaaaaaaaaaaaaaaacaactccnngnggggcccggtgcccctttcccaagccttacagttgatataccctccttgcctgggggcccctttttcacttctgggaggagaaatccaatggcttaaccacctgaaatacccttgcaggaagg

SEQ ID NO: 27484 - DNA, 849 bp, Homo sapiens
aggggctccaggtcggcccgctccggagccgggagagtaaccgcgtgcagggaaaggcgcacggcagcctcggtgcctcccttccctccaccggacgggtgactgactaggggtgaggtcctcacctccaggctgcgcagctgagttctggaaggtactgtcctgggggtgtgagtgtgtgggccctcaggaaaggtgcgaggggcggatgccgtggtctacccgagcttgcgggggtgcggtggtcaagttccccaggaccctcgctggcgccgcttgtcgacaacggggaacagtgggcgccgcgggtggtggtaacttggcccgggaagaaaacacatccctttcccaaaccggattcctctgagcaaaaccagatggtgtcatccgcattttacagctgcgtcaagagaggcccaggacaccaagagccagctgtggccagagccctttcactgacccagaacactggccctcggaaacctggagaactgcgagggcttttaatgcggctgagaagaaagtgaagaccccgactcctcctctctccttcgaaagagccgacacaggtatgaagaccagcgcctcggacgctccggggtagggggccgacgccccctccctttcagaatcacgccttgctgatgctcagtcctgcccagtgtccaccccccacccccgcccccagtttcctttctagcccctccggtccccaaagcgaactaagctagcggcagcttctccatcccggaggagactccaaactcctaggtttcccaccttggagagtactgctctggaatgcgcaggggagcggcacctggaaagggttgggcggaagcttctcgg

SEQ ID NO: 27485 - DNA, 768 bp, Homo sapiens
gaatttctagtgtatgcataatcacattttgtgtgcctctcggcagccattccattgttgaagaggcagccaacacagaaaattgttgaggggttttgatctttgacaagggaagcgtatagtgtgagctcaccagtcaccctggcttttttccctggagacatttcctagtttgtggcataggggaaatagatcccaaataaaaagtgacggtctcactgggctaaggaagaaaggtggaagtttggggccactaaagcaaatttcgctcattttccaggtttaggagagaaccacataaaatctaacctcaaaatctgcagtcaggtccctctaaagtcattgactgacttcagaggtacacataagcaagagaagaaacccagcagaaaacagtagctgaaaagctaaagatctgagcagacatttcagtatctaatgccagagaggcaaaaatggaagttcaaatcctgccaagttagaggggccttattacaccctgagttttccactgtggccccatcatgaccactgcctaagattgaaggcaaaactaaaacagaccagccctcaggaaaatgagttactgctgtgctgctgctaaaaggaaacagccttctttggagaaaggtattatctaaaacttctacaattttgtatccataattcagtatttcattcaccaaaataggatatgctgttttggacaagctaatgaaactgaattgaccaaaaaccaatagaaattatctagtgctgacagaaaaa

SEQ ID NO: 27486 - DNA, 2758 bp, Homo sapiens
atctgtgcagtgtatagcatttcagtactccactgttcttactaagtcaagtttaaataaaggctgttcaaataagcccacaacagtgaacaaacgaagtgttaatgtgaatgctgctagtggaggagttcagaattccggaattgtcagagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgatgctgtagttaacaagggaagtgatgagtccataggcaaaggagatggctttgactttctaccgcagttgaactcagtgtttcctccaagaaaaaatccagtaacttcaagtacttcagtattgcattctagtcctcttaatgtttttatgggatctccagggaaagaggaaaatgaaaaccgtgatctaacagctgagtctaagaaaatatatatgggaaaacaggaatctaaagactccttcaaacagttagcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagagaagcatgccatagggacattgtgaatttgcaagtggagatgattaaacagtttcatatgcaactgaatgaaatgcattctttgctggaaagatactcagtgaatgaaggtttagtggctgaaattgaaagactacgagaagaaaacaaaagattacgggcccacttttgaaatttcagtgaataccttaatgttctgtaatttgggaagtttctggcaacacagaactacatagaatcagtattgttttcatggcctccagggaaaaaatgtttttcaagtaagagtaaaagggtgatgggattttataccaacaactgtttcatcttaaaaatatgtatatttttatattaaaaattgtacagtatgtcatctacccaataggaaagtcaacaggatctttattttttgaaagctttagccatccactaagtgccctttttcataagagaagaaaattgtgcataaaaattggttatgtttgttttttagtcatcttttttaacatatatttttgattgacaaattgcctttcaaatttttggggctagttgagatttaaagagtttgatatgccttctatttttatggagaaagtaattttaaaatggcaattggtgtttctaagccattgactaataaaacatagggttggctagtaattattttgttaacttgatgaagtcaagtatgactattatttattgtacatttgataagacaatttttggaattttgaattgcacaaattacatgatatcttttgcatttatgttactatattgtacttctgacaaatctttattcctgggtggtatttttaagatatctttacctataaaaaatgtttaaggttcataggactcgacaagagctatctggtgattttctcattagtaacatgcaacgttgtactgcaaaatttcaatcaacatgacaacttataatgagtggagatttcatattaggtactaaatattatagtattatttctattttctttttccaaataagaagcttggattattttattttgtggtctttatcattaactttaattctttctgtactgtgtataatatttttatattattggccttaccataaaattatttagaaaggttgtcaaaataagttatacctctttggcaatagatagatgtatacatctacctactatgatctacaattttaggttaagtgaagcttgggggggctactgacttggttaccttcttgtctcttgtcccaaagatttaaactatgtacctttgtatagctcttctgccccattttgacttctgagatgaaagtatttactaaaattaaaaaaaaaaaaacaaaaaacaaacctttagctcactaactttatgggtttctgaagtgatggaaatttttaaggatatatttaataagcataaacttactaataattacttccaaaaataaaaacaggaatattacttttacccagtgtggtttatagcatacatttgtactgaagcatatagggatgttaatgtgatcttttcctgacagattatgaaagcattatgacttgtaacaagtttccttgtatatcactaacaggtttagaagacataaatattagtgtgttttgcctacatggtgtatttaaatctattaatattttcctgttgcttttttaaaaaaataaatacacataatgtatattaaaagaggtgggatgaaataattttagtaattatgtgtacagatgaaacatttttgtcatggaatttaaaagctaagtaagtataaaaaataaaatgttatatgcaaaaaataggaaacatgaaa

SEQ ID NO: 27487 - DNA, 2694 bp, Homo sapiens
  misc_feature (2694)..(2694): n is a, c, g, or t
atctgtgcagtgtatagcatttcagtactccactgttcttactaagtcaagtttaaataaaggctgttcaaataagcccacaacagtgaacaaacgaagtgttaatgtgaatgctgctagtggaggagttcagaattccggaattgtcagagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgatgctgtagttaacaagggaagtgatgagtccataggcaaaggagatggctttgactttctaccgcagttgaactcagtgtttcctccaagaaaaaatccagtaacttcaagtacttcagtattgcattctagtcctcttaatgtttttatgggatctccagggaaagaggaaaatgaaaaccgtgatctaacagctgagtctaagaaaatatatatgggaaaacaggaatctaaagactccttcaaacagttagcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagagaagcatgccatagggacattgtgaatttgcaagtggagatgattaaacagtttcatatgcaactgaatgaaatgcattctttgctggaaagatactcagtgaatgaaggtttagtggctgaaattgaaagactacgagaagaaaacaaaagattacgggcccacttttgaaatttcagtgaataccttaatgttctgtaatttgggaagtttctggcaacacagaactacatagaatcagtattgttttcatggcctccagggaaaaaatgtttttcaagtaagagtaaaagggtgatgggattttataccaacaactgtttcatcttaaaaatatgtatatttttatattaaaaattgtacagtatgtcatctacccaataggaaagtcaacaggatctttattttttgaaagctttagccatccactaagtgccctttttcataagagaagaaaattgtgcataaaaattggttatgtttgttttttagtcatcttttttaacatatatttttgattgacaaattgcctttcaaatttttggggctagttgagatttaaagagtttgatatgccttctatttttatggagaaagtaattttaaaatggcaattggtgtttctaagccattgactaataaaacatagggttggctagtaattattttgttaacttgatgaagtcaagtatgactattatttattgtacatttgataagacaatttttggaattttgaattgcacaaattacatgatatcttttgcatttatgttactatattgtacttctgacaaatctttattcctgggtggtatttttaagatatctttacctataaaaaatgtttaaggttcataggactcgacaagagctatctggtgattttctcattagtaacatgcaacgttgtactgcaaaatttcaatcaacatgacaacttataatgagtggagatttcatattaggtactaaatattatagtattatttctattttctttttccaaataagaagcttggattattttattttgtggtctttatcattaactttaattctttctgtactgtgtataatatttttatattattggccttaccataaaattatttagaaaggttgtcaaaataagttatacctctttggcaatagatagatgtatacatctacctactatgatctacaattttaggttaagtgaagcttgggggggctactgacttggttaccttcttgtctcttgtcccaaagatttaaactatgtacctttgtatagctcttctgccccattttgacttctgagatgaaagtatttactaaaattaaaaaaaaaaaaacaaaaaacaaacctttagctcactaactttatgggtttctgaagtgatggaaatttttaaggatatatttaataagcataaacttactaataattacttccaaaaataaaaacaggaatattacttttacccagtgtggtttatagcatacatttgtactgaagcatatagggatgttaatgtgatcttttcctgacagattatgaaagcattatgacttgtaacaagtttccttgtatatcactaacaggtttagaagacataaatattagtgtgttttgcctacatggtgtatttaaatctattaatattttcctgttgcttttttaaaaaaataaatactataaaccacactgggtaaaagtaatattcctgtttttatttttggagaaatgggctttggagaaatgggctttn

SEQ ID NO: 27488 - DNA, 533 bp, Homo sapiens
ggaaacgttggatgagtagtaattgagaaactactccttctatctagaccttacttgttttttttttagatgtaaaaccagaactatagataatgttgttggttactattgtctaggttctggtaatcctaaagccatagaaaacataatgagttttgttgatcttttcgtactgcatttattgattatgagccaggaaaaggcacatttacctagggcaattattaggtaactcagcagggcagtctagcaggtagactgccattgtgaactttttttattattaaaatgtggacaagttctggtaagcttaaattgggttcttaacctgcagtatgttcatagatctattaggtatgctgtgtgcaataatgtagtagaaaaagatactttaaagcacaattctgaatgttttccaatagaatgcatcagaatgtaatacttaatctaaaaaaaattctttctcagacttatccttgtctgtctcatccttcgaattgtgaacattctaagaatgtgttctacaatgctgc

SEQ ID NO: 27489 - DNA, 211 bp, Homo sapiens
gatgagtcagtctagagatccccccctgagcacttctgtacctgtagccccctgccttactgtcctggcacacccctcaccatcctgtataccttaaatatcaaagagggcaagagagaaagggctttaaagataagttatttttttaaggaaccttaatattatttttaagaagtaaccaaattagtgacgtgaaatgcaaaaaaaaaaa

SEQ ID NO: 27490 - DNA, 5053 bp, Homo sapiens
atctgccccactttctgtctcacaaacaaccttgccacagtcatcttctacccctgtcctgcccagggcaagggagactcctgtgacttcatttcagacatcaacaatgacatcattcatgacaatgctccatagtagtcaaactgcagaccttaagagccagagcaccccacaccaagagaaagtcattacagaatcaaagtcaccaagcctggtgtctctgcccacagagtccaccaaagctgtaacaacaaactctcctttgcctccatccttaacagagtcctccacagagcaaacccttccagccacaagcaccaacttagcacaaatgtctccaactttcacaactaccattctgaagacctctcagcctcttatgaccactcctggcaccctgtcaagcacagcatctctggtcactggccctatagccgtacagactacagctggaaaacagctctcgctgacccatcctgaaatactagttcctcaaatctcaacagaaggtggcatcagcacagaaaggaaccgagtgattgtggatgctaccactggattgatccctttgaccagtgtacccacatcagcaaaagaaatgaccacaaagcttggcgttacagcagagtacagcccagcttcacgttccctcggaacatctccttctccccaaaccacagttgtttccacggctgaagacttggctcccaaatctgccacctttgctgttcagagcagcacacagtcaccaacaacactgtcctcttcagcctcagtcaacagctgtgctgtgaacccttgtcttcacaatggcgaatgcgtcgcagacaacaccagccgtggctaccactgcaggtgcccgccttcctggcaaggggatgattgcagtgtggatgtgaatgagtgcctgtcgaacccctgcccatccacagccacgtgcaacaatactcagggatcctttatctgcaaatgcccggttgggtaccagttggaaaaagggatatgcaatttggttagaaccttcgtgacagagtttaaattaaagagaacttttcttaatacaactgtggaaaaacattcagacctacaagaagttgaaaatgagatcaccaaaacgttaaatatgtgtttttcagcgttacctagttacatccgatctacagttcacgcctctagggagtccaacgcggtggtgatctcactgcaaacaaccttttccctggcctccaatgtgacgctatttgacctggctgataggatgcagaaatgtgtcaactcctgcaagtcctctgctgaggtctgccagctcttgggatctcagaggcggatctttagagcgggcagcttgtgcaagcggaagagtcccgaatgtgacaaagacacctccatctgcactgacctggacggcgttgccctgtgccagtgcaagtcgggatactttcagttcaacaagatggaccactcctgccgagcatgtgaagatggatataggcttgaaaatgaaacctgcatgagttgcccatttggccttggtggtctcaactgtggaaacccctatcagcttatcactgtggtgatcgcagccgcgggaggtgggctcctgctcatcctaggcatcgcactgattgttacctgttgcagaaagaataaaaatgacataagcaaactcatcttcaaaagtggagatttccaaatgtccccgtatgctgaataccccaaaaatcctcgctcacaagaatggggccgagaagctattgaaatgcatgagaatggaagtaccaaaaacctcctccagatgacggatgtgtactactcgcctacaagtgtaaggaatccagaacttgaacgaaacggactctacccggcctacactggactgccaggatcacggcattcttgcattttccccggacagtataacccgtctttcatcagtgatgaaagcagaagaagagactacttttaagtccaggagagagagggactcattgctctgagccagtcacctgggacctctgctcagaggaccgcaccaggaggctgcgcccaggatttgtcgggagccacgctgagtggcaagcaggaagagggacaggcatgcggggcgtgaccacagtggaggagacaggtggatgtggaaccacaggctgctcattcagcacctttgttgttactgtgaacgtgaatgtgggccagtatcaagagagtctctctgagtgactgcaccatggcactggcaccagggcgactattagccagggcagaccactagacttcagtgcagggacctggttttcccttcgtttgcactttagtaaattgggtgggaggtttccttttggatctgttttgagactgttccagaaagaaggcttcctttcccgagacacttccataggcagcaatttggtgattcatttgcagcaaaatactggcttgttaattattttcctgcccagcgcctgcgtgctaaacaacagatgaggatgagcgtaccactgaagtctgaagatgtcgccattgaacggacagtgttttcatatgtttctaggttgtcttatgctacagtttccaagccagcccccacagtgaggaaatgtgtgaggcaccgcacacaactgcaatgtgttttttaagtcaaggtgacacatgtatttaagattttttttttaaaatctctttgcagttaaatctcactttttcaaacaagcctggatcagggcaaaacaacttatatttggttttagctggaggctcagcaggcagattgcaggcaggggggcacttttcatccatgagggcccagcctggggcctgggactctgatcaccattgtggaggccagctgcactcctgcacggggttcctagctgcagaagggtcccgcctaggccgaggggaaacacctgaggaagaacagggagccgagatggagccacacatgagtttgctcaccggctactgcagcactttgtacccagaatctcatgtccacaaaccccatgtaaactttcaaccactcaaagctgtttattcggctgaagaaataacttttttttctcacccagtcatttgtacctcttcatatggctatgtcgcaccctccagaaacgtggttatacttccagtcagtgtgggagaactgaagacttccggttggtcgaggaactgagggttgaccttcgggaaggaagttccactcatcttatttattatgcctgtgatgtgggtcctgccagggagacatccagtactcggtgtctttaattgccacctggggaactgtgtttattggccttctttggggcatcctggttttggatgaagtgaggggaatacagaggtaaaagaattgtctccaccctgaagcggggagtcccgcttcacatttctggaaatggtgcagccactggggacagttctgccccgggcatggttgtttcttcaaggtcctctaaatataatccctattcttacataatccttggccctgatggttttaagcaagaactcctgtgtcccatggtctccaccactcaccatcaccctgctgtagcaagagtcctagtcaggggaggtgcattttagtagttaaattgcacttatccatgagataaataaaaggagaactgtttttatcagtggaggctaacctaaaatttcaaagtgtcgcctttttgaaatcttgggcctctctctctgtagaaccaatggccctttgtggcttcacggcctcgcacctaactggagagttctgagctcctgcagctcacctgagcccacagactaggcttcttggctccttccgcagcatgcctgctcacccccagaacccgcagctgtgggaagagccatgtagggaggctattcccaggcatacacttccactgccttcagctgacgtcacagctgacaaatcatctcctctatcggagccagaagacttcagctccacaaaatgaagtgttctgtcctgaaaacattcttgggaagaatcccaacatcgagaaaacggtgtcctgtgagttccaacaatgcttcttgttcatgggtttcttccgtatggagtggattaagagtgttttattttgttgttctaactgagaaaaaaaggaggcacccacaaggttgaggtcacacagtctccacagtttccaggaggcgtttgggggtggggaaggcacctccagagcatgaggctctaaggggacatgagtaaagcatgtctgtgacccagtgaggaagggagaggccagctgcactcctgcacggggttcctagctgcagaagggtcccgcctaggccgaggggaaacacctgatagcagaagaggcctggatgcacacctggcacgccgaggctctccgcccagacacagtgctccatgtcagcccctgcacctggggtgtgtgattcacgtgcacagatgccacaatcctgcaccaatatcccacagatgggggaaggtgagaggaaggggcaagtgatgtgtaactgctcaagagatgcttaaacctccatagagaggagccgggcgcaggggcatctgtgtgtcccgtcacacactgcagcagggaagggtggctggctggctccctggcatcagtggtttggtttaagctccagagggtcttattgccattgtcttttcctctgccccttgagccagcctaaggccctggagtctgtttctttaggcggatgaactgacatgctcctaccatgaccaggctctgggcaaggctcctcacagtatccttgagaggtgggcatggaagtgcccatttctcaggtacagaaaccttcagagaggataaatagcttgccctgtagaagcaggactgaaacccttgtccgcctgactcccccagctactctgcccactgtagccccctgccttactgtcctggcacacccctcaccatcctgtataccttaaatatcaaagagggcaagagagaaagggctttaaagataagttatttttttaaggaaccttaatattatttttaagaagtaaccaaattagtgacgtgaaatgcaaaaaaaaaaa

SEQ ID NO: 27491 - DNA, 3746 bp, Homo sapiens
atctgccccactttctgtctcacaaacaaccttgccacagtcatcttctacccctgtcctgcccagggcaagggagactcctgtgacttcatttcagacatcaacaatgacatcattcatgacaatgctccatagtagtcaaactgcagaccttaagagccagagcaccccacaccaagagaaagtcattacagaatcaaagtcaccaagcctggtgtctctgcccacagagtccaccaaagctgtaacaacaaactctcctttgcctccatccttaacagagtcctccacagagcaaacccttccagccacaagcaccaacttagcacaaatgtctccaactttcacaactaccattctgaagacctctcagcctcttatgaccactcctggcaccctgtcaagcacagcatctctggtcactggccctatagccgtacagactacagctggaaaacagctctcgctgacccatcctgaaatactagttcctcaaatctcaacagaaggtggcatcagcacagaaaggaaccgagtgattgtggatgctaccactggattgatccctttgaccagtgtacccacatcagcaaaagaaatgaccacaaagcttggcgttacagcagagtacagcccagcttcacgttccctcggaacatctccttctccccaaaccacagttgtttccacggctgaagacttggctcccaaatctgccacctttgctgttcagagcagcacacagtcaccaacaacactgtcctcttcagcctcagtcaacagctgtgctgtgaacccttgtcttcacaatggcgaatgcgtcgcagacaacaccagccgtggctaccactgcaggtgcccgccttcctggcaaggggatgattgcagtgtggatgtgaatgagtgcctgtcgaacccctgcccatccacagccacgtgcaacaatactcagggatcctttatctgcaaatgcccggttgggtaccagttggaaaaagggatatgcaatttggttagaaccttcgtgacagagtttaaattaaagagaacttttcttaatacaactgtggaaaaacattcagacctacaagaagttgaaaatgagatcaccaaaacgttaaatatgtgtttttcagcgttacctagttacatccgatctacagttcacgcctctagggagtccaacgcggtggtgatctcactgcaaacaaccttttccctggcctccaatgtgacgctatttgacctggctgataggatgcagaaatgtgtcaactcctgcaagtcctctgctgaggtctgccagctcttgggatctcagaggcggatctttagagcgggcagcttgtgcaagcggaagagtcccgaatgtgacaaagacacctccatctgcactgacctggacggcgttgccctgtgccagtgcaagtcgggatactttcagttcaacaagatggaccactcctgccgagcatgtgaagatggatataggcttgaaaatgaaacctgcatgagttgcccatttggccttggtggtctcaactgtggaaacccctatcagcttatcactgtggtgatcgcagccgcgggaggtgggctcctgctcatcctaggcatcgcactgattgttacctgttgcagaaagaataaaaatgacataagcaaactcatcttcaaaagtggagatttccaaatgtccccgtatgctgaataccccaaaaatcctcgctcacaagaatggggccgagaagctattgaaatgcatgagaatggaagtaccaaaaacctcctccagatgacggatgtgtactactcgcctacaagtgtaaggaatccagaacttgaacgaaacggactctacccggcctacactggactgccaggatcacggcattcttgcattttccccggacagtataacccgtctttcatcagtgatgaaagcagaagaagagactacttttaagtccaggagagagagggactcattgctctgagccagtcacctgggacctctgctcagaggaccgcaccaggaggctgcgcccaggatttgtcgggagccacgctgagtggcaagcaggaagagggacaggcatgcggggcgtgaccacagtggaggagacaggtggatgtggaaccacaggctgctcattcagcacctttgttgttactgtgaacgtgaatgtgggccagtatcaagagagtctctctgagtgactgcaccatggcactggcaccagggcgactattagccagggcagaccactagacttcagtgcagggacctggttttcccttcgtttgcactttagtaaattgggtgggaggtttccttttggatctgttttgagactgttccagaaagaaggcttcctttcccgagacacttccataggcagcaatttggtgattcatttgcagcaaaatactggcttgttaattattttcctgcccagcgcctgcgtgctaaacaacagatgaggatgagcgtaccactgaagtctgaagatgtcgccattgaacggacagtgttttcatatgtttctaggttgtcttatgctacagtttccaagccagcccccacagtgaggaaatgtgtgaggcaccgcacacaactgcaatgtgttttttaagtcaaggtgacacatgtatttaagattttttttttaaaatctctttgcagttaaatctcactttttcaaacaagcctggatcagggcaaaacaacttatatttggttttagctggaggctcagcaggcagattgcaggcaggggggcacttttcatccatgagggcccagcctggggcctgggactctgatcaccattgtggaggccagaggcagctgcgtatggaggagaaatgtcaaactgaacgcaggtttcaccactctaggaaagcagcttgttgagcccctgcagctggatgtggttagagggatgggctgaataggcaggttagatttcctgcatcaacagtgctttgggaagctgtgtggattcctgaggaagaacagggagccgagatggagccacacatgagtttgctcaccggctactgcagcactttgtacccagaatctcatgtccacaaaccccatgtaaactttcaaccactcaaagctgtttattcggctgaagaaataacttttttttctcacccagtcatttgtacctcttcatatggctatgtcgcaccctccagaaacgtggttatacttccagtcagtgtgggagaactgaagacttccggttggtcgaggaactgagggttgaccttcgggaaggaagttccactcatcttatttattatgcctgtgatgtgggtcctgccagggagacatccagtactcggtgtctttaattgccacctggggaactgtgtttattggccttctttggggcatcctggttttggatgaagtgaggggaatacagaggtaaaagaattgtctccaccctgaagcggggagtcccgcttcacatttctggaaatggtgcagccactggggacagttctgccccgggcatggttgtttcttcaaggtcctctaaatataatccctattcttacataatccttggccctgatggttttaagcaagaactcctgtgtcccatggtctccaccactcaccatcaccctgctgtagcaagagtcctagtcaggggaggtgcattttagtagttaaattgcacttatccatgagataaataaaaggagaactgtttttatcagtg

SEQ ID NO: 27492 - DNA, 653 bp, Homo sapiens
tactactactaaattcgcggccgcgtcgaccacaatcctgcaccaatatcccacagatgggggaaggtgagaggaaggggcaagtgatgtgtaactgctcaagagatgcttaaacctccatagagaggagccgggcgcaggggcatctgtgtgtcccgtcacacactgcagcagggaagggtggctggctggctccctggcatcagtggtttggtttaagctccagagggtcttattgccattgtcttttcctctgccccttgagccagcctaaggccctggagtctgtttctttaggcggatgaactgacatgctcctaccatgaccaggctctgggcaaggctcctcacagtatccttgagaggtgggcatggaagtgcccatttctcaggtacagaaaccttcagagaggataaatagcttgccctgtagaagcaggactgaaacccttgtccgcctgactcccccagctactctgcccactgtagccccctgccttactgtcctggcacacccctcaccatcctgtataccttaaatatcaaagagggcaagagagaaagggctttaaagataagttatttttttaaggaaccttaatattatttttaagaagtaaccaaattagtgacgtgaaatgcaaaaaaaaaaa

SEQ ID NO: 27493 - DNA, 435 bp, Homo sapiens
cagggtggtgactgtagagtcaggggagaccattcttgagaactcactcattccttcattacctccagccaatatgcttttttgtttgttttacgtttagcctatcagcttatcactgtggtgatcgcagccgcgggaggtgggctcctgctcatcctaggcatcgcactgattgttacctgttgcaggtaagtgatgagagttcaggttccaatcccgttcctttgcctgtgctatacaagggtcagtttgtattcttttacaggatacttgagatggttcacaatattaaaccataatgtgtgactaacccatttttaaaaaaggagaaagggaattcacgatagttggtgcctgtgaggaaaaagaaggggagtaaatggaacttcattttctttattagaaaagaatagctgaaagcacaagcaggaaatg

SEQ ID NO: 27494 - DNA, 5155 bp, Homo sapiens
atctgccccactttctgtctcacaaacaaccttgccacagtcatcttctacccctgtcctgcccagggcaagggagactcctgtgacttcatttcagacatcaacaatgacatcattcatgacaatgctccatagtagtcaaactgcagaccttaagagccagagcaccccacaccaagagaaagtcattacagaatcaaagtcaccaagcctggtgtctctgcccacagagtccaccaaagctgtaacaacaaactctcctttgcctccatccttaacagagtcctccacagagcaaacccttccagccacaagcaccaacttagcacaaatgtctccaactttcacaactaccattctgaagacctctcagcctcttatgaccactcctggcaccctgtcaagcacagcatctctggtcactggccctatagccgtacagactacagctggaaaacagctctcgctgacccatcctgaaatactagttcctcaaatctcaacagaaggtggcatcagcacagaaaggaaccgagtgattgtggatgctaccactggattgatccctttgaccagtgtacccacatcagcaaaagaaatgaccacaaagcttggcgttacagcagagtacagcccagcttcacgttccctcggaacatctccttctccccaaaccacagttgtttccacggctgaagacttggctcccaaatctgccacctttgctgttcagagcagcacacagtcaccaacaacactgtcctcttcagcctcagtcaacagctgtgctgtgaacccttgtcttcacaatggcgaatgcgtcgcagacaacaccagccgtggctaccactgcaggtgcccgccttcctggcaaggggatgattgcagtgtggatgtgaatgagtgcctgtcgaacccctgcccatccacagccacgtgcaacaatactcagggatcctttatctgcaaatgcccggttgggtaccagttggaaaaagggatatgcaatttggttagaaccttcgtgacagagtttaaattaaagagaacttttcttaatacaactgtggaaaaacattcagacctacaagaagttgaaaatgagatcaccaaaacgttaaatatgtgtttttcagcgttacctagttacatccgatctacagttcacgcctctagggagtccaacgcggtggtgatctcactgcaaacaaccttttccctggcctccaatgtgacgctatttgacctggctgataggatgcagaaatgtgtcaactcctgcaagtcctctgctgaggtctgccagctcttgggatctcagaggcggatctttagagcgggcagcttgtgcaagcggaagagtcccgaatgtgacaaagacacctccatctgcactgacctggacggcgttgccctgtgccagtgcaagtcgggatactttcagttcaacaagatggaccactcctgccgagcatgtgaagatggatataggcttgaaaatgaaacctgcatgagttgcccatttggccttggtggtctcaactgtggaaacccctatcagcttatcactgtggtgatcgcagccgcgggaggtgggctcctgctcatcctaggcatcgcactgattgttacctgttgcagaaagaataaaaatgacataagcaaactcatcttcaaaagtggagatttccaaatgtccccgtatgctgaataccccaaaaatcctcgctcacaagaatggggccgagaagctattgaaatgcatgagaatggaagtaccaaaaacctcctccagatgacggatgtgtactactcgcctacaagtgtaaggaatccagaacttgaacgaaacggactctacccggcctacactggactgccaggatcacggcattcttgcattttccccggacagtataacccgtctttcatcagtgatgaaagcagaagaagagactacttttaagtccaggagagagagggactcattgctctgagccagtcacctgggacctctgctcagaggaccgcaccaggaggctgcgcccaggatttgtcgggagccacgctgagtggcaagcaggaagagggacaggcatgcggggcgtgaccacagtggaggagacaggtggatgtggaaccacaggctgctcattcagcacctttgttgttactgtgaacgtgaatgtgggccagtatcaagagagtctctctgagtgactgcaccatggcactggcaccagggcgactattagccagggcagaccactagacttcagtgcagggacctggttttcccttcgtttgcactttagtaaattgggtgggaggtttccttttggatctgttttgagactgttccagaaagaaggcttcctttcccgagacacttccataggcagcaatttggtgattcatttgcagcaaaatactggcttgttaattattttcctgcccagcgcctgcgtgctaaacaacagatgaggatgagcgtaccactgaagtctgaagatgtcgccattgaacggacagtgttttcatatgtttctaggttgtcttatgctacagtttccaagccagcccccacagtgaggaaatgtgtgaggcaccgcacacaactgcaatgtgttttttaagtcaaggtgacacatgtatttaagattttttttttaaaatctctttgcagttaaatctcactttttcaaacaagcctggatcagggcaaaacaacttatatttggttttagctggaggctcagcaggcagattgcaggcaggggggcacttttcatccatgagggcccagcctggggcctgggactctgatcaccattgtggaggccagaggcagctgcgtatggaggagaaatgtcaaactgaacgcaggtttcaccactctaggaaagcagcttgttgagcccctgcagctggatgtggttagagggatgggctgaataggcaggttagatttcctgcatcaacagtgctttgggaagctgtgtggattcctgaggaagaacagggagccgagatggagccacacatgagtttgctcaccggctactgcagcactttgtacccagaatctcatgtccacaaaccccatgtaaactttcaaccactcaaagctgtttattcggctgaagaaataacttttttttctcacccagtcatttgtacctcttcatatggctatgtcgcaccctccagaaacgtggttatacttccagtcagtgtgggagaactgaagacttccggttggtcgaggaactgagggttgaccttcgggaaggaagttccactcatcttatttattatgcctgtgatgtgggtcctgccagggagacatccagtactcggtgtctttaattgccacctggggaactgtgtttattggccttctttggggcatcctggttttggatgaagtgaggggaatacagaggtaaaagaattgtctccaccctgaagcggggagtcccgcttcacatttctggaaatggtgcagccactggggacagttctgccccgggcatggttgtttcttcaaggtcctctaaatataatccctattcttacataatccttggccctgatggttttaagcaagaactcctgtgtcccatggtctccaccactcaccatcaccctgctgtagcaagagtcctagtcaggggaggtgcattttagtagttaaattgcacttatccatgagataaataaaaggagaactgtttttatcagtggaggctaacctaaaatttcaaagtgtcgcctttttgaaatcttgggcctctctctctgtagaaccaatggccctttgtggcttcacggcctcgcacctaactggagagttctgagctcctgcagctcacctgagcccacagactaggcttcttggctccttccgcagcatgcctgctcacccccagaacccgcagctgtgggaagagccatgtagggaggctattcccaggcatacacttccactgccttcagctgacgtcacagctgacaaatcatctcctctatcggagccagaagacttcagctccacaaaatgaagtgttctgtcctgaaaacattcttgggaagaatcccaacatcgagaaaacggtgtcctgtgagttccaacaatgcttcttgttcatgggtttcttccgtatggagtggattaagagtgttttattttgttgttctaactgagaaaaaaaggaggcacccacaaggttgaggtcacacagtctccacagtttccaggaggcgtttgggggtggggaaggcacctccagagcatgaggctctaaggggacatgagtaaagcatgtctgtgacccagtgaggaagggagaggccagctgcactcctgcacggggttcctagctgcagaagggtcccgcctaggccgaggggaaacacctgatagcagaagaggcctggatgcacacctggcacgccgaggctctccgcccagacacagtgctccatgtcagcccctgcacctggggtgtgtgattcacgtgcacagatgccacaatcctgcaccaatatcccacagatgggggaaggtgagaggaaggggcaagtgatgtgtaactgctcaagagatgcttaaacctccatagagaggagccgggcgcaggggcatctgtgtgtcccgtcacacactgcagcagggaagggtggctggctggctccctggcatcagtggtttggtttaagctccagagggtcttattgccattgtcttttcctctgccccttgagccagcctaaggccctggagtctgtttctttaggcggatgaactgacatgctcctaccatgaccaggctctgggcaaggctcctcacagtatccttgagaggtgggcatggaagtgcccatttctcaggtacagaaaccttcagagaggataaatagcttgccctgtagaagcaggactgaaacccttgtccgcctgactcccccagctactctgcccactgtagccccctgccttactgtcctggcacacccctcaccatcctgtataccttaaatatcaaagagggcaagagagaaagggctttaaagataagttatttttttaaggaaccttaatattatttttaagaagtaaccaaattagtgacgtgaaatgcaaaaaaaaaaa

SEQ ID NO: 27495 - DNA, 3409 bp, Homo sapiens
atctgccccactttctgtctcacaaacaaccttgccacagtcatcttctacccctgtcctgcccagggcaagggagactcctgtgacttcatttcagacatcaacaatgacatcattcatgacaatgctccatagtagtcaaactgcagaccttaagagccagagcaccccacaccaagagaaagtcattacagaatcaaagtcaccaagcctggtgtctctgcccacagagtccaccaaagctgtaacaacaaactctcctttgcctccatccttaacagagtcctccacagagcaaacccttccagccacaagcaccaacttagcacaaatgtctccaactttcacaactaccattctgaagacctctcagcctcttatgaccactcctggcaccctgtcaagcacagcatctctggtcactggccctatagccgtacagactacagctggaaaacagctctcgctgacccatcctgaaatactagttcctcaaatctcaacagaaggtggcatcagcacagaaaggaaccgagtgattgtggatgctaccactggattgatccctttgaccagtgtacccacatcagcaaaagaaatgaccacaaagcttggcgttacagcagagtacagcccagcttcacgttccctcggaacatctccttctccccaaaccacagttgtttccacggctgaagacttggctcccaaatctgccacctttgctgttcagagcagcacacagtcaccaacaacactgtcctcttcagcctcagtcaacagctgtgctgtgaacccttgtcttcacaatggcgaatgcgtcgcagacaacaccagccgtggctaccactgcaggtgcccgccttcctggcaaggggatgattgcagtgtggatgtgaatgagtgcctgtcgaacccctgcccatccacagccacgtgcaacaatactcagggatcctttatctgcaaatgcccggttgggtaccagttggaaaaagggatatgcaatttggttagaaccttcgtgacagagtttaaattaaagagaacttttcttaatacaactgtggaaaaacattcagacctacaagaagttgaaaatgagatcaccaaaacgttaaatatgtgtttttcagcgttacctagttacatccgatctacagttcacgcctctagggagtccaacgcggtggtgatctcactgcaaacaaccttttccctggcctccaatgtgacgctatttgacctggctgataggatgcagaaatgtgtcaactcctgcaagtcctctgctgaggtctgccagctcttgggatctcagaggcggatctttagagcgggcagcttgtgcaagcggaagagtcccgaatgtgacaaagacacctccatctgcactgacctggacggcgttgccctgtgccagtgcaagtcgggatactttcagttcaacaagatggaccactcctgccgagcatgtgaagatggatataggcttgaaaatgaaacctgcatgagttgcccatttggccttggtggtctcaactgtggaaacccctatcagcttatcactgtggtgatcgcagccgcgggaggtgggctcctgctcatcctaggcatcgcactgattgttacctgttgcagaaagaataaaaatgacataagcaaactcatcttcaaaagtggagatttccaaatgtccccgtatgctgaataccccaaaaatcctcgctcacaagaatggggccgagaagctattgaaatgcatgagaatggaagtaccaaaaacctcctccagatgacggatgtgtactactcgcctacaagtgtaaggaatccagaacttgaacgaaacggactctacccggcctacactggactgccaggatcacggcattcttgcattttccccggacagtataacccgtctttcatcagtgatgaaagcagaagaagagactacttttaagtccaggagagagagggactcattgctctgagccagtcacctgggacctctgctcagaggaccgcaccaggaggctgcgcccaggatttgtcgggagccacgctgagtggcaagcaggaagagggacaggcatgcggggcgtgaccacagtggaggagacaggtggatgtggaaccacaggctgctcattcagcacctttgttgttactgtgaacgtgaatgtgggccagtatcaagagagtctctctgagtgactgcaccatggcactggcaccagggcgactattagccagggcagaccactagacttcagtgcagggacctggttttcccttcgtttgcactttagtaaattgggtgggaggtttccttttggatctgttttgagactgttccagaaagaaggcttcctttcccgagacacttccataggcagcaatttggtgattcatttgcagcaaaatactggcttgttaattattttcctgcccagcgcctgcgtgctaaacaacagatgaggatgagcgtaccactgaagtctgaagatgtcgccattgaacggacagtgttttcatatgtttctaggttgtcttatgctacagtttccaagccagcccccacagtgaggaaatgtgtgaggcaccgcacacaactgcaatgtgttttttaagtcaaggtgacacatgtatttaagattttttttttaaaatctctttgcagttaaatctcactttttcaaacaagcctggatcagggcaaaacaacttatatttggttttagctggaggctcagcaggcagattgcaggcaggggggcacttttcatccatgagggcccagcctggggcctgggactctgatcaccattgtggaggccagaggcagctgcgtatggaggagaaatgtcaaactgaacgcaggtttcaccactctaggaaagcagcttgttgagcccctgcagctggatgtggttagagggatgggctgaataggcaggttagatttcctgcatcaacagtgctttgggaagctgtgtggattcctgaggaagaacagggagccgagatggagccacacatgagtttgctcaccggctactgcagcactttgtacccagaatctcatgtccacaaaccccatgtaaactttcaaccactcaaagctgtttattcggctgaagaaataacttttttttctcacccagtcatttgtacctcttcatatggctatgtcgcaccccttgtccgcctgactcccccagctactctgcccactgtagccccctgccttactgtcctggcacacccctcaccatcctgtataccttaaatatcaaagagggcaagagagaaagggctttaaagataagttatttttttaaggaaccttaatattatttttaagaagtaaccaaattagtgacgtgaaatgcaaaaaaaaaaa

SEQ ID NO: 27496 - DNA, 407 bp, Homo sapiens
gggaatttttaaaaatacttgcttacatgtcttaaaacatacttgaaatatgtgcctagagtgatcctattaaccacaggcacacagtgcacataaggcaatcctatgttttgtatctgtgcacaaatagctttaggacagaatttaaatgtgccaaaacccaaagttcttccagatgtatgctttcactgatttctggaaaattgcttcacagtaccctctcaaagtacatagaccacattataaaatccagaggccactatgcacttttacaacatcattgcgttgactcatgctgtcatttgtcagtgaaatgatgttgtaaatctctcatctttctatgctgcctggcttagacttattatagagttttccaaattcctaccctcattaatgactctttttct

SEQ ID NO: 27497 - DNA, 474 bp, Homo sapiens
acatgaccctccctaccccaagcctcagcttttgcaagagccaatgccatatgtgccacataatgtaaaacaaaatttctcagcaacattttttctgtgggacatctatctgccatattgttgtatctttttcagatatatccattctgcttcacttcttagcagtattcctagaaaagagggtttgatttggccgcgcatggtggctcacgcctgtaatcccagcactttgggaggccgaggctggcggatcacgaggtcaggagatcgagaccatcctggctaatacggtgaaaccctgtctctactaaaaatacaaaaaaattagccgggcgtggtggcgggtgcctgtagtcccagctactctggaggctgaggcaggagaatggtgtcaacccgggaggcggagtttgcagtgagccgagatcgcgccactgcattccagcctgggtgacagagggagactccatctca

SEQ ID NO: 27498 - DNA, 365 bp, Homo sapiens
ctggtcttgaactcctgacctcaggtgatccacctgcctcggtgccctggagtactgcgattccaggtgtgagccaccacgcctggccctcactgcactcatgagcaagaaacacacagccgaggccggtcacggtggctcacgcctagaatcctagcactttgggaggctgaggccagacgatcgtctgagctcaggagtttgagacccgcctgggtaacatggcaagacccttttctatgaaaaatagaaaaaatcagccgggtgtgtgggtggtgcatgcctgtggtcccggctacttgggaggccgaggtgggaggatcacttgagcccaagagatggaggctgcagtgagacgtgactgg

SEQ ID NO: 27499 - DNA, 684 bp, Homo sapiens
ctgttcggcacgtggaaggattgttacagttggggtaccaggtgggttgggaaggaagggaagtggtgcatgaaactgagatttaaatttattttaaaataaatccatgttgtcccacagcataggattagtgggaagaaatgggctttggaatgagacagttgtgagttccaaccccaacccaacaccagagttctgtgagtctgagctggttattgagtctgagtcacgatttcttcatgtatcaaatggataacattgagataacattctgtagccactgccaagaagtcacaaaattgtaatgttataattcttgaatggaaccttgggagattattccagtcccaggtttttaacttcttttggctgatgggcctctttgataatcagatggaagctttagacccactttctagaaagatgcaaattcttcatgtgtatgcagaatttcatgcatataattttagtctgattagtccagtctcttcactttagtcctgcataaagacataaacaattggccaggcacggtgctcatgcctataatcctactgaaatcctaaagctctgggagcctgagttgggaagattgcttaaggcaggagtttgagaccagcctgggcaacatagtgagactccctaaaatctggcctgggtgacagagctagctctgtctcttaa

SEQ ID NO: 27500 - DNA, 769 bp, Homo sapiens
ctgaaagctgacctgggccacgtgtggcccgctggctgtgcattgggcaagcttcatctaaacatggaaaaggtacagtataaaagataagaaatggtacacctgtatagggcacttaccgtgaatggagcttttaggactggaagttgctctggtaagtcagtgagtgagtggtgagtgaatgtgaaggcctaagacatcactgtacactactgtagatgttataaacagtgtatacttagacgactataaattaatgttaaaaataaagtaattcaactacaatgtctctaggcaataggaactttttggctctattataatcttatggggccacctttttatatgcagtcggttgttgactgaaactttatgtggcatgtgatcataatgcttggattctgaaagttttctctccaagggcgtgcaaccattttggtataaaagcaggtaagatgaagtgaaagaattgtgaggcagatggagtgatatatgcctgtggtcccatcctagctactcaggaatctgaggcaggaagatggtttgagcccagaagttggaggttatagggtgctagctgcggtcgtgatcatagctcaccgcaaccttgaacccctgggcttaagcagtctttccatctcagcctcctgagtagctggaactacaggtgtatgccacccatgcctagctaatttttttttttttaatttttagtatagatgaggtcttgatatattgcccaggctggaaaaactttttaaagcaataa

SEQ ID NO: 27501 - DNA, 388 bp, Homo sapiens
ctcttaactatatttctagataacactattttactgtgtggcagccattgtcagtgagttttttttaggaagaaaagctaaaataatactttatgtatttatacaaataaacataaagtgataatattgttcagatttaccttttgattcaggtgatctcaaaaagtcttccccaaagtattctttgatattgaatgcttaccttttatttacttatgtttgttagttgctttaaagtatttttcaagcaaataactttttaatttctattaataagttactttttatcatcttaagtttagattctgcatgtttgcatataattagaaattaggattatatatgatcagaaatttgtggacaatgatagcacttccataatacatag

SEQ ID NO: 27502 - DNA, 163 bp, Homo sapiens
gccagttcccagagataataaaggactcctgctcagaagcaggcctttcatgtgcaaaccaaccaatccagagcccacaccccaccaaaaccccaaagcacaaattataagtgaacacattgatggatttaagcacatcaaaaataacatcttttttttaagc

SEQ ID NO: 27503 - DNA, 945 bp, Homo sapiens
atggaatttacagatagaaactacacgttggtcactgagtttattctattaggttttccaactcgccctgaactgcagattgtcctgttcctcatgtttctgacattgtatgctataattctgatagggaacattggattgatgctgttgatcaggattgatcctcaccttcaaacccccatgtattttttccttagcaacctatcatttgtagacctttgctatttctcagacattgttcccaaaatgctggtcaatttcctctcggagaacaaatctatttcctattatgggtgtgccctgcagttttattttttctgtacttttgcagatacagaatccttcatcctggccgccatggcctatgatcgctatgtcgccatctgtaaccctttattgtacacagttgtgatgtctaggggcatctgtatgcggttgattgtcttgtcataccttggaggcaacatgagttccctggttcacacatcctttgcctttattctgaaatattgtgacaaaaatgttattaatcattttttctgtgacctccctcccctgcttaaactatcctgcactgacacaacaattaatgagtggctcctctccacatacggcagctcagtggaaatcatttgttttatcatcatcatcatctcctactttttcattcttctctcagtcttaaagatccgctctttcagtgggaggaagaagaccttttctacatgcgcctctcacctgacttcagtgacgatctaccaagggactctcctctttatttactcacggcccagctacctgtattctccaaacactgataaaattatctcagtgttctacaccattttcattccagtgctgaatccgttgatttatagtttgagaaataaagatgtaaaggatgcagctgagaaagttctaagatcaaaggtagattcttcatga

SEQ ID NO: 27504 - DNA, 341 bp, Homo sapiens
aagattattgatagaaggattaattggacctcactcaccttttctgtgccataaggaaagcagttaggtaaagctgaccttctttggagggaagacacaaggtcaaggcatgcccatcaggatgccctttgggcctagacctgatgtgagaatgatgggcttggagtgttctggaaatagctgggaggcctgtgtgtttaggagcaccttaaacagtaggatataagggcagagaagtagctgggaactgagaaaagaactttggctgttattctagtaagactgaaaatttcaggtgggatttgaacagagatgtgttgtgatctgacttggtggttcat

SEQ ID NO: 27505 - DNA, 1274 bp, Homo sapiens
aagaggatgcagaatcttagggagtgaggcaagcagggaaaacacgtccatctgttcatgtccagagatggtttagccaactgggccactgagttcagtgtctaaaatatgctgagagaaaacagacaacagttagaaaaaagagagccacatcaaggaggtccagcaagatgccatcctatcagacaaacgagagcagagcaatccaagacaagcagtatttgcaggttgagtacaggtccaggcaggcatccagcactgtgttagtctgtttgggctgctgggacaaaataccgtagactgggggacttaaacaacaaaatggattttcttgtaattctggaggccagaagtccaggatcaaggtgttggcagggttggttgcttctgaggcccctctcctgggcttgtaggtgactcacttctccctgtgacttcacttggtcttccctatgtatgtgtctgtatcctaatctttatttctcataaggacacgagtcctattgccttagggcccaccctaatgatctcattatgcacttaatttacctctttcaagaccctaactccaaatgcagtcacattctgtggtgcttggggtaagactacatgatacaaattgtgagtttaaaacataattcagcccataatgaaaaatcaaggtggttttacggtagatcgaagggccatttaaggggtaggaaaataaagccactgagtcaatgaagggttggatatcattgttggtggggaaaggggagactggtaagaaaaccaaggcatctagagaactaagtagcatgatcaggaataggagagaaatgtggattgttgggggtgtgaggggaagctatggttggggtcatggtaggaaccctggttctagttcagcacttaaccagccagggtctagggtgctcatccttctaacactgactcagaactttaattgttttcttgactgaatttgtccctgagcccgaagcagggatctgcttgccgtgaagattaggttagttcagttaaggggacaggagaactttagagccatgagccagtggaccagtaagaattattttctttggagctgggcacagtagctcatgcttgtaatgccaggactttgggaggccgaggcaggtggatggagaccagcctgggcaatgtggtgaaactgcatctctacaaaaaataaaaataataataatacaaaaattagccaggcgtgatggtgcgtacctgtaatcccagctacttgagaggctaaggtggga

SEQ ID NO: 27506 - DNA, 317 bp, Homo sapiens
ttttttttttcttaatttccctgggctccatggattgtgtgtatgtgtatgaatgagagagagaaagagagagagaatttcgtatgttactcaggtggcatttgggaacgaacggtgctcaaaatagaaatggatagtattcgccctcactctgccaagaacacagagtccgaccatgtctatggagaagcagatggcatcatgtggggacacctgaggcagggaaggtgcaatacctaaactgattttgatgttggcaagagtccccgtttaccgactaagcatgaacgtgccaacagctattgagaaaagaggtt

SEQ ID NO: 27507 - DNA, 432 bp, Homo sapiens
gatagtaagaggcagggcttaggcatgggtatatgatttaattatgaccagtgaagttgacaaggaaatgtgggaaaatagccatctttcaaccatgaggagtgacatcaccaagtcactcaagatggcagagtagaaaacagaaaataccatgtgggacactaataagatcattatgacaattcattaactgccaatactccaaattttttgttgagtgagaagatacacccttactgtttactttacttgtagtaaggccttctattacttatatttttattaacacagaaaagtttttacgaatattcacacagtttcccacactgggttaagtcaaactaacacgaagttggattgattcctctggtagaagtcaggggttttccctttcttcatgctgcatgcctagacaacatgtcacatgacaat

SEQ ID NO: 27508 - DNA, 470 bp, Homo sapiens
taaactgttgctatactagattaaactgattgccttctagtggtaaaccagactttcagctatttctttccatgtttctatgttctgccctttttttctttccttctgggactcagatgataggaagctcggcccttttgttattacctaaggtctctatggttctgttcaaggttttcaaactttgtctgttactcagattcagtcatttctattaatttatttatgaactgactgactacttcctccatcatcttcatcccagtagtgagcccagccagtgtgttttctatttttgtagttgattttttcatttctaatatttccacttagttcttcttcatatcttccatttctttgcaaaattttctatatgttttaagagtaccctcctttacttgtacaatatttttaacaactgcttgaaaatctttgtcaaataattccagtatctgtttcatctcagagta

SEQ ID NO: 27509 - DNA, 349 bp, Homo sapiens
ggagacatgccaatggcaggacttatagaccagtcgtaggatccctaagtcctctctgagggtctggcctggatcccaatacctctgcatcctgccttgtctctccaaaaatatttatctttagagagagttcggagggccaagcaaagcttgtctaaaccgcagagagatgcacctgctcctggtccggggcctctggacctccctcccctccaccctgtcctgactcctttacatggacccttgtcaccccacctgcggccccagaagctcaaaggaagagctgacctggggtacacaacacccccttcccctgtacaaatcccagtctgggtcctaccttgaaggg

SEQ ID NO: 27510 - DNA, 1334 bp, Homo sapiens
aaagaaaatgtggctgcccagaaggtcaatcatgagtgagttgtgattgcgcccctgtactccagcctgggcaacagagtgagacacagtctgaaataaataaataaataaacaaaataaaaacaaataagtaaatgaaattaaaacaaaacccaaaatacggtcttaaaaaaaggacatttagtaaaataataggaaatctaagacattaacaagtgagtcttctttattttctaccttagttgatttaatgaaatccagtgatttcatattctcccatttgcacaaaacaaaaattcatagatactttgaagagttggaagggaactgagaaggcctgtatcccaagcaactatacagtacagaatcttgggaaaagcttgccttagagatgaccatttcgggttttgcttgaattggaaatcttctacctgtctcaccttttagacatccttaattgttccctaaattgttcctaaatttgcttccttgtaatgtctttctggacctgccatctcttgctacaaagaacataaaaaaccaaaaaccatttcttgatgagattctgcccttcatctcctatctctctaagtctttcatttgccacatttaccatcactttgtttaaggaggaggcactgtagtccgagtgaggagggatgaagaggtgaagagatgggtctctacttctacctcttgcattgaccatactggtgactttgggtgagccacctttccattagggcctctgtttctttcttgtcaggtgagggagatggacttagatgacttagatgatttttttttttttgagacgaaatctactttgttgcacaggctggtgtgcagtggcacggtcatagctcactgcagcctttacctcctgggctcaagcgatcctctcaccttggcctcccaaagtgttgggattacaggcatgagctactgaccccagcctagatgacctttaagcttgctttcaacctgcattctggagttattagcttttcagctgaggtttttattaaatggttttatttgtcatcttctgtctgcccccttgtggacattgttttgggaagaaaataaaatatttaattgctcgaagaacaatataatgaccatctcaccctccaaaaattcacttgcatcacactgtttgttttcagttattcatgttcacttctagtcgtcgttcataaatgtacatcattttacatggttgaatcatatcagggacataattttgtactttcccccctccctgataaagatgatgtttttacagtaaaataaaaaaatgcttgtgattcaataagcttttaaaatattac

SEQ ID NO: 27511 - DNA, 1695 bp, Homo sapiens
  misc_feature (45)..(45): n is a, c, g, or t
  misc_feature (51)..(51): n is a, c, g, or t
  misc_feature (74)..(74): n is a, c, g, or t
  misc_feature (88)..(88): n is a, c, g, or t
  misc_feature (100)..(100): n is a, c, g, or t
  misc_feature (110)..(110): n is a, c, g, or t
  misc_feature (126)..(126): n is a, c, g, or t
  misc_feature (137)..(137): n is a, c, g, or t
  misc_feature (151)..(151): n is a, c, g, or t
  misc_feature (168)..(168): n is a, c, g, or t
  misc_feature (171)..(171): n is a, c, g, or t
  misc_feature (208)..(208): n is a, c, g, or t
  misc_feature (543)..(543): n is a, c, g, or t
  misc_feature (611)..(611): n is a, c, g, or t
  misc_feature (978)..(978): n is a, c, g, or t
  misc_feature (1395)..(1395): n is a, c, g, or t
  misc_feature (1461)..(1461): n is a, c, g, or t
  misc_feature (1467)..(1467): n is a, c, g, or t
  misc_feature (1531)..(1531): n is a, c, g, or t
  misc_feature (1537)..(1537): n is a, c, g, or t
  misc_feature (1544)..(1544): n is a, c, g, or t
  misc_feature (1578)..(1578): n is a, c, g, or t
  misc_feature (1587)..(1587): n is a, c, g, or t
  misc_feature (1598)..(1598): n is a, c, g, or t
  misc_feature (1607)..(1607): n is a, c, g, or t
  misc_feature (1621)..(1621): n is a, c, g, or t
  misc_feature (1677)..(1677): n is a, c, g, or t
  misc_feature (1681)..(1681): n is a, c, g, or t
  misc_feature (1683)..(1683): n is a, c, g, or t
  misc_feature (1686)..(1686): n is a, c, g, or t
  misc_feature (1688)..(1691): n is a, c, g, or t
tggagatagagtcttgctctgtcacccaggctggatcttggctcnctgcancctctgcctcctgggttcaagcnattctcctgccttngcctctcgagtngctgggattncaggcacctgccaccncgcccggctantttttgtatttttngcagagatggggtttcnccntgttggccaggatggtctcgatctcttgacctcatgntctgcctgccttggcctcccaaagtgccggaattacaggcatgagccaccacacctggccactgttctcaaattgtattatggagttttttttttttacaaaatatggatatattttaatttactcaaatgggaactactgataagcagttcttatttttccagcataagcaaggctacaataaatatctttgaatatatgtactgatgctttttgttttttgttgaagctatatcccaataagtgataagtacggtctaagagagaacatgttttttacaattttgattgatatcatattgggccacgcatggtggctcaggcctggcatcccngcactttgggaggttgaggtgggaggatagcttgagctcaggagttcaagaccagcttgagcaacctngtgagacctcatctctactaaaaaaacaaaacaaacaaacacaaaattagctaggtgtggtggcatgtgccagtagtcccagctagttgggaggctgaggtggaaagattgcttgatcctgggaggttgaggctacagtgagctgtgatggtatcactgcactctatcctggacaacacagcaagaacctgcctcaaacaaatgtatttggttgatattgtatcagatttcttctgaaaaacgttttaatggtttagactttcaccaagtgcaagaaactggcattttctttgtaactggcctggaatgttaccactcttttaaacttttgtcaagatgatcgtgagaaatagtatctaattacttnaatttgcatttccctgactcctaatgaagttcagcatctcttcaaatctttattgggcatttggattttctcttcagtgaattgcttcatcatattctccatttattctaaagttgtgttcctatttgtcgctttcaaatctagtttggtggaatccttgcatgttagaaaccttaaccctcgtaatatgtgttgtagatatttttccctcgcctatgagttgtctttcatccttgagcatgagttttagagtcagaagaacaacagtaggatttgaatcatgttacgttattttctagttgtcgtattttttatttcttcagcctcttagaatcttagtttcctttaaaattgagataatagtatctactttattcaaaaaaattttttggctggacgcggtggctcacgcttgtnatcccaccattttgggaggccaaggcaggcggatcacctgaggtcaggagtttgagaccagcttgnccaacntggtgaaaacccatctctactaaaaatacaaaaattagccaggtacagcggggcatgcctgtantcccangtactcnggaggctgaggcaggagaatcacttgacccgggnggcagagangaggtagtganctgaatcgnaccactgcactccngcctgagtggtagggcgagactctgtctcaaaaaaaaaatgttttttcattatttntttntnganannnncttc

SEQ ID NO: 27512 - DNA, 3339 bp, Homo sapiens
cagagagcgttgagctgggaacagtgacaagtgcttatcaagttccttcactctcaacacggttgacaagaactgatggcattatggaacacatcacaaaaatacccaatgaagcagcacacagaggtaccataagaccagtcaaaggccctcagacatccacttcgcctgccagtcctaaaggactacacacaggagggacaaaaagaatggagaccaccaccacagctctgaagaccaccaccacagctctgaagaccacttccagagccaccttgaccaccagtgtctatactcccactttgggaacactgactcccctcaatgcatcaatgcaaatggccagcacaatccccacagaaatgatgatcacaaccccatatgttttccctgatgttccagaaacgacatcctcattggctaccagcctggggggaggtgggctgggctggctctgggagttctggaagctcccaagctttgtagctcaggccaacagagcccagggacagaggcagagccccagaggggtgacaccccctctgagtcccattcgttcacctatcttctatggccgccccatagccatactgcccattagcgtggccgccagcattacagctcagaggcatcgccgctacaaagctttggtggcatcagagccgctcagtgtgcggctctatcgtctgggcttggcttaccttgctttcacaggcccactggcatacagtgccctctgcaacacagctgccaccctcagctatgtggcagaaacctttggctccttcttgaattggttcagcttcttcccccttcttggccgcctcatggagtttgtcctccttctgccttaccggatctggaggctactgatgggggagactggcttcaacagcagctgctttcaggagtgggcgaagctctatgagtttgttcacagttttcaggatgagaagcgtcagctggcttaccaggttttgggcctctcagaaggggcaacaaatgaagaaatacatcggagttaccaggagctagtgaaggtctggcacccagaccacaacctggaccagacagaggaggcacagaggcacttcctggagatccaggctgcgtatgaagtcctgagtcaacccaggaagccctggggatcccggaggtgaaaagaaacttccccctgaggactgactcttcctagcagagctgggcaacttgtcccaaatctagctttgcccacgaatggcatcccaacagagttaaagaaactgcttgcaggggctgggcgtggtggctcatgcctgtaatcccagcactttgggaggccgaggcgggcagatcacgaggtcaggagttcgagaccagcagcctggccaatatagtgaaacttcgtctctactaaaaatacaaaaaattagccaggagtggtggcaggcacctgtagtcccagctacttgggaggctgaggcaggagaatcacctgaacctgagaggcggaggttgcagtgagccgagatcacgccactgcactccagcctgggcaacaagagtgaaactccgtctcaaaaaaaaaaaaaaagaaagaaaaactgcttgcaggggacatgagaaaacaatggggtgagaaaaggttgtggtagaaggatgtgtttatattctgaatttctgaattcttggctattgcattcttgacaatttttcttaaaaccagagagtgaaaggcatattataaaacaatcaaatatcttttagagtatggacaactattatatatcaataaaaaattaattagaaaaaatatatcttttagagaacacaccaccttatcccacccatgatatattgatgtgtgatggagaaagattatttaactatttttttaaatgtgtaaagcagcagggcatagtggcttacgcctgtaatcccaacactttgggaagctgaggtgggaggatcaccttaggtcaggagttcaagaccagcctggccaaccaacatggtgaaaccccatctctactaaaaatacaaaacttagccagccatggtggcacatgcctgtagccccagctagtcgggaggctgaggcaggaaaatcacttgagcctgggaggtggaggttgcagtcaactgagattgagccactgcactgtactccagcctgggcggcagagctagattctgtctcaaaaattaaataaataaataagtaagtaaataaataaataaataaatgtataaagcactatgttaggagattgaaggaaaaatatgaaggttctagtattcacaagctgtcctgtgataagagagatttgatcttttctgtagatggggtgagactaggattaaatttcaaaatttgagaaaaatattttcattccatttatgggagaactttctagcagctacactttctccaaaagggaacaagctactgtggagtggggggtagttcttcctcctctgcttagaggagaatttttggagagctctcagactttacataggtgattggactggctgacttctcaggtcttcccagtatttgaggtctgattctgggctacataccctactcctagaagcatacaatctgatgggagataatgacacaggtacacagatatcaaagcccttgttcagtgttttgaactaaatgtcataagagctgtaaatagtgtattggcacattggaggagggacagataacattgttttatggggactcagaaagattcattattttatatgtcatatgtccctttggggactttgggaaaccctagggaaccagcggctagagcatctcaagggggccttattcaattctaggtaactagccaggtgtgaaagaaagggcccagggtgtctcactttgcagaggaagattggagaccaggaacatgattttaaattatgtgcctttactgcagctttcttgctctctttgtgtgtgtgcattctttccatttttttcttctttctggatgttaaatctgagtaatatatatcatttttaaagtggaattatgaccaggcatggtgcctcttgcctataatcctagcactttggcaagccaaggcaggaagattgcttgagcccaggagttcaacaccagcctgggcaacatggcaaaactccatctctacaaaaagtacaaaaatgagccaggtgttgtggggtgcgcctgtagtcccagctaaggaggctgagattgggaggatcacttgaacccaaaaggtggaggctgcagtgagctgagatcgtaccactacactccagcctgagtgacacagtgacagcctgtctcaaaaatataaaaataaataaataaataaagtgga

SEQ ID NO: 27513 - DNA, 3397 bp, Homo sapiens
gtgggagcagggcgagacgggccattttcactctgtggtcaaaggaaatgactggtctgactcggtctgggagcggggcacccagggtctaaggataactctggggccatgacagccatgagtctcacagaggaccccgagacttctgtgctgcgagtaaccggacttgttctgagacctttgccctagaggatggccaaggggctcctggtgacctatgccctctgggctgtggggggccctgctgggctccaccacctgtacctgggaagggacagccacgccctgctctggatgctgaccctggggggaggtgggctgggctggctctgggagttctggaagctcccaagctttgtagctcaggccaacagagcccagggacagaggcagagccccagaggggtgacaccccctctgagtcccattcgctttgctgcccaggtgatagttggcatctattttggccttgtggcactgattagcctttcttccatggtcaacttctatattgtggccctcccactggcagttggcttaggggtcttgctggtggctgctgttggcaaccagacctcagactttaagaacactctggggtcagcatttctcacttcacctatcttctatggccgccccatagccatactgcccattagcgtggccgccagcattacagctcagaggcatcgccgctacaaagctttggtggcatcagagccgctcagtgtgcggctctatcgtctgggcttggcttaccttgctttcacaggcccactggcatacagtgccctctgcaacacagctgccaccctcagctatgtggcagaaacctttggctccttcttgaattggttcagcttcttcccccttcttggccgcctcatggagtttgtcctccttctgccttaccggatctggaggctactgatgggggagactggcttcaacagcagctgctttcaggagtgggcgaagctctatgagtttgttcacagttttcaggatgagaagcgtcagctggcttaccaggttttgggcctctcagaaggggcaacaaatgaagaaatacatcggagttaccaggagctagtgaaggtctggcacccagaccacaacctggaccagacagaggaggcacagaggcacttcctggagatccaggctgcgtatgaagtcctgagtcaacccaggaagccctggggatcccggaggtgaaaagaaacttccccctgaggactgactcttcctagcagagctgggcaacttgtcccaaatctagctttgcccacgaatggcatcccaacagagttaaagaaactgcttgcaggggctgggcgtggtggctcatgcctgtaatcccagcactttgggaggccgaggcgggcagatcacgaggtcaggagttcgagaccagcagcctggccaatatagtgaaacttcgtctctactaaaaatacaaaaaattagccaggagtggtggcaggcacctgtagtcccagctacttgggaggctgaggcaggagaatcacctgaacctgagaggcggaggttgcagtgagccgagatcacgccactgcactccagcctgggcaacaagagtgaaactccgtctcaaaaaaaaaaaaaaagaaagaaaaactgcttgcaggggacatgagaaaacaatggggtgagaaaaggttgtggtagaaggatgtgtttatattctgaatttctgaattcttggctattgcattcttgacaatttttcttaaaaccagagagtgaaaggcatattataaaacaatcaaatatcttttagagtatggacaactattatatatcaataaaaaattaattagaaaaaatatatcttttagagaacacaccaccttatcccacccatgatatattgatgtgtgatggagaaagattatttaactatttttttaaatgtgtaaagcagcagggcatagtggcttacgcctgtaatcccaacactttgggaagctgaggtgggaggatcaccttaggtcaggagttcaagaccagcctggccaaccaacatggtgaaaccccatctctactaaaaatacaaaacttagccagccatggtggcacatgcctgtagccccagctagtcgggaggctgaggcaggaaaatcacttgagcctgggaggtggaggttgcagtcaactgagattgagccactgcactgtactccagcctgggcggcagagctagattctgtctcaaaaattaaataaataaataagtaagtaaataaataaataaataaatgtataaagcactatgttaggagattgaaggaaaaatatgaaggttctagtattcacaagctgtcctgtgataagagagatttgatcttttctgtagatggggtgagactaggattaaatttcaaaatttgagaaaaatattttcattccatttatgggagaactttctagcagctacactttctccaaaagggaacaagctactgtggagtggggggtagttcttcctcctctgcttagaggagaatttttggagagctctcagactttacataggtgattggactggctgacttctcaggtcttcccagtatttgaggtctgattctgggctacataccctactcctagaagcatacaatctgatgggagataatgacacaggtacacagatatcaaagcccttgttcagtgttttgaactaaatgtcataagagctgtaaatagtgtattggcacattggaggagggacagataacattgttttatggggactcagaaagattcattattttatatgtcatatgtccctttggggactttgggaaaccctagggaaccagcggctagagcatctcaagggggccttattcaattctaggtaactagccaggtgtgaaagaaagggcccagggtgtctcactttgcagaggaagattggagaccaggaacatgattttaaattatgtgcctttactgcagctttcttgctctctttgtgtgtgtgcattctttccatttttttcttctttctggatgttaaatctgagtaatatatatcatttttaaagtggaattatgaccaggcatggtgcctcttgcctataatcctagcactttggcaagccaaggcaggaagattgcttgagcccaggagttcaacaccagcctgggcaacatggcaaaactccatctctacaaaaagtacaaaaatgagccaggtgttgtggggtgcgcctgtagtcccagctaaggaggctgagattgggaggatcacttgaacccaaaaggtggaggctgcagtgagctgagatcgtaccactacactccagcctgagtgacacagtgacagcctgtctcaaaaatataaaaataaataaataaataaagtgga

SEQ ID NO: 27514 - DNA, 2619 bp, Homo sapiens
aaaaaattattttagaaaaaagaattccagccttttgaaacatagacaagctctagatctcatggcaagagccattaaccacaactgcccattttccaagctggaattctaacctgagctgctggacctttcccacgggcaagtagaagccaattctagagatatgatagcctgatttagcaaaggtgcaaggagaggcccaggtaccctgacaacttgggggattctaatttgtcatcttctgtttccataaggttttgggcctctcagaaggggcaacaaatgaagaaatacatcggagttaccaggagctagtgaaggtctggcacccagaccacaacctggaccagacagaggaggcacagaggcacttcctggagatccaggctgcgtatgaagtcctgagtcaacccaggaagccctggggatcccggaggtgaaaagaaacttccccctgaggactgactcttcctagcagagctgggcaacttgtcccaaatctagctttgcccacgaatggcatcccaacagagttaaagaaactgcttgcaggggctgggcgtggtggctcatgcctgtaatcccagcactttgggaggccgaggcgggcagatcacgaggtcaggagttcgagaccagcagcctggccaatatagtgaaacttcgtctctactaaaaatacaaaaaattagccaggagtggtggcaggcacctgtagtcccagctacttgggaggctgaggcaggagaatcacctgaacctgagaggcggaggttgcagtgagccgagatcacgccactgcactccagcctgggcaacaagagtgaaactccgtctcaaaaaaaaaaaaaaagaaagaaaaactgcttgcaggggacatgagaaaacaatggggtgagaaaaggttgtggtagaaggatgtgtttatattctgaatttctgaattcttggctattgcattcttgacaatttttcttaaaaccagagagtgaaaggcatattataaaacaatcaaatatcttttagagtatggacaactattatatatcaataaaaaattaattagaaaaaatatatcttttagagaacacaccaccttatcccacccatgatatattgatgtgtgatggagaaagattatttaactatttttttaaatgtgtaaagcagcagggcatagtggcttacgcctgtaatcccaacactttgggaagctgaggtgggaggatcaccttaggtcaggagttcaagaccagcctggccaaccaacatggtgaaaccccatctctactaaaaatacaaaacttagccagccatggtggcacatgcctgtagccccagctagtcgggaggctgaggcaggaaaatcacttgagcctgggaggtggaggttgcagtcaactgagattgagccactgcactgtactccagcctgggcggcagagctagattctgtctcaaaaattaaataaataaataagtaagtaaataaataaataaataaatgtataaagcactatgttaggagattgaaggaaaaatatgaaggttctagtattcacaagctgtcctgtgataagagagatttgatcttttctgtagatggggtgagactaggattaaatttcaaaatttgagaaaaatattttcattccatttatgggagaactttctagcagctacactttctccaaaagggaacaagctactgtggagtggggggtagttcttcctcctctgcttagaggagaatttttggagagctctcagactttacataggtgattggactggctgacttctcaggtcttcccagtatttgaggtctgattctgggctacataccctactcctagaagcatacaatctgatgggagataatgacacaggtacacagatatcaaagcccttgttcagtgttttgaactaaatgtcataagagctgtaaatagtgtattggcacattggaggagggacagataacattgttttatggggactcagaaagattcattattttatatgtcatatgtccctttggggactttgggaaaccctagggaaccagcggctagagcatctcaagggggccttattcaattctaggtaactagccaggtgtgaaagaaagggcccagggtgtctcactttgcagaggaagattggagaccaggaacatgattttaaattatgtgcctttactgcagctttcttgctctctttgtgtgtgtgcattctttccatttttttcttctttctggatgttaaatctgagtaatatatatcatttttaaagtggaattatgaccaggcatggtgcctcttgcctataatcctagcactttggcaagccaaggcaggaagattgcttgagcccaggagttcaacaccagcctgggcaacatggcaaaactccatctctacaaaaagtacaaaaatgagccaggtgttgtggggtgcgcctgtagtcccagctaaggaggctgagattgggaggatcacttgaacccaaaaggtggaggctgcagtgagctgagatcgtaccactacactccagcctgagtgacacagtgacagcctgtctcaaaaatataaaaataaataaataaataaagtgga

SEQ ID NO: 27515 - DNA, 1997 bp, Homo sapiens
  misc_feature (845)..(845): n is a, c, g, or t
  misc_feature (913)..(913): n is a, c, g, or t
  misc_feature (1280)..(1280): n is a, c, g, or t
  misc_feature (1697)..(1697): n is a, c, g, or t
  misc_feature (1763)..(1763): n is a, c, g, or t
  misc_feature (1769)..(1769): n is a, c, g, or t
  misc_feature (1833)..(1833): n is a, c, g, or t
  misc_feature (1839)..(1839): n is a, c, g, or t
  misc_feature (1846)..(1846): n is a, c, g, or t
  misc_feature (1880)..(1880): n is a, c, g, or t
  misc_feature (1889)..(1889): n is a, c, g, or t
  misc_feature (1900)..(1900): n is a, c, g, or t
  misc_feature (1909)..(1909): n is a, c, g, or t
  misc_feature (1923)..(1923): n is a, c, g, or t
  misc_feature (1979)..(1979): n is a, c, g, or t
  misc_feature (1983)..(1983): n is a, c, g, or t
  misc_feature (1985)..(1985): n is a, c, g, or t
  misc_feature (1988)..(1988): n is a, c, g, or t
  misc_feature (1990)..(1993): n is a, c, g, or t
aaaaaattattttagaaaaaagaattccagccttttgaaacatagacaagctctagatctcatggcaagagccattaaccacaactgcccattttccaagctggaattctaacctgagctgctggacctttcccacgggcaagtagaagccaattctagagatatgatagcctgatttagcaaaggtgcaaggagaggcccaggtaccctgacaacttgggggattctaatttgtcatcttctgtttccataaggttttgggcctctcagaaggggcaacaaatgaagaaatacatcggagttaccaggagctagtgaaggtctggcacccagaccacaacctggaccagacagaggaggcacagaggcacttcctggagatccaggctgcgtatgaagtcctgagtcaacccaggaagccctggggatcccggaggtgaaaagaaacttccccctgaggactgactcttcctagcagagctgggcaacttgtcccaaatctagctttgcccacgaatggcatcccaacagagttaaagaaactgcttgcatgagccaccacacctggccactgttctcaaattgtattatggagttttttttttttacaaaatatggatatattttaatttactcaaatgggaactactgataagcagttcttatttttccagcataagcaaggctacaataaatatctttgaatatatgtactgatgctttttgttttttgttgaagctatatcccaataagtgataagtacggtctaagagagaacatgttttttacaattttgattgatatcatattgggccacgcatggtggctcaggcctggcatcccngcactttgggaggttgaggtgggaggatagcttgagctcaggagttcaagaccagcttgagcaacctngtgagacctcatctctactaaaaaaacaaaacaaacaaacacaaaattagctaggtgtggtggcatgtgccagtagtcccagctagttgggaggctgaggtggaaagattgcttgatcctgggaggttgaggctacagtgagctgtgatggtatcactgcactctatcctggacaacacagcaagaacctgcctcaaacaaatgtatttggttgatattgtatcagatttcttctgaaaaacgttttaatggtttagactttcaccaagtgcaagaaactggcattttctttgtaactggcctggaatgttaccactcttttaaacttttgtcaagatgatcgtgagaaatagtatctaattacttnaatttgcatttccctgactcctaatgaagttcagcatctcttcaaatctttattgggcatttggattttctcttcagtgaattgcttcatcatattctccatttattctaaagttgtgttcctatttgtcgctttcaaatctagtttggtggaatccttgcatgttagaaaccttaaccctcgtaatatgtgttgtagatatttttccctcgcctatgagttgtctttcatccttgagcatgagttttagagtcagaagaacaacagtaggatttgaatcatgttacgttattttctagttgtcgtattttttatttcttcagcctcttagaatcttagtttcctttaaaattgagataatagtatctactttattcaaaaaaattttttggctggacgcggtggctcacgcttgtnatcccaccattttgggaggccaaggcaggcggatcacctgaggtcaggagtttgagaccagcttgnccaacntggtgaaaacccatctctactaaaaatacaaaaattagccaggtacagcggggcatgcctgtantcccangtactcnggaggctgaggcaggagaatcacttgacccgggnggcagagangaggtagtganctgaatcgnaccactgcactccngcctgagtggtagggcgagactctgtctcaaaaaaaaaatgttttttcattatttntttntnganannnncttc

SEQ ID NO: 27516 - DNA, 4542 bp, Homo sapiens
  misc_feature (3390)..(3390): n is a, c, g, or t
  misc_feature (3458)..(3458): n is a, c, g, or t
  misc_feature (3825)..(3825): n is a, c, g, or t
  misc_feature (4242)..(4242): n is a, c, g, or t
  misc_feature (4308)..(4308): n is a, c, g, or t
  misc_feature (4314)..(4314): n is a, c, g, or t
  misc_feature (4378)..(4378): n is a, c, g, or t
  misc_feature (4384)..(4384): n is a, c, g, or t
  misc_feature (4391)..(4391): n is a, c, g, or t
  misc_feature (4425)..(4425): n is a, c, g, or t
  misc_feature (4434)..(4434): n is a, c, g, or t
  misc_feature (4445)..(4445): n is a, c, g, or t
  misc_feature (4454)..(4454): n is a, c, g, or t
  misc_feature (4468)..(4468): n is a, c, g, or t
  misc_feature (4524)..(4524): n is a, c, g, or t
  misc_feature (4528)..(4528): n is a, c, g, or t
  misc_feature (4530)..(4530): n is a, c, g, or t
  misc_feature (4533)..(4533): n is a, c, g, or t
  misc_feature (4535)..(4538): n is a, c, g, or t
cagagagcgttgagctgggaacagtgacaagtgcttatcaagttccttcactctcaacacggttgacaagaactgatggcattatggaacacatcacaaaaatacccaatgaagcagcacacagaggtaccataagaccagtcaaaggccctcagacatccacttcgcctgccagtcctaaaggactacacacaggagggacaaaaagaatggagaccaccaccacagctctgaagaccaccaccacagctctgaagaccacttccagagccaccttgaccaccagtgtctatactcccactttgggaacactgactcccctcaatgcatcaatgcaaatggccagcacaatccccacagaaatgatgatcacaaccccatatgttttccctgatgttccagaaacgacatcctcattggctaccagcctggggggaggtgggctgggctggctctgggagttctggaagctcccaagctttgtagctcaggccaacagagcccagggacagaggcagagccccagaggggtgacaccccctctgagtcccattcgttcacctatcttctatggccgccccatagccatactgcccattagcgtggccgccagcattacagctcagaggcatcgccgctacaaagctttggtggcatcagagccgctcagtgtgcggctctatcgtctgggcttggcttaccttgctttcacaggcccactggcatacagtgccctctgcaacacagctgccaccctcagctatgtggcagaaacctttggctccttcttgaattggttcagcttcttcccccttcttggccgcctcatggagtttgtcctccttctgccttaccggatctggaggctactgatgggggagactggcttcaacagcagctgctttcaggagtgggcgaagctctatgagtttgttcacagttttcaggatgagaagcgtcagctggcttaccaggttttgggcctctcagaaggggcaacaaatgaagaaatacatcggagttaccaggagctagtgaaggtctggcacccagaccacaacctggaccagacagaggaggcacagaggcacttcctggagatccaggctgcgtatgaagtcctgagtcaacccaggaagccctggggatcccggaggtgaaaagaaacttccccctgaggactgactcttcctagcagagctgggcaacttgtcccaaatctagctttgcccacgaatggcatcccaacagagttaaagaaactgcttgcaggggctgggcgtggtggctcatgcctgtaatcccagcactttgggaggccgaggcgggcagatcacgaggtcaggagttcgagaccagcagcctggccaatatagtgaaacttcgtctctactaaaaatacaaaaaattagccaggagtggtggcaggcacctgtagtcccagctacttgggaggctgaggcaggagaatcacctgaacctgagaggcggaggttgcagtgagccgagatcacgccactgcactccagcctgggcaacaagagtgaaactccgtctcaaaaaaaaaaaaaaagaaagaaaaactgcttgcaggggacatgagaaaacaatggggtgagaaaaggttgtggtagaaggatgtgtttatattctgaatttctgaattcttggctattgcattcttgacaatttttcttaaaaccagagagtgaaaggcatattataaaacaatcaaatatcttttagagtatggacaactattatatatcaataaaaaattaattagaaaaaatatatcttttagagaacacaccaccttatcccacccatgatatattgatgtgtgatggagaaagattatttaactatttttttaaatgtgtaaagcagcagggcatagtggcttacgcctgtaatcccaacactttgggaagctgaggtgggaggatcaccttaggtcaggagttcaagaccagcctggccaaccaacatggtgaaaccccatctctactaaaaatacaaaacttagccagccatggtggcacatgcctgtagccccagctagtcgggaggctgaggcaggaaaatcacttgagcctgggaggtggaggttgcagtcaactgagattgagccactgcactgtactccagcctgggcggcagagctagattctgtctcaaaaattaaataaataaataagtaagtaaataaataaataaataaatgtataaagcactatgttaggagattgaaggaaaaatatgaaggttctagtattcacaagctgtcctgtgataagagagatttgatcttttctgtagatggggtgagactaggattaaatttcaaaatttgagaaaaatattttcattccatttatgggagaactttctagcagctacactttctccaaaagggaacaagctactgtggagtggggggtagttcttcctcctctgcttagaggagaatttttggagagctctcagactttacataggtgattggactggctgacttctcaggtcttcccagtatttgaggtctgattctgggctacataccctactcctagaagcatacaatctgatgggagataatgacacaggtacacagatatcaaagcccttgttcagtgttttgaactaaatgtcataagagctgtaaatagtgtattggcacattggaggagggacagataacattgttttatggggactcagaaagattcattattttatatgtcatatgtccctttggggactttgggaaaccctagggaaccagcggctagagcatctcaagggggccttattcaattctaggtaactagccaggtgtgaaagaaagggcccagggtgtctcactttgcagaggaagattggagaccaggaacatgattttaaattatgtgcctttactgcagctttcttgctctctttgtgtgtgtgcattctttccatttttttcttctttctggatgttaaatctgagtaatatatatcatttttaaagtggaattatgaccaggcatggtgcctcttgcctataatcctagcatgccttggcctcccaaagtgccggaattacaggcatgagccaccacacctggccactgttctcaaattgtattatggagttttttttttttacaaaatatggatatattttaatttactcaaatgggaactactgataagcagttcttatttttccagcataagcaaggctacaataaatatctttgaatatatgtactgatgctttttgttttttgttgaagctatatcccaataagtgataagtacggtctaagagagaacatgttttttacaattttgattgatatcatattgggccacgcatggtggctcaggcctggcatcccngcactttgggaggttgaggtgggaggatagcttgagctcaggagttcaagaccagcttgagcaacctngtgagacctcatctctactaaaaaaacaaaacaaacaaacacaaaattagctaggtgtggtggcatgtgccagtagtcccagctagttgggaggctgaggtggaaagattgcttgatcctgggaggttgaggctacagtgagctgtgatggtatcactgcactctatcctggacaacacagcaagaacctgcctcaaacaaatgtatttggttgatattgtatcagatttcttctgaaaaacgttttaatggtttagactttcaccaagtgcaagaaactggcattttctttgtaactggcctggaatgttaccactcttttaaacttttgtcaagatgatcgtgagaaatagtatctaattacttnaatttgcatttccctgactcctaatgaagttcagcatctcttcaaatctttattgggcatttggattttctcttcagtgaattgcttcatcatattctccatttattctaaagttgtgttcctatttgtcgctttcaaatctagtttggtggaatccttgcatgttagaaaccttaaccctcgtaatatgtgttgtagatatttttccctcgcctatgagttgtctttcatccttgagcatgagttttagagtcagaagaacaacagtaggatttgaatcatgttacgttattttctagttgtcgtattttttatttcttcagcctcttagaatcttagtttcctttaaaattgagataatagtatctactttattcaaaaaaattttttggctggacgcggtggctcacgcttgtnatcccaccattttgggaggccaaggcaggcggatcacctgaggtcaggagtttgagaccagcttgnccaacntggtgaaaacccatctctactaaaaatacaaaaattagccaggtacagcggggcatgcctgtantcccangtactcnggaggctgaggcaggagaatcacttgacccgggnggcagagangaggtagtganctgaatcgnaccactgcactccngcctgagtggtagggcgagactctgtctcaaaaaaaaaatgttttttcattatttntttntnganannnncttc

SEQ ID NO: 27517 - DNA, 2834 bp, Homo sapiens
  misc_feature (1682)..(1682): n is a, c, g, or t
  misc_feature (1750)..(1750): n is a, c, g, or t
  misc_feature (2117)..(2117): n is a, c, g, or t
  misc_feature (2534)..(2534): n is a, c, g, or t
  misc_feature (2600)..(2600): n is a, c, g, or t
  misc_feature (2606)..(2606): n is a, c, g, or t
  misc_feature (2670)..(2670): n is a, c, g, or t
  misc_feature (2676)..(2676): n is a, c, g, or t
  misc_feature (2683)..(2683): n is a, c, g, or t
  misc_feature (2717)..(2717): n is a, c, g, or t
  misc_feature (2726)..(2726): n is a, c, g, or t
  misc_feature (2737)..(2737): n is a, c, g, or t
  misc_feature (2746)..(2746): n is a, c, g, or t
  misc_feature (2760)..(2760): n is a, c, g, or t
  misc_feature (2816)..(2816): n is a, c, g, or t
  misc_feature (2820)..(2820): n is a, c, g, or t
  misc_feature (2822)..(2822): n is a, c, g, or t
  misc_feature (2825)..(2825): n is a, c, g, or t
  misc_feature (2827)..(2830): n is a, c, g, or t
gtgggagcagggcgagacgggccattttcactctgtggtcaaaggaaatgactggtctgactcggtctgggagcggggcacccagggtctaaggataactctggggccatgacagccatgagtctcacagaggaccccgagacttctgtgctgcgagtaaccggacttgttctgagacctttgccctagaggatggccaaggggctcctggtgacctatgccctctgggctgtggggggccctgctgggctccaccacctgtacctgggaagggacagccacgccctgctctggatgctgaccctggggggaggtgggctgggctggctctgggagttctggaagctcccaagctttgtagctcaggccaacagagcccagggacagaggcagagccccagaggggtgacaccccctctgagtcccattcgctttgctgcccaggtgatagttggcatctattttggccttgtggcactgattagcctttcttccatggtcaacttctatattgtggccctcccactggcagttggcttaggggtcttgctggtggctgctgttggcaaccagacctcagactttaagaacactctggggtcagcatttctcacttcacctatcttctatggccgccccatagccatactgcccattagcgtggccgccagcattacagctcagaggcatcgccgctacaaagctttggtggcatcagagccgctcagtgtgcggctctatcgtctgggcttggcttaccttgctttcacaggcccactggcatacagtgccctctgcaacacagctgccaccctcagctatgtggcagaaacctttggctccttcttgaattggttcagcttcttcccccttcttggccgcctcatggagtttgtcctccttctgccttaccggatctggaggctactgatgggggagactggcttcaacagcagctgctttcaggagtgggcgaagctctatgagtttgttcacagttttcaggatgagaagcgtcagctggcttaccaggttttgggcctctcagaaggggcaacaaatgaagaaatacatcggagttaccaggagctagtgaaggtctggcacccagaccacaacctggaccagacagaggaggcacagaggcacttcctggagatccaggctgcgtatgaagtcctgagtcaacccaggaagccctggggatcccggaggtgaaaagaaacttccccctgaggactgactcttcctagcagagctgggcaacttgtcccaaatctagctttgcccacgaatggcatcccaacagagttaaagaaactgcttgcaggggctgggcgtggtggctcatgctgccttggcctcccaaagtgccggaattacaggcatgagccaccacacctggccactgttctcaaattgtattatggagttttttttttttacaaaatatggatatattttaatttactcaaatgggaactactgataagcagttcttatttttccagcataagcaaggctacaataaatatctttgaatatatgtactgatgctttttgttttttgttgaagctatatcccaataagtgataagtacggtctaagagagaacatgttttttacaattttgattgatatcatattgggccacgcatggtggctcaggcctggcatcccngcactttgggaggttgaggtgggaggatagcttgagctcaggagttcaagaccagcttgagcaacctngtgagacctcatctctactaaaaaaacaaaacaaacaaacacaaaattagctaggtgtggtggcatgtgccagtagtcccagctagttgggaggctgaggtggaaagattgcttgatcctgggaggttgaggctacagtgagctgtgatggtatcactgcactctatcctggacaacacagcaagaacctgcctcaaacaaatgtatttggttgatattgtatcagatttcttctgaaaaacgttttaatggtttagactttcaccaagtgcaagaaactggcattttctttgtaactggcctggaatgttaccactcttttaaacttttgtcaagatgatcgtgagaaatagtatctaattacttnaatttgcatttccctgactcctaatgaagttcagcatctcttcaaatctttattgggcatttggattttctcttcagtgaattgcttcatcatattctccatttattctaaagttgtgttcctatttgtcgctttcaaatctagtttggtggaatccttgcatgttagaaaccttaaccctcgtaatatgtgttgtagatatttttccctcgcctatgagttgtctttcatccttgagcatgagttttagagtcagaagaacaacagtaggatttgaatcatgttacgttattttctagttgtcgtattttttatttcttcagcctcttagaatcttagtttcctttaaaattgagataatagtatctactttattcaaaaaaattttttggctggacgcggtggctcacgcttgtnatcccaccattttgggaggccaaggcaggcggatcacctgaggtcaggagtttgagaccagcttgnccaacntggtgaaaacccatctctactaaaaatacaaaaattagccaggtacagcggggcatgcctgtantcccangtactcnggaggctgaggcaggagaatcacttgacccgggnggcagagangaggtagtganctgaatcgnaccactgcactccngcctgagtggtagggcgagactctgtctcaaaaaaaaaatgttttttcattatttntttntnganannnncttc

SEQ ID NO: 27518 - DNA, 1305 bp, Homo sapiens
gcaggcgtgcgccgccacacctgatgggttttcgtacttttttggtggagacggggtttcgctgtgttggccgggctggtctccagctcctaaccgtgagtgatccgccagcctcggcctcccgaggtgccgggattgcagacggagtcttgttaactcagtgctcaatggtgcccaggctggagtgcagtggcgtgatctcggctacaacctccacttcccagccgcctgtcttggccccccaaagtgccgagattgcagcctctgcccggccgctaccccgtctgggaagtgaggagcgtctctgcctggccgcccatcgtctgggatgtgaggagcccctctgcctggctgcccagtctggaaagtgaggagtgtctctgcccggccgccatcccatctaggaagtgaggagcgtctctgcccggccgcccatcgtctgagatgggagcgcctctgccccgccgccccgtctgggagatcattaagcagcttcgagtctggaaaatttgttgaatgtactgagcaattagaattgttaccaggagaaaatatcaatctacttgctggaggatcaaaagaaaaaatagacatgaaaaacctgcttcgtaacatgttaagtccagatccaagggaacctcagaaatccattgaagttcaattgttaagaagttctgtttgtttggcaactgctttaaacccgatagaacaagatcagaagtggcagtctataactgaaaatgtggtaaagtacttgaagcaaacatcccgcatcgctgttggacctctgagactttctactttaacagtttcacagtctttgccagttctaagtaccttgcagctgtattgctcacctgctttggagaacacagtttctaacagactttaaacagaggactgtcttattccactcttcggtgaagctttacgttcatgtaaacagcatgatgtgaggccatggatgcaggcagtaaggtatactatgtaccagaatcagttgttggagaaaaattaaagttaagtggttttcctttttttttttgtaagagaaaattaaaggtgtttttttttttaaattttgctttattgaggtttatattacacattctaagtgtatggtttgatgagttctaacatgtcttcacttgtgtgaccaccaatacgattgagatacagaacaccgtcttaccccagaaggttcccttgggatcatctcctcatttggccctgtcagcagttactcatttgctttctgtcactatggattagacttgtctttactaaagtttcatgtacgtgaaa

SEQ ID NO: 27519 - DNA, 1146 bp, Homo sapiens
ccctctccctctctttccacggtctccctctccctctctttccacggtttccacggtctccctctccctctctttccacggtctccctctcatgccaagccgaagctggactgtgctgctgccatctcggctcactgcaacgtctctgcctggccgcccatcgtctgggatgtgaggagcccctctgcctggctgcccagtctggaaagtgaggagtgtctctgcccggccgccatcccatctaggaagtgaggagcgtctctgcccggccgcccatcgtctgagatgggagcgcctctgccccgccgccccgtctgggagatcattaagcagcttcgagtctggaaaatttgttgaatgtactgagcaattagaattgttaccaggagaaaatatcaatctacttgctggaggatcaaaagaaaaaatagacatgaaaaacctgcttcgtaacatgttaagtccagatccaagggaacctcagaaatccattgaagttcaattgttaagaagttctgtttgtttggcaactgctttaaacccgatagaacaagatcagaagtggcagtctataactgaaaatgtggtaaagtacttgaagcaaacatcccgcatcgctgttggacctctgagactttctactttaacagtttcacagtctttgccagttctaagtaccttgcagctgtattgctcacctgctttggagaacacagtttctaacagactttaaacagaggactgtcttattccactcttcggtgaagctttacgttcatgtaaacagcatgatgtgaggccatggatgcaggcagtaaggtatactatgtaccagaatcagttgttggagaaaaattaaagttaagtggttttcctttttttttttgtaagagaaaattaaaggtgtttttttttttaaattttgctttattgaggtttatattacacattctaagtgtatggtttgatgagttctaacatgtcttcacttgtgtgaccaccaatacgattgagatacagaacaccgtcttaccccagaaggttcccttgggatcatctcctcatttggccctgtcagcagttactcatttgctttctgtcactatggattagacttgtctttactaaagtttcatgtacgtgaaa

SEQ ID NO: 27520 - DNA, 423 bp, Homo sapiens
aaaagaaagaaacagtgccgaaaaatcacaatgatttgagttcttcaaaaacctttgattggctgcattggctctgttctgcatattactagacttcttacatgatcacaagtaaccactaattggttaaaaccaaagagagagagagagagagtgtgtgtgtgtgtgtgtgtgtttggttggggggtgttgtgttagcttccaggtgaatgcattatctgttaatcctgtttattgatctgtttttataagtgctccatgattctctgaaaacagtatactatgtatctaatttttggatacaggatggacatacgtactcaaactgtgtttttcaatttgtactgtatttgtttctctcgacctgacttagtgatagaggtatattaaagtcttccactagcatggtagattaacaaattc

SEQ ID NO: 27521 - DNA, 734 bp, Homo sapiens
taaagcaaaaagctagacaattgtttcatcattttttattaaatcacctgtcttttctccacagatacaaatgctatgtctaaattttatcacagtcttgggtctgttgttgggctgtcttttgctccattgatgtgtcttttggcaactgtggcatattgtttcactgtatctttatatgtcataatattgaggcagattctttgtaattcttgtttttagaattttcatagctattcattctcatgcttctcagtgtattctgaagtcattcatcattttctagaaaatttatgattggcattttgattggaatcccttggaattcatcagttagagttgactactgtaggctattaaaacgtcttcctataagaatgtagatatcagactggtgaaaatttaaggagctgaagtaattttaaattttaattgtaagattttcgtggaggtgatttttcaaaaaggtttagttactgatgttggttcctgtgttatttctggtagatgaatcaattatattaggtaaaagtattatcattggcatgattaaaaagatgttttagcttaaaacctaaatgatgggttgataggtacagcaagccaccacagcatgtgtatacaacctgcatgttctgcacatgtatgtaacaaacctgcatgttctgcacgtgtgtttaacaaacctgcatgttctgcacatgtatcccaggacttaaagtaaaaaaaaacaa

SEQ ID NO: 27522 - DNA, 579 bp, Homo sapiens
agcctcgctgaggaaattgactttgaatatccttttacactcttctgttttagaaagcattgtggtaaaacattgaatcatcatggtcataagttctgttcacattctttcttgctttgaatattttttcccagtggccaatatttgattctgttgtatcatggctaaaaggtaggcatggcaacaaaataaagacaggaagtctttggaataagtgatcccatcacaatgaatcaatttgccattggaacatatttttacaaagtcactcttttgaaaatatttagctatgaattaaaacagagtctgtatggttaatatttttcctggtctaaagtgaacagcattttagagaatgaactcaggacacaaccacagcacaagaaaaacgtgataattaagtttacacatatgtgttactactgcaacagaaaacatgtaaagaacatttgatttatgtatcagtctgcactgtttaattttttgtgtcataaatactcttatttaaaaaaacaggactagttaacagtgtcaattactagtaattcatggtataaataattaaacaaggaagtgttc

SEQ ID NO: 27523 - DNA, 945 bp, Homo sapiens
ttttccattttctccatgccctgacacagtgttggatatccactacctgtttaaaatatatgtgctgatttgagttggtcaggtgttgggggtgggatacgacagagaaaatggggtcccagctactgaggacgcaacacatgaacagggaaacgggacagatcctcttgggaaaaagccccactggggccaattccggggccttttcctccacagcccgcagagatgcctgtgcacttcccccaagaagctcctccaagttacgtgaccctgatgaaggtcttccttcaccatatgatttgttacaggaaaaataaggaaggaatttggaagcagttaaggtcactttgtgccgagactatcgcactatatcatgttaaataaaatgtcaggtgatagttattgagtcattcttttctaatggttttatgcacagtagataattttattatctacatatgatttggatttgaataaattatcagattgttaagaatttaataagaatatgtaaatacatttgtattccctatttaagtcaacctaagaatgaaatgatgagaataatggtattttgtgaggatggtgggggctttttggtagatgacctcctctgatctccgccacaatcctggaacacagatattacatccccttcttacaaatgagaaaactgaagctcagacaggttaatttgcctaaggtctcccatcccagaatacgggttcaaattttagaggtttttcaccttatgctacctatagatattcaaatcttaatttattcacatgaaatgatgggttaaatcgtttacaaaattatcaaccataagattctgttgacaaatacccatgaaatatttacttttaaaaatgtcctgtccatgcatatgaatttcagttttaaacatgaaaagtattttagcttttaggttgcaaaaaaaaa

SEQ ID NO: 27524 - DNA, 778 bp, Homo sapiens
gttctcctgcctcagcctcctgagtagctgggaccacaggcgcataccgccacgcccggctaatttttgtatttttagtagagatggggtttcgccatattggccaggctggtttcaaactactgacctcgtgatccgcctgcctcggcctcccaaagtgttgggattacaggcgtgagccaccgcgcctggccaagcccagtcttacaaatgaggaccctgaggttggtaggagggaggtgacctgtccacaccaggagttagcagaaacttgaacccatatttctttgctgctcatgggcagagttacactgctgctatgattcccaggagagaaactgaactttgctaaactactttggcaaactcaaaagcagatgggccagccatttgtggtctgaaagcactcggatgctagagaccctctgttacatggtgcctgtcagacagccctacaatttggatcctggggctggaaaaagataagaatgctgggagactttggttgtggcagactgcctctcagtgggtcccactgtgttggctgagtgccagcggtggactcctgatgcctgcatttgcagaactgatagctgcagggaggcagtgggttccagcggcacagcgttctcacatttctggccacttctagaggcagaggacggggtcagcaccatggacagcctcacggtcccgcctccctttcgtgtgtcagaacacgcgacccggactagtctggtctggggacggccctagtcattgctggctgttctaagcg

SEQ ID NO: 27525 - DNA, 444 bp, Homo sapiens
tggaaaagtgatcaacgcacagtgcggcttatggatccttcccacccactcaccacccacctgccagattatctgttggcaaatcccaggcctgatagcatttcctctgtcagtatttcagtgtatacctctaaacaataagggatttaagagaaaacataatcctggtaccattgttatacttgaaaaagttgcctgtgcgcagtggctcatgcccataatcccagcattgggaggccaagatagaaggatcacttgagcccaggaattcgagaccagcctgggtaacagtgagaatgtgtctctacaaaagaaaaaaaaaattagccaggcactgtggcacatgtctgtggtcccagctccttgggaggctgaggtaggaggatcacttgagtccaggaattcaagaccagcctgggcaacatagtgagactatgtctctac

SEQ ID NO: 27526 - DNA, 761 bp, Homo sapiens
tggtaaaccttcttttatataatattatttaaagtatcagaagagatactgtagcaaattaaaatcttggttccattggctgctctcttcagaaacacaggccttcagctcacgctggggtcggttggcagcagttgtatggatcgaaaagggcattgtgttcagggctgaatcctctgcacagtgccttccacatccataacccgcccccgaatggaactgtccaacgcttccagccaacacagctggactggtcgggggagagggctatttccctatgagggagccttcagggcacttgttttctgggctgctttaaggagatcaagaaccccacctgatacctgaaagagaaacattctgtcattcccttcaccctgtggggtttattctgagaaaaacaggggtcactaggcaaagtcataatcaggaaaaatggggagtcctgctgcccatgggtgatatcttacagcctctgtgagacacttttgtgaaaagggaaaaaaatgaaatagtcatttgtgcaacaaatgcttattgagaacctactgtatgccaggctttgaactaggtgttgagacaagcaagatggataggtttaaaattgttttgaaggttgtccacaataagaaatctgcttaatatcagccaagcgtggtggctcacacctgtaatcccagcgctttgggaggccgaggcaggcggatcacttgaagtcaggagtttgagaccagccaacaaggtgaaaccccgtgtctact

SEQ ID NO: 27527 - DNA, 269 bp, Homo sapiens
ggaaaacgggttaataaaacagctttatagcagtttataaatacgttaacatattttacattttatccatatgccacaggttaagaccaagtgcttaaatcaaaagcttatttgaattattttaggaaaaataatctcagaaaagaaagttagagtgagggaagattagtgaaatagttgtatttggtagtagctttctattaatatattttagataaactggagacaagccttaaaaactgaaccacaattatgagacctgaatacat

SEQ ID NO: 27528 - DNA, 850 bp, Homo sapiens
cccaagtgctgcagccaaaaacacaggcttcgtccccaccggctcccagctagagagctttcttcttgggagagcaggacttccacttctcattctgccccagctgcctgttgctgagtttacgtctgcagcaagtaatgccaagaggtgggggctgccttcttgcatccagctctgactagtgaaactgaagctctcccttgggtgtggcatgctgatagtgctgaggggggccctgaccaccctcaccttgccacttctattcaaggtgatattggaggttcttgggagagcaattaggtaagaaaaataaatacaggtcacctagatgggaaaggaataagtcatactatctcaatttgcaaatgacatggtcatatgtatatataaaatactaaggaaccctctaaaaaaaaactattagaactaataaactagttcagcagggttgcaagatacaagatcaacatataaaaatcaattgtatttctacacactatcaatgaacaatctgaaaattaagaaaacgattctattgacaaaagcaccaaaaagaataaaatacttcagaatatatttaacagaggaaatgtaaaacttatactctgaaaactataaataattcttgaaagaaacttaaaagatcaaaataaatggaaaagtaaccatgttcacagcttagaggttttaacactgttaagatggaaatacctgcagagtgatctacagattgaaagcaattactttcaaaatcccagctgacttccttgtaaaaactgacaagctgaccttaaaattcaaatgacatacaagggacctagaatgatcaaaacaaacttgaaaaagaaaa

SEQ ID NO: 27529 - DNA, 2802 bp, Homo sapiens
tgattgaggtgcagagcaaagtgaagggctgcccaggtgaggccaggctgactgaaaaagatggatactactatgctgaatatgcggaatctgtttgagcagcttgtgcgcggggcggagattctcaaggaaggaaacgaactccaatttatccagttggtgaaggactttgaggatttctttaaaaagtgggagaggactgactatgagctggggaaatacaaggatcttttgataaaagcagagactgagcgaagtgctctggatgttaagctgaagcatgcacataatcaggtggatgcagacatccaacggagacggagagctgaggctaactgcgaaaagctggagcaacagattcagctgattggagagatgttcctgtgtgacatatctggcagcattcaactaagcggggagcaaaaatcagctttggcttttctcaacagaggccaaccatccagcagcaatgctgggaacaaaagactttcaattagcgatgaatctggttccattttatcaggtatcagctttgacaagactgatgaatcactggattgcgactcttctttggtgaagactttcaagcggaagcagagagaaaagaggtgctctagtagccgacagtttgttgatggtccctctggacctgtaaaggaaactcgttccattggctccacagtagaccaggggaatgaatccatagttgcaaaaactacagtgactgttcccaaggatggcgggcccatcaaagctgtgcccactattgagactgtgccatactggaccaggagccaaaggaaaacaggtactttacaaccttggaacagtgaccccaccctgaacagcaggcagctggagccaagaactgagacagacaatgtgggcacgccacagagtaacagagggatgtgcctgaatgactttgtctctaagacggttattaaacctgaattctatgttccatgtggaaagcagataaaatttgggaaactatctctgaagtgtcaggactgttgtgtgatctctcgtccagaatgtcgggaccactgtccccttccctgcattcctaccctgataggaacacctgtcaagattggagagggaatgctggccgactttgtgtcccagacttttccaatgatcccccgcattgttgtgcattgtgtaaatgagattgagcagagaggtcttactgagacaggcctgtataggatcttgggctgtgacagcacagtaaaactgaaagagaaattcctcagagtgaaaactgtacccctcgtcagcaaagtggatgatatccatgctatctgtagccttcttaaagactttcttcgaaacttcaaagaacctcttctgacctttcgcctaaacaaagcctttatggaagcagcagaaatcacagatgaagacaacagcatatctgccatgtaccaggctgttggtgaactgccccaggccaacagggacacattggttttcctcatgattcacttgcagagagtggctcagagtccatatactaaaatgaatgttgccaatctggctgaagtctttggctctacaatagtggcccatgctgtgcccaatccagaaccagtgacgatgttacaggacatcaagtgtcaacccaaggtggtcgagcgcctgccttccttgcccctggagtactggagtcagttctcaatagtggagcagaagaacattgaccccctacatgtcactgaaaactcaaatgccttttcaacaccagatattaaagtgagtttactgggacctgtgaccactcctgatcatcagcttctcaagactccttcatctagttccctgtcacagggagtctgttccaccctcacaaagaacactcccagatttgggagcaaaggcaagtctgccactaacctaggaaggcaaggcaacctttttgcttcttcaatgctcaagtgaagtcacatctacctattactcccagcattgattgactataagaaaggatgcacctgtactctctgctctacagcctcctcttctcattactatttttagcattctccaggcttttactcaagtttaattttgcatgagggttttactaaaattttatatatctccccttccttctcctcgagtcacataatatcagtaccttgttctggtcactgttgggagcttttagatgagacatctttccaggagtagaagggttagtatggaattgattgtgattcttttgggggaagggggttactatccctttggcttaaagccaaatgctgctcatggaatgaacgatctttctctagtttcattcaactgatttccatgagacaatgacagaaaccctacctatctgataagattggcttgtctcagggtgggaagtgggagggtggggcgaagaaaggattacaccagaagatttaggatgcctccttctaagaactggaagttctcattccccattatgaactgagctataatatggagctttcataaaaatgggatgcattgaggacagaactagtgatgggagtatgtgtagctttgatttggatgattaggtctttaatagtgttgagtggcacaaccttgtaaatgtgaaagtacaacgcatatttatctctgatgtgccattggctgaaccttgggttaatttggggtcaaagtcagtttttcttttaaaattgaattcattctgatgcttgacccccatactcccaaccttgtccagtggagcccaacttccaaaggtcaatatgtcgtcctttggcatcccaactaacaataaagaataggctataa

SEQ ID NO: 27530 - DNA, 330 bp, Homo sapiens
ttcaagatgaggaatgagttgtttctggattgatgccttcactggctagaaatgccagcgggtggtgggaagagtacatggcaggatgatgaggagtttcgcattcattcattcatttattcatctgtgtattcattttacaaaaattcatatcagatttgcaaaattcactcacaatacactcagagataataaaaaatgtaacaactttttttattaactggtggaatatttctctcaaatttccaccactggaccccagagtgggaattcaattttagcccaatcttgtaaacttagttccaatgtaattatctaggttgagctaaa

SEQ ID NO: 27531 - DNA, 472 bp, Homo sapiens
gggaactccagtcagagtcaggcagtgtctgtgagcacaagttaggaagtttctcggcatccgggagcgttcccgtctgatgtcccagtgttagtcctcccggccgccctcccctcctctcctccagggacggctgggaaaacagtcctgcgggatgaagacttcaccgcctccgatttgaatttgaaagtaactccttccgtggcatatttcgctgggcagatagaacaaaccatgtcgttttcccccgtctctaaaatagacatattattatcattcacacttttgcacccggtcgttttgcgggagttcgggaaactgactttcttcattggggacattgtaattttctgatgatgccacgaggagaaaaaaaatacgggtttgttttaattggaaggaccttccgcttttatgatttcggtttaccttggaaaactgaatcttctgtgttttatttctttcctctagt

SEQ ID NO: 27532 - DNA, 427 bp, Homo sapiens
gcatgccacctgggctccagccccgaggtctcctctggttcctctctgttaattcctgctcatctttcagggagatgttcaggcgtgggctcctcagggaagcctgccactgcacacacttcccatagctttctgtatgcttccttcatagctctgaccagggttgtcatggtatacactggggatgtgtggactcgagtggccgatgtctctgcccacagttgggtaagcttcaagaggccaggcctgtgtcagtttcccttactgtattcccagcagccaactccttgactggcatgcagctgctcagttagtatttactgaaggagagaagggagggaagaagaaaaagagaatttgatgctcctcttgctgtatctaccttcatgtctccatcgtagtcttctctcttagagaaaaaaaaaaa

SEQ ID NO: 27533 - DNA, 390 bp, Homo sapiens
cacagagaggttaaataatgtgcccaaaatcacacagctttaaagtgaaggagccctatctggctccagaactcactctcttaatcacgattctatattgcatccctgtatctgtattttgctcctttttctactatactagtccagtcaagaatggaatggaagctgggagactttagtggctactaacactgaagtgatataggattagactaaagtggtagtaatggagacagggaattggagagatctggtaatatgccttcaagacagagctagtaagacttaatggatcagagattggatgtgaggtatgagggaaagagaggaatgatggcaaccaggttttttggcctacccatagcctggtatttaagactctgtttctca

SEQ ID NO: 27534 - DNA, 343 bp, Homo sapiens
aaaataactaagaacagtaatttgtgtatatataaacatttaccattcagaaggagtgtgtaagtctattgtctcttatctttacagcagtttagtaaaaggtggaaagaagtggtgaccactttctcagataaagaaagtaaagattagaaaggttaagcaaactgcctgcccttatatagcttagagtcagcctaaagatttgaccgaactctgttctttgagttggacttcatccctagcctttggaaggctggatagtcttcaaggcttttagcatttctggacatgtttatgatcaatggtaataccaaccaccagataaaatcaaatctaatcagta

SEQ ID NO: 27535 - DNA, 834 bp, Homo sapiens
  misc_feature (1)..(1): n is a, c, g, or t
  misc_feature (11)..(11): n is a, c, g, or t
  misc_feature (13)..(13): n is a, c, g, or t
  misc_feature (15)..(15): n is a, c, g, or t
ntttcggcacngngnaaatctaagaagctcatacataagaaacacacaaaacataagaaacacacacaaaaacccgacaccatgcctggcctaggcgggctcattttcgctgggagtgtctgctttctggtcattatcggtgcctgctgttcctgaatcactgctgcctggagacatcttcctgttctatctggaaaacttcctggtcctacagcctgtgaatggctgatcagggctcatgagccaagtagaactctgggacccaatccaattaaacaatggtggaggtcactgtgcaccgtgtgccccacaaactctgctccacgccctgtggcagccttctcctctggcctcagcccaccctgcaccacactccccaaggcccatccgccttccccttatcagggaaacatgaccgtgattttgggcttcttgcctccagaactgagggaatacacttctgttactttataccaccttcgttcatgtcctgtgtcagtgcagccccgtaacatgagcccagctggagaaaggaccactcgctagggttagagggaacaatccccagagctcacacaaggctgggaatagggcgtctagccatcagtcagaggcaaacacctcctcattcgtggggcgtggcatagagcacccagaaggacttttcctcaccaccgaggaatgctctgctttcctacctaacaaagcaaggtccccaaggatgaaactgttaagtgacgtgatagtgtcccacagcaaagctcaagaatgtttggaatacagaaacatccaacacccagaaacgtaacagtcacaatgtatggcattcaatta

SEQ ID NO: 27536 - DNA, 430 bp, Homo sapiens
ctgatggtagtggaggagccgagtatcttgattgtatcaatgtcaatatcctggttgtgctattgaactaaattttgcatgtctatgtactgatatggaactgagttcaaatatgcatgttaatgataaaacaaaaggtgcaaaaccatgtaaatatattgttaccatttgtgttaaggggagagagcgagttttatattcatttgccttcatttgtaaagtttctttttgttttatcttatgtgtaatattcaaaagctcccaaataataaaatataaattgggtaaatctgggttgtttggggggtagtaaatcaagccaaattaaaaatggggtgcaaaggagacattttgttccacgtcttttgtagtgtttgattcttgtaccaatgtaaattttaaggcaaaaacctaaaataatacaaattca

SEQ ID NO: 27537 - DNA, 374 bp, Homo sapiens
ttcactgttctatccccaggacttagaagaataaccgaaatacagcaggcactcaataaatatgactgggtagggtgcatagttcacacccataatcccagtgctttgagaggctgaggcaggagattgcttgagcccaggagtttgaggctgtggtgagctatgctaaccccactgcactccagcctgggcaacagagtccctgtctccaataaaggaaaacaaataaataaataaataaataataaacatgtctgtactttgtgatctcaccagagagtctgcagagatgagcaaaactcatatcctcaccagctgtgacaaacactgcagtgacctcctcaaaaacacactgtcctcttccttatccacct

SEQ ID NO: 27538 - DNA, 3091 bp, Homo sapiens
  misc_feature (1474)..(1474): n is a, c, g, or t
cttcatggacacccacacagattcactggagagcaaagcctaccagagtccctgtcagcagcactgtttctagaagcttccacatgagcagacagcatggagtcctgggggctaatgaagcagcaatgtcagcatgagcacaggcagggagaggcaagaggagcagagtaaaggggaacgttctcttcattcttccacctgcctgtcccccagccgacacgtcccttccgttccctgcaaggccatttccagggaggcttacgaagacagcagatgatggtgatggaaggagtctgggtgctgagctgtgccatggacctggagagaaactgagtccgagggatgtcaacatgccaagtccatggaaatatcagtgggctggaattctagctgcctgaaagaagacattcctcacacaagacctcacaatcatatccatggaattatagcactgggctctccagatggtgctacaggaagacctccagaaatttgacgatcctctattcaaggccctaccacagagacacacaggaacggaactcagaatcacaaacaaagaaactttgatccaagaaagaaaatgatctttaaaaagaccctcgtttcatgctggccgatgctgagaaaatctgctctgaaggatatttggagacactgattaaaaggtagtaccatcaccacatatttaacttccccctctttttcctctgcttctaggagtagagaaaccaacaaaaccaaccggagagagatggtttcaaacaatctgtcccccaccccaccactattcacacctttcacaagggcccagccacaaagccagtgcaacatgacatcaatcatcagcaaagtggagatggttgtcccagtggagggggattcttcgtgttacgtagataggaagcacgatgcaaaagtgttgaagcaggagtgtaaagaataattaaaacacctgcccaagacccaagcaaggataggatttcccagacattcgcgagggagaaaatgccatgtcctttccttctggtgtcacatcagaatctgaaggctgctagagaagggagagaaacatgaaagtgagtcccatgctgattgttgttgaaatacctggaaagaaactggcaaagactatccaagggatgctaagacatgtccgaacttacaaaacagtagaacctgaataggaatttgaagttgtctatactctcctcagccacaccctgccattttacagattgtcttctctggggaagttagctgtcatgttgtgaggatactcaagcagtttataaagaggttcatgtcgcaaggaatggaggcctcctgccaacagccatgtaaaggagccatctaggaaatagattctccagccccagtcagaccttcagatgattacagcccctaccaaccttctgactgcggtggaaggaaggttccggaaccagaaccacccaggttaatgtgggtaagnctcatccaatcctttgaaggcctgaagaacaaagagtgaggtttctggaagaagaaaattttacctcaagcctgcaatgtagaaattctgcttgagtttcccgcctgctggcctgccctgtggaattcggagtcaagaaggagtcttgtaagcattaactgagatagtatatgaagagtgcttttgcaccgagtgaaccttcaatcaactgtactagtttgtatgcctggaagagctgctatatgggatcagaaagaaaaataaggtgcatacgccagaaaaaaaatacttgcatatgagtactaggagatgcatgacaatgttcacggcagcagtattcatggcagtgaaaaatgaaaagaactgaaatgcccattgataaaaacgtctacttatttgtgtcatctttgcacagtggaattgtgcgagtggaaatgattgatctacagctaggagaagcagcagagctcaatctcaaaaacataacgttgtgtggaaaaagctaacctcagaacactttgcggctctatcttagcaaaccaggagagaaattctcctgatggccttgaagaagcaaacagccacctggttaagcccctgtggatagtgccaagtggcaggaaagtgggagccacctctaggacctgaggattaaagtcagtaagagctgggacctcactcatgcagactcgaggacatgaattcgaccaacaacttgaatgagcttggaagtggattcttccctagtccagtcttcagaaattaagaatgttcccaaagaatgatggagacatttcaaaaggatacggaagccagattgtgggcgcttctactggccaactctgggacatcgtggacatcaaaataaatttgtaataataaaggattatagcctattagttaaatcagaaaaatctgatttaactaaatgagtaggaggaaaagaaagctcttccttatattagaaagtcaattaataaatgcagaaaggaatgaaaaaattagaaaagccaccatttggcaaccatggcaggcagaatggggagtatgcctccagacagtaattcctttcaaactggtttataggaactcactgagcttgctgatcgacctctgagaggcaaagtttctgaattatgaagtactgattatataaacttagacagagacatgcttcattatttaataggactgtgtcaaaagcctactattaggatgatgtgttgggtgtggaacagggtctcttcctgccaggaacactggtgaattttcactccgtgttcaggctgatctttgaagttgaagacaagcagaagaatccttctaaaatttagccatgcccataggctgggagggacactgctccattcagaggcagcaaagcacattactgtatctcctatagagctttgagcagtccagtgtacatggagaaacttagtaaatgttgttgaattaatgaatgaacaaatcaatggaccaagtcaggggtaagtcttacatttgtcatctaggtgattaagaaaggaaaaagtatctgtttcaagaggattacaatctaactgtactccaatagtaaaatttactcttttggaatctgaagacattcatgagtct

SEQ ID NO: 27539 - DNA, 1047 bp, Homo sapiens
taaggatactgaggacctttggaggtcctcatccaaaggtcttgctgtattcctcattggaagatgtaagtgagacagagaaaggacagaggcagggagccatgacaaggcaacttcagggccaagaagaaactgtcatgaaaagagtgataggatggagaatattggaggatgagctacagttcccaaaaattaagaatgttcccaaagaatgatggagacatttcaaaaggatacggaagccagattgtgggcgcttctactggccaactctgggacatcgtggacatcaaaataaatttgtaataataaaggattatagcctattagttaaatcagaaaaatctgatttaactaaatgagtaggaggaaaagaaagctcttccttatattagaaagtcaattaataaatgcagaaaggaatgaaaaaattagaaaagccaccatttggcaaccatggcaggcagaatggggagtatgcctccagacagtaattcctttcaaactggtttataggaactcactgagcttgctgatcgacctctgagaggcaaagtttctgaattatgaagtactgattatataaacttagacagagacatgcttcattatttaataggactgtgtcaaaagcctactattaggatgatgtgttgggtgtggaacagggtctcttcctgccaggaacactggtgaattttcactccgtgttcaggctgatctttgaagttgaagacaagcagaagaatccttctaaaatttagccatgcccataggctgggagggacactgctccattcagaggcagcaaagcacattactgtatctcctatagagctttgagcagtccagtgtacatggagaaacttagtaaatgttgttgaattaatgaatgaacaaatcaatggaccaagtcaggggtaagtcttacatttgtcatctaggtgattaagaaaggaaaaagtatctgtttcaagaggattacaatctaactgtactccaatagtaaaatttactcttttggaatctgaagacattcatgagtct

SEQ ID NO: 27540 - DNA, 2677 bp, Homo sapiens
  misc_feature (1060)..(1060): n is a, c, g, or t
tgtctgtactctggattgttttgagcgtgtctttgcagggcttgcttgtgcctgccaagttcagctgcctgcagaagcacagctcagagccgtccctataggcctagtccttgcacaggtctggccaatcagagctctgttaccaggcagagcctctctctccagctctggtcactgtcagcctagctgtccaggcacccttctgcaattttcgtttgaattgatttttttaaaagcacctgatatacacttttcttcttattcttctccttctagtcctctattcaaggccctaccacagagacacacaggaacggaactcagaatcacaaacaaagaaactttgatccaagaaagaaaatgatctttaaaaagaccctcgtttcatgctggccgatgctgagaaaatctgctctgaaggatatttggagacactgattaaaagatggttgtcccagtggagggggattcttcgtgttacgtagataggaagcacgatgcaaaagtgttgaagcaggagtgtaaagaataattaaaacacctgcccaagacccaagcaaggataggatttcccagacattcgcgagggagaaaatgccatgtcctttccttctggtgtcacatcagaatctgaaggctgctagagaagggagagaaacatgaaagtgagtcccatgctgattgttgttgaaatacctggaaagaaactggcaaagactatccaagggatgctaagacatgtccgaacttacaaaacagtagaacctgaataggaatttgaagttgtctatactctcctcagccacaccctgccattttacagattgtcttctctggggaagttagctgtcatgttgtgaggatactcaagcagtttataaagaggttcatgtcgcaaggaatggaggcctcctgccaacagccatgtaaaggagccatctaggaaatagattctccagccccagtcagaccttcagatgattacagcccctaccaaccttctgactgcggtggaaggaaggttccggaaccagaaccacccaggttaatgtgggtaagnctcatccaatcctttgaaggcctgaagaacaaagagtgaggtttctggaagaagaaaattttacctcaagcctgcaatgtagaaattctgcttgagtttcccgcctgctggcctgccctgtggaattcggagtcaagaaggagtcttgtaagcattaactgagatagtatatgaagagtgcttttgcaccgagtgaaccttcaatcaactgtactagtttgtatgcctggaagagctgctatatgggatcagaaagaaaaataaggtgcatacgccagaaaaaaaatacttgcatatgagtactaggagatgcatgacaatgttcacggcagcagtattcatggcagtgaaaaatgaaaagaactgaaatgcccattgataaaaacgtctacttatttgtgtcatctttgcacagtggaattgtgcgagtggaaatgattgatctacagctaggagaagcagcagagctcaatctcaaaaacataacgttgtgtggaaaaagctaacctcagaacactttgcggctctatcttagcaaaccaggagagaaattctcctgatggccttgaagaagcaaacagccacctggttaagcccctgtggatagtgccaagtggcaggaaagtgggagccacctctaggacctgaggattaaagtcagtaagagctgggacctcactcatgcagactcgaggacatgaattcgaccaacaacttgaatgagcttggaagtggattcttccctagtccagtcttcagaaattaagaatgttcccaaagaatgatggagacatttcaaaaggatacggaagccagattgtgggcgcttctactggccaactctgggacatcgtggacatcaaaataaatttgtaataataaaggattatagcctattagttaaatcagaaaaatctgatttaactaaatgagtaggaggaaaagaaagctcttccttatattagaaagtcaattaataaatgcagaaaggaatgaaaaaattagaaaagccaccatttggcaaccatggcaggcagaatggggagtatgcctccagacagtaattcctttcaaactggtttataggaactcactgagcttgctgatcgacctctgagaggcaaagtttctgaattatgaagtactgattatataaacttagacagagacatgcttcattatttaataggactgtgtcaaaagcctactattaggatgatgtgttgggtgtggaacagggtctcttcctgccaggaacactggtgaattttcactccgtgttcaggctgatctttgaagttgaagacaagcagaagaatccttctaaaatttagccatgcccataggctgggagggacactgctccattcagaggcagcaaagcacattactgtatctcctatagagctttgagcagtccagtgtacatggagaaacttagtaaatgttgttgaattaatgaatgaacaaatcaatggaccaagtcaggggtaagtcttacatttgtcatctaggtgattaagaaaggaaaaagtatctgtttcaagaggattacaatctaactgtactccaatagtaaaatttactcttttggaatctgaagacattcatgagtct

SEQ ID NO: 27541 - DNA, 437 bp, Homo sapiens
tgaagaagtctggttgaggagaaaataggttaaaggaactcataagttgctgataagagtttgctttggaaaacaatttgtcattccttgtaaagttgaatatttgcataccctaagactcagtgattttacttttaggtgcatacgccagaaaaaaaatacttgcatatgagtactaggagatgcatgacaatgttcacggcagcagtattcatggcagtgaaaaatgaaaagaactgaaatgcccattgataaaaacgtctacttatttgtgtcatctttgcacagtggaattgtgcgagtggaaatgattgatctacagctaggagaagcagcagagctcaatctcaaaaacataacgttgtgtggaaaaagctaacctcagaacactttgcggtatgtgatgccattattatagttcagaagttagcaatagc

SEQ ID NO: 27542 - DNA, 989 bp, Homo sapiens
  misc_feature (883)..(884): n is a, c, g, or t
  misc_feature (891)..(891): n is a, c, g, or t
  misc_feature (893)..(893): n is a, c, g, or t
  misc_feature (896)..(896): n is a, c, g, or t
  misc_feature (901)..(901): n is a, c, g, or t
  misc_feature (908)..(908): n is a, c, g, or t
  misc_feature (915)..(915): n is a, c, g, or t
caggcgccggcgtaattaaatataactgagtttacgcagacgcagaaaacgcaggcaaacctgaggtcctcagaatggcgggcacaggtttggtggctggagaggttgtggtggatgcgctgccgtattttgatcaaggttatgaagcccctggtgtgcgggaagcggctgcagcgctggtggaggaggaaactcgcagataccgacctactaagaactacctgagctacctgacagccccggattattctgcctttgaaactgacataatgagaaatgaatttgaaagactggctgctcgacaaccaattgaattgctcagtatgaaacgatatgagcttccagccccctcctctggtcaaaaaaatgacattactgcatggcaagaatgtgtaaacaattctatggcccagttagagcatcaagcagttagaattgagaatctggaactaatgtcacagcatggatgtaatgcctggaaagtatacaatgaaaatctagttcatatgattgaacacgcacagaaggaacttcagaagttaagaaaacatattcaagatttaaactggcagagaaagaacatgcaactcacagctggatctaaattgagagaaatggagtcaaattgggtatccctggtcagtaagaattatgagattgaacggactattgttcagctagaaaatgaaatctatcaaattaagcagcaacatggagaggcaaacaaagaaaacatccggcaagacttctgaaaagacaatttagcaggtagaagaaaagttgggctttcacagtgggttcccaaaggcttgactttatgactgtgaggacacagatttccaaaccatgtgttagtgtttgaatctgagggtgcgcgggatcnntggtttncngantaagntcggggntttaccnaaaaattggtaaaggggttcacatggggtaatggggatttggagggtaaccacaggggatggggagaaaaaatg

SEQ ID NO: 27543 - DNA, 889 bp, Homo sapiens
caggcgccggcgtaattaaatataactgagtttacgcagacgcagaaaacgcaggcaaacctgaggtcctcagaatggcgggcacaggtttggtggctggagaggttgtggtggatgcgctgccgtattttgatcaaggttatgaagcccctggtgtgcgggaagcggctgcagcgctggtggaggaggaaactcgcagataccgacctactaagaactacctgagctacctgacagccccggattattctgcctttgaaactgacataatgagaaatgaatttgaaagactggctgctcgacaaccaattgaattgctcagtatgaaacgatatgagcttccagccccctcctctggtcaaaaaaatgacattactgcatggcaagaatgtgtaaacaattctatggcccagttagagcatcaagcagttagaattgagaatctggaactaatgtcacagcatggatgtaatgcctggaaagtatacaatgaatcccagacttggaacttgaacttcatcctctggttatttctgtatgagagctaaaacaagaaggcaaagcacctccttgttcatcctcagctgaaaatgtgcatgctcagctgctcagatttttcaccactgtgcacatgtccatgaatgactgcaaaacactacaagtagtaattttgggattacaaataaatttgagcaagtatttgttgtcaaaacaagccactgacatcctgtttctgttccatgtaactagctctagctttagtatttattgtctatctagaattcagattccttgcttgcaaaattccgtggttagattatctgcatggcccctttgtgccctaaaatttcctgagtgtctattcacaatttaagagaaaaaggccact

SEQ ID NO: 27544 - DNA, 742 bp, Homo sapiens
caggcgccggcgtaattaaatataactgagtttacgcagacgcagaaaacgcaggcaaacctgaggtcctcagaatggcgggcacaggtttggtggctggagaggttgtggtggatgcgctgccgtattttgatcaaggttatgaagcccctggtgtgcgggaagcggtgagtgcggggtgtctttgtagctgactcactgctagctggctcggtactgaaagaaacatgttacaatttgccacttctaccctggtccctattctctttcttaggctgcagcgctggtggaggaggaaactcgcagataccgacctactaagaactacctgagctacctgacagccccggattattctgcctttgaagtaagtatgtcttgagcctaggtgtgaacgagaattcctgtgaacctttattttggattgagagctttaaattccagttttaaccattgcctgcatagctactacttacctactgtataggtgtcagtctattgaaaacaactagatagataagtcttctccgaggttcttattctaagatccataggaagactttctggggctccacaactcacttaatgcaaaaatttgtggctaccattctttgagataggatccatgcgtaaattctcaaagggaccctctcctgccaagattcactctacagcaagtgatctagggttttcaatatgtataagcctaattacctaagctctttagaaccactggagagtg

SEQ ID NO: 27545 - DNA, 635 bp, Homo sapiens
caggcgccggcgtaattaaatataactgagtttacgcagacgcagaaaacgcaggcaaacctgaggtcctcagaatggcgggcacaggtttggtggctggagaggttgtggtggatgcgctgccgtattttgatcaaggttatgaagcccctggtgtgcgggaagcggctgcagcgctggtggaggaggaaactcgcagataccgacctactaagaactacctgagctacctgacagccccggattattctgcctttgaagtaagtatgtcttgagcctaggtgtgaacgagaattcctgtgaacctttattttggattgagagctttaaattccagttttaaccattgcctgcatagctactacttacctactgtataggtgtcagtctattgaaaacaactagatagataagtcttctccgaggttcttattctaagatccataggaagactttctggggctccacaactcacttaatgcaaaaatttgtggctaccattctttgagataggatccatgcgtaaattctcaaagggaccctctcctgccaagattcactctacagcaagtgatctagggttttcaatatgtataagcctaattacctaagctctttagaaccactggagagtg

SEQ ID NO: 27546 - DNA, 1143 bp, Homo sapiens
caggcgccggcgtaattaaatataactgagtttacgcagacgcagaaaacgcaggcaaacctgaggtcctcagaatggcgggcacaggtttggtggctggagaggttgtggtggatgcgctgccgtattttgatcaaggttatgaagcccctggtgtgcgggaagcggctgcagcgctggtggaggaggaaactcgcagataccgacctactaagaactacctgagctacctgacagccccggattattctgcctttgaaactgacataatgagaaatgaatttgaaagactggctgctcgacaaccaattgaattgctcagtatgaaacgatatgagcttccagccccctcctctggtcaaaaaaatgacattactgcatggcaagaatgtgtaaacaattctatggcccagttagagcatcaagcagttagaattgagaatctggaactaatgtcacagcatggatgtaatgcctggaaagtatacaatgaaaatctagttcatatgattgaacacgcacagaaggaacttcagaagttaagaaaacatattcaagatttaaactggcagagaaagaacatgcaactcacagctggatctaaattgagagaaatggagtcaaattgggtatccctggtcagtaagaattatgagattgaacggactattgttcagctagaaaatgaaatctatcaaattaagcagcaacatggagaggcaaacaaagaaaacatccggcaagacttctgaaaagacaatttagcaggtagaagaaaagttgggctttcacaaaaggcatctgaacttttaatgaactgtgaaggacaacagcatcttcccaaaaccattgatgtttaagtgtttagaaatcatagaaggtgtaggctgctgtggtaattctatttgtatatctcaacagaattaaaatgtctagcttggtggtatttttatagccataaaagaaaatctttaggctttcaaaataaggatgactttagaataatattgtgtcatagaattaattttcagccatgtggaccatattttgtatccaaggatccttatttaaagctttcaacatgtacaggaagttggaaatttttggtttatgactttgtctaataaagagatagttctaaac

SEQ ID NO: 27547 - DNA, 1803 bp, Homo sapiens
gcttgaattgggaggggggcagctggagcctcaggcggcagcgcttctagaaatgctgagccgattatcaggattagcaaatgttgttttgcatgaattatcaggagatgatgacactgatcagaatatgagggctcccctagaccctgaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaagcatgacaagagttctacagaggaagagatggaaatagaaaagataaaacataagctccaggagaaggaggaactaatcagcactttgcaagcccagcttactcgggcacaggtttggtggctggagaggttgtggtggatgcgctgccgtattttgatcaaggttatgaagcccctggtgtgcgggaagcggctgcagcgctggtggaggaggaaactcgcagataccgacctactaagaactacctgagctacctgacagccccggattattctgcctttgaaactgacataatgagaaatgaatttgaaagactggctgctcgacaaccaattgaattgctcagtatgaaacgatatgagcttccagccccctcctctggtcaaaaaaatgacattactgcatggcaagaatgtgtaaacaattctatggcccagttagagcatcaagcagttagaattgagaatctggaactaatgtcacagcatggatgtaatgcctggaaagtatacaatgaaaatctagttcatatgattgaacacgcacagaaggaacttcagaagttaagaaaacatattcaagatttaaactggcagagaaagaacatgcaactcacagctggatctaaattgagagaaatggagtcaaattgggtatccctggtcagtaagaattatgagattgaacggactattgttcagctagaaaatgaaatctatcaaattaagcagcaacatggagaggcaaacaaagaaaacatccggcaagacttctgaaaagacaatttagcaggtagaagaaaagttgggctttcacaaaaggcatctgaacttttaatgaactgtgaaggacaacagcatcttcccaaaaccattgatgtttaagtgtttagaaatcatagaaggtgtaggctgctgtggtaattctatttgtatatctcaacagaattaaaatgtctagcttggtggtatttttatagccataaaagaaaatctttaggctttcaaaataaggatgactttagaataatattgtgtcatagaattaattttcagccatgtggaccatattttgtatccaaggatccttatttaaagctttcaacatgtacaggaagttggaaatttttggtttatgactttgtctaataaagagatagttctaaacacattcttgatcaccaaacaacttcagaaagacagtgactgtacagttatcattatcatcatcatcgtcatcatcataggtaacagttatatcaagcttaatatgtgctgaacattgttctgaacactttaggtagatgaactagatgtatgtgaataaaaattatttggtcctcacaaaaa

SEQ ID NO: 27548 - DNA, 1053 bp, Homo sapiens
ggtggcgttcagaggtcccctgacaggcgcgacaccaatggaatgctcagtatgaaacgatatgagcttccagccccctcctctggtcaaaaaaatgacattactgcatggcaagaatgtgtaaacaattctatggcccagttagagcatcaagcagttagaattgagaatctggaactaatgtcacagcatggatgtaatgcctggaaagtatacaatgaaaatctagttcatatgattgaacacgcacagaaggaacttcagaagttaagaaaacatattcaagatttaaactggcagagaaagaacatgcaactcacagctggatctaaattgagagaaatggagtcaaattgggtatccctggtcagtaagaattatgagattgaacggactattgttcagctagaaaatgaaatctatcaaattaagcagcaacatggagaggcaaacaaagaaaacatccggcaagacttctgaaaagacaatttagcaggtagaagaaaagttgggctttcacaaaaggcatctgaacttttaatgaactgtgaaggacaacagcatcttcccaaaaccattgatgtttaagtgtttagaaatcatagaaggtgtaggctgctgtggtaattctatttgtatatctcaacagaattaaaatgtctagcttggtggtatttttatagccataaaagaaaatctttaggctttcaaaataaggatgactttagaataatattgtgtcatagaattaattttcagccatgtggaccatattttgtatccaaggatccttatttaaagctttcaacatgtacaggaagttggaaatttttggtttatgactttgtctaataaagagatagttctaaacacattcttgatcaccaaacaacttcagaaagacagtgactgtacagttatcattatcatcatcatcgtcatcatcataggtaacagttatatcaagcttaatatgtgctgaacattgttctgaacactttaggtagatgaactagatgtatgtgaataaaaattatttggtcctcacaaaaa

SEQ ID NO: 27549 - DNA, 1254 bp, Homo sapiens
caggcgccggcgtaattaaatataactgagtttacgcagacgcagaaaacgcaggcaaacctgaggtcctcagaatggcgggcacaggtttggtggctggagaggttgtggtggatgcgctgccgtattttgatcaaggttatgaagcccctggtgtgcgggaagcggctgcagcgctggtggaggaggaaactcgcagataccgacctactaagaactacctgagctacctgacagccccggattattctgcctttgaaatatgagcttccagccccctcctctggtcaaaaaaatgacattactgcatggcaagaatgtgtaaacaattctatggcccagttagagcatcaagcagttagaattgagaatctggaactaatgtcacagcatggatgtaatgcctggaaagtatacaatgaaaatctagttcatatgattgaacacgcacagaaggaacttcagaagttaagaaaacatattcaagatttaaactggcagagaaagaacatgcaactcacagctggatctaaattgagagaaatggagtcaaattgggtatccctggtcagtaagaattatgagattgaacggactattgttcagctagaaaatgaaatctatcaaattaagcagcaacatggagaggcaaacaaagaaaacatccggcaagacttctgaaaagacaatttagcaggtagaagaaaagttgggctttcacaaaaggcatctgaacttttaatgaactgtgaaggacaacagcatcttcccaaaaccattgatgtttaagtgtttagaaatcatagaaggtgtaggctgctgtggtaattctatttgtatatctcaacagaattaaaatgtctagcttggtggtatttttatagccataaaagaaaatctttaggctttcaaaataaggatgactttagaataatattgtgtcatagaattaattttcagccatgtggaccatattttgtatccaaggatccttatttaaagctttcaacatgtacaggaagttggaaatttttggtttatgactttgtctaataaagagatagttctaaacacattcttgatcaccaaacaacttcagaaagacagtgactgtacagttatcattatcatcatcatcgtcatcatcataggtaacagttatatcaagcttaatatgtgctgaacattgttctgaacactttaggtagatgaactagatgtatgtgaataaaaattatttggtcctcacaaaaa

SEQ ID NO: 27550 - DNA, 1438 bp, Homo sapiens
  misc_feature (1332)..(1333): n is a, c, g, or t
  misc_feature (1340)..(1340): n is a, c, g, or t
  misc_feature (1342)..(1342): n is a, c, g, or t
  misc_feature (1345)..(1345): n is a, c, g, or t
  misc_feature (1350)..(1350): n is a, c, g, or t
  misc_feature (1357)..(1357): n is a, c, g, or t
  misc_feature (1364)..(1364): n is a, c, g, or t
gcttgaattgggaggggggcagctggagcctcaggcggcagcgcttctagaaatgctgagccgattatcaggattagcaaatgttgttttgcatgaattatcaggagatgatgacactgatcagaatatgagggctcccctagaccctgaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaagcatgacaagagttctacagaggaagagatggaaatagaaaagataaaacataagctccaggagaaggaggaactaatcagcactttgcaagcccagcttactcgggcacaggtttggtggctggagaggttgtggtggatgcgctgccgtattttgatcaaggctgcagcgctggtggaggaggaaactcgcagataccgacctactaagaactacctgagctacctgacagccccggattattctgcctttgaaactgacataatgagaaatgaatttgaaagactggctgctcgacaaccaattgaattgctcagtatgaaacgatatgagcttccagccccctcctctggtcaaaaaaatgacattactgcatggcaagaatgtgtaaacaattctatggcccagttagagcatcaagcagttagaattgagaatctggaactaatgtcacagcatggatgtaatgcctggaaagtatacaatgaaaatctagttcatatgattgaacacgcacagaaggaacttcagaagttaagaaaacatattcaagatttaaactggcagagaaagaacatgcaactcacagctggatctaaattgagagaaatggagtcaaattgggtatccctggtcagtaagaattatgagattgaacggactattgttcagctagaaaatgaaatctatcaaattaagcagcaacatggagaggcaaacaaagaaaacatccggcaagacttctgaaaagacaatttagcaggtagaagaaaagttgggctttcacagtgggttcccaaaggcttgactttatgactgtgaggacacagatttccaaaccatgtgttagtgtttgaatctgagggtgcgcgggatcnntggtttncngantaagntcggggntttaccnaaaaattggtaaaggggttcacatggggtaatggggatttggagggtaaccacaggggatggggagaaaaaatg

SEQ ID NO: 27551 - DNA, 259 bp, Homo sapiens
gttatatcaagcttaatatgtgctgaacattgttctgaacactttaggtagatgaactagatgtatgtgaataaaaattatttggtcctcacaaaaacctcaggaggcggttactgtttttctcatatgtggacatgtaacagacaccagttaaataacataacttgccagagttttatagctgaaagtgtcagcttttttatagaaagttgtcagtcaggttttgaacccaatagtccagctccagagttaatgttct

SEQ ID NO: 27552 - DNA, 1325 bp, Homo sapiens
caggcgccggcgtaattaaatataactgagtttacgcagacgcagaaaacgcaggcaaacctgaggtcctcagaatggcgggcacaggtttggtggctggagaggttgtggtggatgcgctgccgtattttgatcaaggttatgaagcccctggtgtgcgggaagcggctgcagcgctggtggaggaggaaactcgcagataccgacctactaagaactacctgagctacctgacagccccggattattctgcctttgaaactgacataatgagaaatgaatttgaaagactggctgctcgacaaccaattgaattgctcagtatgaaacgatatgagcttccagccccctcctctggtcaaaaaaatgacattactgcatggcaagaatgtgtaaacaattctatggcccagttagagcatcaagcagttagaattgagaatctggaactaatgtcacagcatggatgtaatgcctggaaagtatacaatgaaaatctagttcatatgattgaacacgcacagaaggaacttcagaagttaagaaaacatattcaagatttaaactggcagagaaagaacatgcaactcacagctggatctaaattgagagaaatggagtcaaattgggtatccctggtcagtaagaattatgagattgaacggactattgttcagctagaaaatgaaatctatcaaattaagcagcaacatggagaggcaaacaaagaaaacatccggcaagacttctgaaaagacaatttagcaggtagaagaaaagttgggctttcacaaaaggcatctgaacttttaatgaactgtgaaggacaacagcatcttcccaaaaccattgatgtttaagtgtttagaaatcatagaaggtgtaggctgctgtggtaattctatttgtatatctcaacagaattaaaatgtctagcttggtggtatttttatagccataaaagaaaatctttaggctttcaaaataaggatgactttagaataatattgtgtcatagaattaattttcagccatgtggaccatattttgtatccaaggatccttatttaaagctttcaacatgtacaggaagttggaaatttttggtttatgactttgtctaataaagagatagttctaaacacattcttgatcaccaaacaacttcagaaagacagtgactgtacagttatcattatcatcatcatcgtcatcatcataggtaacagttatatcaagcttaatatgtgctgaacattgttctgaacactttaggtagatgaactagatgtatgtgaataaaaattatttggtcctcacaaaaa

SEQ ID NO: 27553 - DNA, 764 bp, Homo sapiens
caggcgccggcgtaattaaatataactgagtttacgcagacgcagaaaacgcaggcaaacctgaggtcctcagaatggcgggcacaggtttggtggctggagaggttgtggtggatgcgctgccgtattttgatcaaggttatgaagcccctggtgtgcgggaagcggctgcagcgctggtggaggaggaaactcgcagataccgacctactaagaactacctgagctacctgacagccccggattattctgcctttgaaactgacataatgagaaatgaatttgaaagactggctgctcgacaaccaattgaattgctcagtatgaaacgatatgagcttccagccccctcctctggtcaaaaaaatgacattactgcatggcaagaatgtgtaaacaattctatggcccagttagagcatcaagcagttagaattgagaatctggaactaatgtcacagcatggatgtaatgcctggaaagtatacaatgaaaatctagttcatatgattgaacacgcacagaaggaacttcagaagttaagaaaacatattcaagatttaaactggcagagaaagaacatgcaactcacagctggatctaaattgagagaaatggagtcaaattggggttctgggcagttagaatatgagattgaccggcttttttcagttgaaatgaatctatcaattaagcgcacatgggaggcaacaagaaacatccggagaattttaaaacatttacaggtgacttgtgtttaaggt

SEQ ID NO: 27554 - DNA, 1834 bp, Homo sapiens
  misc_feature (1834)..(1834): n is a, c, g, or t
caggcgccggcgtaattaaatataactgagtttacgcagacgcagaaaacgcaggcaaacctgaggtcctcagaatggcgggcacaggtttggtggctggagaggttgtggtggatgcgctgccgtattttgatcaaggttatgaagcccctggtgtgcgggaagcggctgcagcgctggtggaggaggaaactcgcagataccgacctactaagaactacctgagctacctgacagccccggattattctgcctttgaaactgacataatgagaaatgaatttgaaagactggctgctcgacaaccaattgaattgctcagtatgaaacgatatgagcttccagccccctcctctggtcaaaaaaatgacattactgcatggcaagaatgtgtaaacaattctatggcccagttagagcatcaagcagttagaattgagaatctggaactaatgtcacagcatggatgtaatgcctggaaagtatacaatgaaaatctagttcatatgattgaacacgcacagaaggaacttcagaagttaagaaaacatattcaagatttaaactggcagagaaagaacatgcaactcacagctggatctaaattgagagaaatggagtcaaattgggtatccctggtcagtaagaattatgagattgaacggactattgttcagctagaaaatgaaatctatcaaattaagcagcaacatggagaggcaaacaaagaaaacatccggcaagacttctgaaaagacaatttagcaggtagaagaaaagttgggctttcacaaaaggcatctgaacttttaatgaactgtgaaggacaacagcatcttcccaaaaccattgatgtttaagtgtttagaaatcatagaaggtgtaggctgctgtggtaattctatttgtatatctcaacagaattaaaatgtctagcttggtggtatttttatagccataaaagaaaatctttaggctttcaaaataaggatgactttagaataatattgtgtcatagaattaattttcagccatgtggaccatattttgtatccaaggatccttatttaaagctttcaacatgtacaggaagttggaaatttttggtttatgactttgtctaataaagagatagttctaaacacattcttgatcaccaaacaacttcagaaagacagtgactgtacagttatcattatcatcatcatcgtcatcatcataggtaacagttatatcaagcttaatatgtgctgaacattgttctgaacactttaggtagatgaactagatgtatgtgaataaaaattatttggtcctcacaaaaaaaaaaaaaaaaaaaaaaaaaaaaaaaaaaataaaaaaaaaaaaaaaaacaaaaaaaaaacaaacaagaagtgtgcgtgcgccgcgcggcgcccgcgcgcgccccgcaaagaagaagttcttcctacagcaccccgctgcggtgggggcgcgaccgagcggcggcccagagagggagatgagtgagcgacagcaggggggaactacaaacgcgggtgcgtccccaagaagaagcaacaccccccgggcaagagagaaacctaggcggcttggtgtgtgtgtctctcccaaccccagaattaaaaagagagacacgcgcgccgcggggggagacacacgagaggcgtgttcttagaacgacaaacaaactcaccgagagggggagcgcctatgcaagaaagacagccacaaagagggggagggtatctacaacaaagcaagggggggcggccaaaaagaggggacgcataagaataaaaaaaaaatcacccccgcgcggctgctcgtgcgn

SEQ ID NO: 27555 - DNA, 999 bp, Homo sapiens
caggcgccggcgtaattaaatataactgagtttacgcagacgcagaaaacgcaggcaaacctgaggtcctcagaatggcgggcacaggtttggtggctggagaggttgtggtggatgcgctgccgtattttgatcaaggttatgaagcccctggtgtgcgggaagcggctgcagcgctggtggaggaggaaactcgcagataccgacctactaagaactacctgagctacctgacagccccggattattctgcctttgaaactgacataatgagaaatgaatttgaaagactggctgctcgacaaccaattgaattgctcagtatgaaacgatatgagcttccagccccctcctctggtcaaaaaaatgacattactgcatggcaagaatgtgtaaacaattctatggcccagttagagcatcaagcagttagaattgagaatctggaactaatgtcacagcatggatgtaatgcctggaaagtatacaatgaaaatctagttcatatgattgaacacgcacagaaggaacttcagaagttaagaaaacatattcaagatttaaactggcagagaaagaacatgcaactcacagctggatctaaattgagagaaatggagtcaaattgggtatccctggtcagtaagaattatgagattgaacggactattgttcagctagaaaatgaaatctatcaaattaagcagcaacatggagaggcaaacaaagaaaacatccggcaagacttctgaaaagacaatttagcaggtagaagaaaagttgggctttcacatttatgatttgcaggcacgcctctccaaaccctgagttagtgttagaatcttcagggtggtgcgggtatctattgtatccacgaatagagtcgcggggttttagcaaaaaatcggttcacaagggacttaaatggtctaaataggtgtacatgtacgcctactcgctcgaggccgtactctagacttctccacaaggactattgca

SEQ ID NO: 27556 - DNA, 1270 bp, Homo sapiens
caggcgccggcgtaattaaatataactgagtttacgcagacgcagaaaacgcaggcaaacctgaggtcctcagaatggcgggcacaggtttggtggctggagaggttgtggtgctgcagcgctggtggaggaggaaactcgcagataccgacctactaagaactacctgagctacctgacagccccggattattctgcctttgaaactgacataatgagaaatgaatttgaaagactggctgctcgacaaccaattgaattgctcagtatgaaacgatatgagcttccagccccctcctctggtcaaaaaaatgacattactgcatggcaagaatgtgtaaacaattctatggcccagttagagcatcaagcagttagaattgagaatctggaactaatgtcacagcatggatgtaatgcctggaaagtatacaatgaaaatctagttcatatgattgaacacgcacagaaggaacttcagaagttaagaaaacatattcaagatttaaactggcagagaaagaacatgcaactcacagctggatctaaattgagagaaatggagtcaaattgggtatccctggtcagtaagaattatgagattgaacggactattgttcagctagaaaatgaaatctatcaaattaagcagcaacatggagaggcaaacaaagaaaacatccggcaagacttctgaaaagacaatttagcaggtagaagaaaagttgggctttcacaaaaggcatctgaacttttaatgaactgtgaaggacaacagcatcttcccaaaaccattgatgtttaagtgtttagaaatcatagaaggtgtaggctgctgtggtaattctatttgtatatctcaacagaattaaaatgtctagcttggtggtatttttatagccataaaagaaaatctttaggctttcaaaataaggatgactttagaataatattgtgtcatagaattaattttcagccatgtggaccatattttgtatccaaggatccttatttaaagctttcaacatgtacaggaagttggaaatttttggtttatgactttgtctaataaagagatagttctaaacacattcttgatcaccaaacaacttcagaaagacagtgactgtacagttatcattatcatcatcatcgtcatcatcataggtaacagttatatcaagcttaatatgtgctgaacattgttctgaacactttaggtagatgaactagatgtatgtgaataaaaattatttggtcctcacaaaaa

SEQ ID NO: 27557 - DNA, 1384 bp, Homo sapiens
  misc_feature (285)..(285): n is a, c, g, or t
ggcaggcaaacctgtaggtcctcagaaaatggcggggactagcaggttgggatggcttggtagagggttgtggtggtatgcgcttgccaggtacttattgattcaagggttatgatagccccttgtgatggtgcgggaacgcggcatgcagctgcatggtgggaggaggagaagcgtcgtcagcattgaccgagccgtcactgaagaacgttactctgcaggctaactcgtgcacaaggccccggaatatcatatcttgacctatcggaaactggacattaatgnagggaaatgtaatttagaaagagatctgggctggactcgcacgagacctagagttgtacactgtggctcgagatatgaaaaacgtataatgacgcttaccgagcaatatgagcttccagccccctcctctggtcaaaaaaatgacattactgcatggcaagaatgtgtaaacaattctatggcccagttagagcatcaagcagttagaattgagaatctggaactaatgtcacagcatggatgtaatgcctggaaagtatacaatgaaaatctagttcatatgattgaacacgcacagaaggaacttcagaagttaagaaaacatattcaagatttaaactggcagagaaagaacatgcaactcacagctggatctaaattgagagaaatggagtcaaattgggtatccctggtcagtaagaattatgagattgaacggactattgttcagctagaaaatgaaatctatcaaattaagcagcaacatggagaggcaaacaaagaaaacatccggcaagacttctgaaaagacaatttagcaggtagaagaaaagttgggctttcacaaaaggcatctgaacttttaatgaactgtgaaggacaacagcatcttcccaaaaccattgatgtttaagtgtttagaaatcatagaaggtgtaggctgctgtggtaattctatttgtatatctcaacagaattaaaatgtctagcttggtggtatttttatagccataaaagaaaatctttaggctttcaaaataaggatgactttagaataatattgtgtcatagaattaattttcagccatgtggaccatattttgtatccaaggatccttatttaaagctttcaacatgtacaggaagttggaaatttttggtttatgactttgtctaataaagagatagttctaaacacattcttgatcaccaaacaacttcagaaagacagtgactgtacagttatcattatcatcatcatcgtcatcatcataggtaacagttatatcaagcttaatatgtgctgaacattgttctgaacactttaggtagatgaactagatgtatgtgaataaaaattatttggtcctcacaaaaa

SEQ ID NO: 27558 - DNA, 609 bp, Homo sapiens
tttaccatttagtcctacttactgccccatccttctcgctcatacttctcctacacagattctttcccatactgtacatgtttacccacaatgtgtaaatgccactatcctgtctgcatctgtacatgccaagccccttctcctagcataccttttccattatcctagcactccaggaacaccttcaatttccagttccaaacctgcccctctggcagccttccccagttgctttaattcatgagtatctttcatatacctctgaatggctctagtgcttacagtctttgtctgtaatggcctcaccatgtagttattttacctttttatctcctccagtgtaccgtcagctcctggagcgcagggcacttggtttattgatggtgtcgagaaaagcctcagagatggtgagaatctgtgaacaagctggaaaccaaacgcacctccttcaggtcagggtgggagtatattccccatgaaatagtccggaaagatggagtagcattgcttaaatttcttggtgttccggtcagctcttcagatagtttccaaaagaagtccctggctgaaataattccccgcaactccagctgtgagcaatgaattaaa

SEQ ID NO: 27559 - DNA, 1303 bp, Homo sapiens
agattgtctctaaaattgtggtttaactcacgcaggaagtaaaattcctatagcaagacatagtttcattttagaggacccccaaaatcccgtgaattctctggtgatgattctagcctaaccttcaacataaaataatgaagagaacttttaaacttttttatgaattcctaaacattaccatttatgtggcagaagttctgttccctataatctgcaatgctgaagtatctctattcaattcccttccttatctgttaaatttaatgtctttatactaaaaatataggctcttgggattggagaggaaaaattagaggtgattttcagatttcttgttctatggaagaggaagctgagctcagggagatatgagctccacagccacagctggttaggggcggctgcagtagaacagggcagatgcctggactcccaactcagtaggccttctgttacacctcaaaatgtgttacatgggaagaaaaagattaagaaaaagcaagataattttgaagaaggacgagaggaagaggcatgaacttgtcctaacaatgtcaaagaatattttaaaggtataccagttaaagtagtgtgtggctggtgccagtagaggtcagtcaagggatccctgacgagaataaagagcccagaaacaggtccatgtttatatgggaacttgatttttgacagatacggcaagctctatggggaaaacaatatgtactaccttatacccttccccaaaaacaaagggattaaagacctaaatatgaagacaaaacttttaaatgagaatctataaggttattttcatgattttgcaaatgggaaggatttctttaaagcaagacacaaaagcatacacaggaaaaaatgatgcataaaaacatggcttctgtagaacaatagagactgtaaaagaacaagctacagacaaggaaatgtttgcaatgcatggaactgtcaaaggattcgtatctggaatacattaaagaagcaaaagaacctcatacaaaagtcattgagtaaatgacagccatgcattagaacagcaattctcaaaacttttggtctcaagatccctttacactcttcaaaagtgagaaccccaaagagttttcatgtatgtgggttaaatctattgatattttctgttagaatttaaaaattatgttaaaaaaataagaagaatgactatttttcaaaacaaaaaatgagaagagtggtattgttttacatttttacaaatctctttaacatttagcttaataaaagatagctggcctctcaaaaaaaaaaa

SEQ ID NO: 27560 - DNA, 550 bp, Homo sapiens
  misc_feature (85)..(85): n is a, c, g, or t
ggcgtgcccacttctcccgcgaattgcccgaggagacgcgcgaggcctacgagcgtctcctgaagaggcaaaaccagcgtggcgnccgcgctctcttccaggacatcaagaagccaaccgtggactagtactagtccacggttggctccggtagcttttgcctcctggagcccacagtccagatggggacaaaaaaagagatagggacacaaagagtgatcactgagccagagggtggaaaggtgcttaggagacatgagctgcttggaggcagagtcctgcttggaagctgttggttgattcctgggcaagccacttcccctcctgggcctgggttttcatctgtaaatgaaggcgtggatccagatctccctctaagactactccacgcctcacgtgccatttgttctctgagtttcccatgttctcgcctcctactacctagccctatgctaggactctcccctccaggacacagtagccaaccgtggactagtagccaaccgtggactagtagccaaccgtgactagtagccaaccgtggactagt

SEQ ID NO: 27561 - DNA, 715 bp, Homo sapiens
gtctggaggtggccaggtggggctggggccatcttcacagggcaagataatccccaaggagcctggccacttccaagattctatgattctactctgctatcatctttaattattttaaaaaatatgtcactgacacataacaaatgagggcagaaatggcattgttcccatctggggaagagcctcaagggtgggcagtatacaaaacatgaccctttgccagattctaactggtccagtgcccaatcccattgatagaaactcaaccaatgcaaacctcagcctgcaagctccgaaggggcagagtgcaagccggtagcttttgcctcctggagcccacagtccagatggggacaaaaaaagagatagggacacaaagagtgatcactgagccagagggtggaaaggtgcttaggagacatgagctgcttggaggcagagtcctgcttggaagctgttggttgattcctgggcaagccacttcccctcctgggcctgggttttcatctgtaaatgaaggcgtggatccagatctccctctaagactactccacgcctcacgtgccatttgttctctgagtttcccatgttctcgcctcctactacctagccctatgctaggactctcccctccaggacacagtagccaaccgtggactagtagccaaccgtggactagtagccaaccgtgactagtagccaaccgtggactagt

SEQ ID NO: 27562 - DNA, 482 bp, Homo sapiens
ctctaccagatattaaaatgtcacaaagccacagtaattaaaacagtgtaatgatacacagagagataaccagaccaatggaataaaaaagaaagtctaaaagtagaatcagcattttatggaaatccagtgtatgatgaaagtgagatttcataacactgagcctttttaaaaatggtgttggggctcggtacagtggcttatgcctataatcccagcactttggaaggccaaagaggaggattgcttgaagccacgagtttgagaccagcctgggtcacaaagtgagaccccagtctctataaaaattaaaaagaagaaaattagttagccagatgtggtggtatgcacctgtagtcatagctacctggaaggctgaggcaggagcatctcttgagcccaggagttcaaggctgcagtcagctatgatcatacccctgcactccatcctggatgatacagtgagatcctatccctaaaaa

SEQ ID NO: 27563 - DNA, 231 bp, Homo sapiens
ccaatagatgaaaaaagattcaaggaagacacatttgctttttattcactcatcacttcccatcactatgctgaccagagtcaatgtgagcagagttgagaatagcagttttctggcaggagagccacttctcagcgaaaaatgacacactcaaagtataaatctttcatggaaggctcacatattttcagcaaattaagcatatgcatgaataaaattcttgtggtgaaa

SEQ ID NO: 27564 - DNA, 646 bp, Homo sapiens
ggagtcaggtctcttgaatacaagatgcaaatttatgcaacatatgcaaatcactcatgttctcaaattccatgaacaaaatctggtagccttgagataaaaaagcccctgccaagcatcatctctcctaattattgcttaatttcctcctccccccaccctttaacattgaacactttcaggcttggcagaaactggaagaaaacacaatgagagctggttaataaacaggaagttcctcaggggcaaagaccctgcaatctatttattttatgctctccagtggctcctaatatactgctgagcacacacagtcttgcatagggaacaccaccagtcctgactatcaaattatggatatttcaagatgaacaagttgagagccccgaaagctttgcaaaacatgccatttaagactagaaacaggaaactgatgacctgtactatataatgcatgtagctattaatttatttaaattaaataacatttaaaaattttgttcttggctgggtgtggcggctcatgcctgtaatcctagccctttgggagaccgaggcaggaggatcccttgagcccaggagtttgagaccagcctgggcaacatagggaaaccctgtctctattaaattaaaaagaaaaaaaaaa

SEQ ID NO: 27565 - DNA, 281 bp, Homo sapiens
agagtttcagttttacaagataaaaagttttggagtctgattgcacaacaatggaaatatacttaacactcttcaacggtgcacttaaaatagtgaagatggttaattttatgttatgtatattttatccactatgacagaattttaaaaataaactgttggaatctaatagcaatagggagactgaattactaatataaccatggtacaaaatgataaatctaaatcagggtgtagataacatcaaattccctatttgggtctccacttcagtagacatt

SEQ ID NO: 27566 - DNA, 348 bp, Homo sapiens
tgttccgatgagtggcatcatttgtagcttagtcctgttaggacagacttttttaaaaaatctgatccttagccttactatgaaaaacatcagaataacatctcagtaatcagaaaaaatggttttctttcaggcaccgaatttaagatcaagtccagcttcctcctataaggagacatatacactagaagaattaggatttttctcaaatatgttagtcttctgaagatattcacaatctttcaaaccagaaattgctccccttctcctctctccgaaaagaataatagtgtttttcttttgagagaaggagaagtgtttgcattttccctttattttgtttattta

SEQ ID NO: 27567 - DNA, 372 bp, Homo sapiens
cagggtcccaggacacaggaagaccccgagggtagatcctggaccctggaaagtcagtagcctaagggaagtgaagatgcagaaaactgagagtgcagatatggggaacgcatctggaaattagctggcacagaggaggaagcctgagagccagggtgggctgtggagttctgggtacacgtgctgacagctggaaacatggggctgaggctgcatggggcagtgggagctcaagacacaaatctggccaggtgtggtggctcacgcctgtcatcctagcactttgggaggccgaggctggagaattgcttgtggccaggtgttcgagaccagtctgggcaacatgatgaaatctcgaaacctcgtctctac

SEQ ID NO: 27568 - DNA, 436 bp, Homo sapiens
tgaaaataaatggagctctagtaaatgttagagtttttgctagtagagttttgatgctttttgtctttgttctactactgagcttgcacctaggatgccttcttatagtgccattcaacatgcaagtttctttttctggggctgtgtgtccaggtgactttatgagttaggctttggcaaatgccagacttgttcatcctaacactagaatgtagggatcctgcattcagcatgacctgaaatttgctcaaagtataaaattgtagatgttcagtttttatacagaattcaatcttttgaagacttaaattagttcatatttaactttggacttacctggagaatcgcttgaaccaagaagtcagaggttgcagtgagctgagatctcgccacagcactccagcctggtgagagagtgagagtccatctaaaaaaa

SEQ ID NO: 27569 - DNA, 408 bp, Homo sapiens
tgagaattgcttgaacctgggagtggaggttgctgtgagccaagatcgtgccactgtactccatcctgggcaacagagtgtgactcagtctcaaaagataataaagataatatttttttaaaagtttgaaaaaaaaggtgatagctatcaacaggtattattttggggggctcctgctgtttgctaagtactgtgtcaagggctttacttgcataacctcattaattattcctaaccctaagaaatgagtacaattattcccattttatagttgaagaaatcaaggagcagaaatattcaggaatatttagtcagtaatggagctaggattggcttccaggtcttcctgacggcaaagcccatgttattcattccattgtgttggatcaaaattttaggatgggattt

SEQ ID NO: 27570 - DNA, 778 bp, Homo sapiens
gtgggatatgaagcatgagacggaatgaggtcaccaagagagtgaatgtatataaagcaaagagggtgtccaagggctgagttctgagatacttcaatagcagaagatgatgctgagaagcagaagccagctaaagagactgagaaagtgctggtggtgaagcaccaggaaaatcaacagatcatgctctgtgttagtggattcacaagcaacctgtactcctcaaagaaagatgataagatgaaggagatctctagaaccagcaactggggctcttccttcagtgaaaaaagtgggtgtatgcagactcatccatccatgaatctagattgcagggatgtgacctatgtaatgaacttgctacttattgcctcatcatcatcttcttcaatgacaaaaaagaaaatagtaacaatgaatacgtctcttgggcaaaataaataatgagattgttacagcaacctgatttttgaaaagaaaaaaggaacttcctcgaactaaagcagttaagacctcgacatttgctcacagaaaaagtcgctgagtcgtttctagttgtgaaggtgcaaaagatgcagttatcccttatggaaaattccaagaacttgtgcctaatttgagtcatgcaaacctgagttctgcatgactgagctctgtcactcaatggttgggaaatttgtgatcatctctacgccttgctttctgcatctgtaaagtggaaatgataatatctaccttgtgtgattcctggaagaattaaatacattatattcaaaat

SEQ ID NO: 27571 - DNA, 387 bp, Homo sapiens
aaaagggaggaggagcaggaaaaggaggagaaggatgagggagatgaagagaaggaagaagcaaaagcaacctgatttttgaaaagaaaaaaggaacttcctcgaactaaagcagttaagacctcgacatttgctcacagaaaaagtcgctgagtcgtttctagttgtgaaggtgcaaaagatgcagttatcccttatggaaaattccaagaacttgtgcctaatttgagtcatgcaaacctgagttctgcatgactgagctctgtcactcaatggttgggaaatttgtgatcatctctacgccttgctttctgcatctgtaaagtggaaatgataatatctaccttgtgtgattcctggaagaattaaatacattatattcaaaat

SEQ ID NO: 27572 - DNA, 405 bp, Homo sapiens
tgagttctgagatacttcaatagcagaagatgatgctgagaagcagaagccagctaaagagactgagaaagtgctggtggtgaagcaccaggaaaatcaacagatcatgtaagatgtctcagatgccaagtgaagaaagcattttaaggacaaggaggcagtcaactgtattatatgttgctaatcagcaaaccaagatgagaattgatgtttgacttttgtgtttagcaatgtgggtgtcaatcattataataattaggtttatatataataaccttgataacaacaattttggtggagagtgaaggtgaaactgtgatttaagagtgatgaagagaaaatgagtagaaagcttattcatcagctatgggttttatacaagttacagaacctcaaatcctccct

SEQ ID NO: 27573 - DNA, 292 bp, Homo sapiens
ataaaatattttctacatttctgtttatttcccttagattcccagcagtggaatttccaagccaaaagcttttggtacatgttataaattgcttttaagaatgtgtatcaattataatgtccagtgtttgctttaaaacattctagcaaagaaaaaagtataggggattagatgaggagaaactggcaaaatggtaacagttgaagctaggtgaggtgcctggagattcattttgctattattctcttttgtgtatgtctgaaaattacaaagatttctaaattgaattgaa

SEQ ID NO: 27574 - DNA, 410 bp, Homo sapiens
ttaaaaagttcttactatgcatataaaaactagtttcattgtattccaaaaacacctaaacataatctatgtagatggttcttgaaagaattaagaaaaaaaattgtttaaaaaaagatagactaagaaaagtgaaaagatggagagagagatataagaaaacaggctgcctttaaaacaacaacaaaatatgttgtctgaacttggctttgcaggggtattaaacagaaaacaggagcataattttcacagactttgaggataagatgacatggcaagacatcaacccagtaatcattaataaaataaagcaacagaagggtaagttaagttactctatgactcacgatataccatgtttatctgcttatgtttaaaaatgttctctaagatttactacagacagtctt

SEQ ID NO: 27575 - DNA, 388 bp, Homo sapiens
tctgagacaggatctcactctgtcccacaggcttgagggcagtagctccatcttggctcaccgcaacctctgcctcctaggttcaagcgattctcctgcctcagcctcctgagtagctgggactacaggtgcccaccactatacctggctattttttgtatttttagcagagatggggttttgccatgttggccgggctggtctcgaactcctggcctcatgtgatctgcctgtctgggcctcccaaagtgctgggattacaggtgtgagccaccgtgtccagccgggatcactgtctttattcttcatccgtgtctcctgggtgatcattaattgggctctcccagtgtgctggccactgtcttttctgggtttgattgattgagtc

SEQ ID NO: 27576 - DNA, 583 bp, Homo sapiens
gcaacatgttggcactgaaaacgtttcaaattttggagcacttaggattttgggttttcagatttgggatactcaacgtgtatgtagctattctcccatccaggtggtggagtttaattcccctctcttgagtgtggacttagtaactctatttcaaagaatagagaatgggaaggaaaaataaggcctttactgaggaaatatggcaagtgccagtgaggaaccaagtgagaaaggttggcatgaccagtgataagccacgtgcatatcgtgagcccctgataggatgcatggaggcatcttgcctccatgggatcgtaccaaaaaaccacagttcagtctaatcataggaaaactcacaatcccaggtcaggggacattctataggatacttggccagtactcttcaaacatggcaaggccttgaaaaacacaaaagaccgaggaactgtcactgataagagactaaggacccaggatgaaaatgcaaagtggactcccagatcagttcctggaacagaaatctggagtttgtgggaaaactggtgaagcccaaataaagtccgtagccaagttcatggta

SEQ ID NO: 27577 - DNA, 402 bp, Homo sapiens
ttctatttttatatcctcaagctcagagattgtttcctcggccatgtccagtctactaatgagcccatcaaaggcattctttatttctgttgcagtgtttttgatctctagcacttttctgtgattctttcttaggcttttcatctcctaacttacattatctacctgttcttatatcttgtctactttttccattagagcccttagcatattaatcatacttttaaattcctggtgtgataattccaacatttgtgccctatctgactctgattctgatgctcgttgggtctcttcaaactgcgttttttgccctttagtatgctttgtgcttttttgttgaaatgtgaatattttgtagagatgaaaagaatgtggggctgggtgtggtggcttacacct

SEQ ID NO: 27578 - DNA, 164 bp, Homo sapiens
agtctgaacacaactaccaaccgctaagtggaagctcttagcagaggtcagccgagttttcaagtgaggctataactgctgaagagtagcccttcaacctatggtacttggttgcccattataaaggaaagctgtgtagtaatttgactttttataccttaaga

SEQ ID NO: 27579 - DNA, 560 bp, Homo sapiens
cgcaacgcacctggtgcgctttggcaaacaagccccgcggcgggctggggcaggatttaagaaatgtttaatgaagactgggaggcctggagcaacgctctttgggatgcagaaaagggtcgtgcagctcggtggcctctcctccggccccctggccctggctgtaagtttcctcggctctgcagggcgcggggcactcagggatggaggagaccacaccgcgcggctgggttcgcggaatggcggtccctgcggcctccaaaggcgggacctcagacccctcccactcctttcctgctcgacatctcaatccagctcctaatatctcaatagggtttttaaacaaatcgatcctaagggctcagttcagcccacccagggattcttggaggacgcacgccgaactcagggtagtgagaagagtttggggggccctggggcgcagggagaagaccccacactccacggccaccagctcccttccggagacggcgctcggacgtcgcgggtcacgggcggggaatttagcccaggtgctcgttgggccgcgagcggccgct

SEQ ID NO: 27580 - DNA, 219 bp, Homo sapiens
tttgccatgttgcccaggctggccttgaactcctggtctcaatccatccatctaccttggccttccaaagtgctgcaattacaggcgtgagtcactgtgccctgctattacactctattcttacaatcaagtatgctagagaaaacattattaatcataaggaagagaaaatatacttactacttgttaaatggaagtggatcatcataaaggtcttca

SEQ ID NO: 27581 - DNA, 211 bp, Homo sapiens
gcatgcggttactcccaaattggtatctttagcctgtacttacctcttcatagatccaactgtcatttccaatttggtgtctaagagaaaattcaaacttagtttgtcgaaactgaactcctgacctcctcctatcccatccaagcttagttgtccttatgcttttccaggtttatttaatagcaactttattggtatagttgcttagctc

SEQ ID NO: 27582 - DNA, 454 bp, Homo sapiens
ttctgcgctgtggagcctctggggctcagctgggcggtggtcgggtcgtggggcggtagggcgggagcgggggaagggaaaagcaaaagctggaaaagaagcaggggagttgtgaaccagacatccagacctcctgaagggctcgtgcagacgtacaggcgggatcttctggaagtgagaattgtttttgtttgtttatctattgtagcagaatggggaaatggagagagaacctgaaagagccccaaactcgaggacctattgctccccaagaataacatcttccagaactagacagaaaactaggcgtctgggaaccctgaaatccttggaggagtagatcatcatgaccctctgtgttccttttggcaaatgacttgcttccattgtttgtttgttcaattgtctgtttgttaaataaataaaacccttttcatgtatctttaaaattaca

SEQ ID NO: 27583 - DNA, 391 bp, Homo sapiens
tgggtcattaacaaggcaggccagacttggcctgccagaatgtggggcttgagattgtggaggagagaacaaatggaatgtgagtcagtaaggctgctagctacagaaaccaacccaagaagaggtttactggaaggtgtatcagtaggattagcttcagctgtggttaagagtcccaactacaatagggaaaatacaggggttaattctgtcacacaaaacccagaggcagaaagaagagaactgatctggaggctccattagtgtatcagagccccagactctgtgcttttgctccaccaaacatgacttccattctcaagatcatctcaagatctaggatggctgctagagctccggccattgcttccacgttccatgcagcaggaag

SEQ ID NO: 27584 - DNA, 354 bp, Homo sapiens
tgtaatcaaaggtgtaggaaagggatgctggctgcacagaaaaagtgttgttcaccaccaggaggaaggagggaaacaagaagacctgaggatcaggtggtacaccacttcagtgttcaggtggcacaaacaaacactagaagaaaataatcatcaccagcctgggaaacatggcaaaatccaatctctacaaaaaataacaacaacaaaagaaaaccacacacacacacaaaagtaaattagccaggcatggtggcatgcacctgtaatcccagctgcttgagaggctgaggtgggaggattcattgaacccaggagattgaggttgcagtgaggtgtgattgcaccactgtg

SEQ ID NO: 27585 - DNA, 688 bp, Homo sapiens
tccccagacttgccctttagttccctggggcaccctttttccgctgagtcacatccccagagtgctcccaggtaaacaagcccctgggggctgggggatgagcctggctcatcctatctaccattccttccccaccccacccccgccccacttctagtccttttacctcccctggcagcagctgcagcgggcccaaaccgatgtgacaccatataccagggcttcgccgagtgtctcatccgcttgggggacagcatgggccgcggaggcgagctggagaccatctgcaggtcttggaatgacttccatgcctgtgcctctcaggtcctgtcaggctgtccggaggaggcagctgcagtgtgggaatcactacagcaagaagctcgccaggccccccgtccgaataacttgcacactctgtgcggtgccccggtgcatgttcgggagcgcggcacaggctccgaaaccaaccaggagacgctgcgggctacagcgcctgcactccccatggcccctgcgcccccactgctggcggctgctctggctctggcctacctcctgaggcctctggcctagcttgttgggttgggtagcagcgcccgtacctccagccctgctctggcggtggttgtccaggctctgcagagcgcagcagggcttttcattaaaggtatttatatttgtagta

SEQ ID NO: 27586 - DNA, 1110 bp, Homo sapiens
ggctctgtcgggacattttatccgtctgtttacaacatgaaatagacacctccgaaatgtgtgtgtgttccgtaaatgaaggagcagagggaccccttcggagcatctcagaggccaggaagcctggcttctggccgccctgcccgctcctcacgtgtgaggggaactggggaagtcgagtcagcccgctggggttcctgattctctgcggttctgggaagagcttgcagtggaaggcctcccagccatttcctcttctcccccaactgtgactcactgattgattaatgtttggaaattgtgactcatcttgttagagaaggaaaaggaaattttattctcttcattctccctccctttcaaataagtaataaataaaaagtggctgatcttccacttggtgcggtaagaagcatttaaatacattcccggccctcataattggtggcttcttggagaaaggtacttattagaagaaaaacacttccctatgtgttgttgttcggccttctcgttgatgaaattacacggtgagttggtgagcgaatttaccttgcccctttttaaaggtatttgtggcagctcttgttgtaggaatcaggggagaggagccacttctcttttagtaagaaatgcgaagagtggcctctccatcttcagagtttcaaaatgagttcactctggtggtgagtaatgatgtcttaagctggcttattaaaggcggaggaataagatgttcttgctttacctcacgtaccaaatatagataaggcgctggatcagcagagcctcaggcccgtgccaggacacagtcgggcctggcgatgtctgttttgtctcacgactggagggttgaaggggaagcacagcctttgcttttaagggttttcttctgggaaatccacaaaaaaaaaaaaagcatttgttcacttctcacgttgtgatgttgaaattatggcttggagttttacatttgccttttaattctctttatgggcagcatgtctgtatgtcttaggctcttggttctggaagaccaagtaaattcagtatcttttcaaattgtaaccctctggtctgggtaacacagcaagacccccatctctacaa

SEQ ID NO: 27587 - DNA, 1521 bp, Homo sapiens
  misc_feature (46)..(46): n is a, c, g, or t
ctgaaaaggaccagctgtccttttccgtgtccgcccccactctgtngaaccagctcccccccaacatccgctgtcctcctagtctctctacctggggcccatcttgaagtttggctccaaggagcagaagcaggcgtgggtcacgcctttcaccagtggtgacaaaattggctgctttgccctcagcgaaccagggaacggcagtgatgcaggagctgcgtccaccaccgcccgggccgagggcgactcatgggttctgaatggaaccaaagcctggatcaccaatgcctgggaggcttcggctgccgtggtctttgccagcacggacagagccctgcaaaacaagggcatcagtgccttcctggtccccatgccaacgcctgggctcacgttggggaagaaagaagacaagctgggcatccggggctcatccacggccaacctcatctttgaggactgtcgcatccccaaggacagcatcctgggggagccagggatgggcttcaagatagccatgcaaaccctggacatgggccgcatcggcatcgcctcccaggccctgggcattgcccagaccgccctcgattgtgctgtgaactacgctgagaatcgcatggccttcggggcgcccctcaccaagctccaggtcatccagttcaagttggcagacatggccctggccctggagagtgcccggctgctgacctggcgcgctgccatgctgaaggataacaagaagcctttcatcaaggaggcagccatggccaagctggccgcctcggaggccgcgaccgccatcagccaccaggccatccagatcctgggcggcatgggctacgtgacagagatgccggcagagcggcactaccgcgacgcccgcatcactgagatctacgagggcaccagcgaaatccagcggctggtgatcgccgggcatctgctcaggagctaccggagctgagcccgcggcggactgccccaggactgcgggaaggcgcgggagccaggggcctccaccccaaccccggctcagagactgggcggcccggcgggggctccctggggaccccagatgggctcagtgctgccacccagatcagatcacatgggaatgaggccctccgaccattggcagctccgcctctgggcctttccgcctcctcaccactgtgcctcaagttcctcatctaagtggccctggcctcctgggggcggggttgtgggggggctgagcgacactcagggacacctcagttgtcctcccgcgggccctggtgccctggcatgaaggcccagtgcgacaggcccttggtggggtctgtcttttccttgaggtcagaggtcaggagcagggctggggtcaggatgacgaggcctggggtcctggtgttgggcaggtggtggggctgggccatggagctggcccagaggcccctcagccctttgtaaagtctgatgaaggcaggggtggtgattcatgctgtgtgactgactgtgggtaataaacacacctgtccccca

SEQ ID NO: 27588 - DNA, 1701 bp, Homo sapiens
  misc_feature (7)..(7): n is a, c, g, or t
  misc_feature (17)..(17): n is a, c, g, or t
  misc_feature (21)..(21): n is a, c, g, or t
cacgggnaggtcgcganctgnggaactgtgtctgtcgcccatggccgccgcgctgctcgcccgggcctcgggccctgcccgcagagctctctgtcctagggcctggcggcagttacacaccatctaccagtctgtggaactgcccgagacacaccagatgttgctccagacatgccgggactttgccgagaaggagttgtttcccattgcagcccaggtggataaggaacatctcttcccagcggctcaggtgaagaagatgggcgggcttgggcttctggccatggacgtgcccgaggagcttggcggtgctggcctcgattacctggcctacgccatcgccatggaggagatcagccgtggctgcgcctccaccggagtcatcatgagtgtcaacaactctctctacctggggcccatcttgaagtttggctccaaggagcagaagcaggcgtgggtcacgcctttcaccagtggtgacaaaattggctgctttgccctcagcgaaccagggaacggcagtgatgcaggagctgcgtccaccaccgcccgggccgagggcgactcatgggttctgaatggaaccaaagcctggatcaccaatgcctgggaggcttcggctgccgtggtctttgccagcacggacagagccctgcaaaacaagggcatcagtgccttcctggtccccatgccaacgcctgggctcacgttggggaagaaagaagacaagctgggcatccggggctcatccacggccaacctcatctttgaggactgtcgcatccccaaggacagcatcctgggggagccagggatgggcttcaagatagccatgttcaagttggcagacatggccctggccctggagagtgcccggctgctgacctggcgcgctgccatgctgaaggataacaagaagcctttcatcaaggaggcagccatggccaagctggccgcctcggaggccgcgaccgccatcagccaccaggccatccagatcctgggcggcatgggctacgtgacagagatgccggcagagcggcactaccgcgacgcccgcatcactgagatctacgagggcaccagcgaaatccagcggctggtgatcgccgggcatctgctcaggagctaccggagctgagcccgcggcggactgccccaggactgcgggaaggcgcgggagccaggggcctccaccccaaccccggctcagagactgggcggcccggcgggggctccctggggaccccagatgggctcagtgctgccacccagatcagatcacatgggaatgaggccctccgaccattggcagctccgcctctgggcctttccgcctcctcaccactgtgcctcaagttcctcatctaagtggccctggcctcctgggggcggggttgtgggggggctgagcgacactcagggacacctcagttgtcctcccgcgggccctggtgccctggcatgaaggcccagtgcgacaggcccttggtggggtctgtcttttccttgaggtcagaggtcaggagcagggctggggtcaggatgacgaggcctggggtcctggtgttgggcaggtggtggggctgggccatggagctggcccagaggcccctcagccctttgtaaagtctgatgaaggcaggggtggtgattcatgctgtgtgactgactgtgggtaataaacacacctgtccccca

SEQ ID NO: 27589 - DNA, 1839 bp, Homo sapiens
  misc_feature (7)..(7): n is a, c, g, or t
  misc_feature (17)..(17): n is a, c, g, or t
  misc_feature (21)..(21): n is a, c, g, or t
cacgggnaggtcgcganctgnggaactgtgtctgtcgcccatggccgccgcgctgctcgcccgggcctcgggccctgcccgcagagctctctgtcctagggcctggcggcagttacacaccatctaccagtctgtggaactgcccgagacacaccagatgttgctccagacatgccgggactttgccgagaaggagttgtttcccattgcagcccaggtggataaggaacatctcttcccagcggctcaggtgaagaagatgggcgggcttgggcttctggccatggacgtgcccgaggagcttggcggtgctggcctcgattacctggcctacgccatcgccatggaggagatcagccgtggctgcgcctccaccggagtcatcatgagtgtcaacaactctctctacctggggcccatcttgaagtttggctccaaggagcagaagcaggcgtgggtcacgcctttcaccagtggtgacaaaattggctgctttgccctcagcgaaccagggaacggcagtgatgcaggagctgcgtccaccaccgcccgggccgagggcgactcatgggttctgaatggaaccaaagcctggatcaccaatgcctgggaggcttcggctgccgtggtctttgccagcacggacagagccctgcaaaacaagggcatcagtgccttcctggtccccatgccaacgcctgggctcacgttggggaagaaagaagacaagctgggcatccggggctcatccacggccaacctcatctttgaggactgtcgcatccccaaggacagcatcctgggggagccagggatgggcttcaagatagccatgcaaaccctggacatgggccgcatcggcatcgcctcccaggccctgggcattgcccagaccgccctcgattgtgctgtgaactacgctgagaatcgcatggccttcggggcgcccctcaccaagctccaggtcatccagttcaagttggcagacatggccctggccctggagagtgcccggctgctgacctggcgcgctgccatgctgaaggataacaagaagcctttcatcaaggaggcagccatggccaagctggccgcctcggaggccgcgaccgccatcagccaccaggccatccagatcctgggcggcatgggctacgtgacagagatgccggcagagcggcactaccgcgacgcccgcatcactgagatctacgagggcaccagcgaaatccagcggctggtgatcgccgggcatctgctcaggagctaccggagctgagcccgcggcggactgccccaggactgcgggaaggcgcgggagccaggggcctccaccccaaccccggctcagagactgggcggcccggcgggggctccctggggaccccagatgggctcagtgctgccacccagatcagatcacatgggaatgaggccctccgaccattggcagctccgcctctgggcctttccgcctcctcaccactgtgcctcaagttcctcatctaagtggccctggcctcctgggggcggggttgtgggggggctgagcgacactcagggacacctcagttgtcctcccgcgggccctggtgccctggcatgaaggcccagtgcgacaggcccttggtggggtctgtcttttccttgaggtcagaggtcaggagcagggctggggtcaggatgacgaggcctggggtcctggtgttgggcaggtggtggggctgggccatggagctggcccagaggcccctcagccctttgtaaagtctgatgaaggcaggggtggtgattcatgctgtgtgactgactgtgggtaataaacacacctgtccccca

SEQ ID NO: 27590 - DNA, 1729 bp, Homo sapiens
  misc_feature (7)..(7): n is a, c, g, or t
  misc_feature (17)..(17): n is a, c, g, or t
  misc_feature (21)..(21): n is a, c, g, or t
  misc_feature (1527)..(1527): n is a, c, g, or t
  misc_feature (1532)..(1532): n is a, c, g, or t
  misc_feature (1541)..(1543): n is a, c, g, or t
  misc_feature (1546)..(1546): n is a, c, g, or t
  misc_feature (1561)..(1561): n is a, c, g, or t
  misc_feature (1583)..(1583): n is a, c, g, or t
  misc_feature (1585)..(1585): n is a, c, g, or t
  misc_feature (1632)..(1632): n is a, c, g, or t
  misc_feature (1725)..(1725): n is a, c, g, or t
cacgggnaggtcgcganctgnggaactgtgtctgtcgcccatggccgccgcgctgctcgcccgggcctcgggccctgcccgcagagctctctgtcctagggcctggcggcagttacacaccatctaccagtctgtggaactgcccgagacacaccagatgttgctccagacatgccgggactttgccgagaaggagttgtttcccattgcagcccaggtggataaggaacatctcttcccagcggctcaggtgaagaagatgggcgggcttgggcttctggccatggacgtgcccgaggagcttggcggtgctggcctcgattacctggcctacgccatcgccatggaggagatcagccgtggctgcgcctccaccggagtcatcatgagtgtcaacaactctctctacctggggcccatcttgaagtttggctccaaggagcagaagcaggcgtgggtcacgcctttcaccagtggtgacaaaattggctgctttgccctcagcgaaccagggaacggcagtgatgcaggagctgcgtccaccaccgcccgggccgagggcgactcatgggttctgaatggaaccaaagcctggatcaccaatgcctgggaggcttcggctgccgtggtctttgccagcacggacagagccctgcaaaacaagggcatcagtgccttcctggtccccatgccaacgcctgggctcacgttggggaagaaagaagacaagctgggcatccggggctcatccacggccaacctcatctttgaggactgtcgcatccccaaggacagcatcctgggggagccagggatgggcttcaagatagccatgcaaaccctggacatgggccgcatcggcatcgcctcccaggccctgggcattgcccagaccgccctcgattgtgctgtgaactacgctgagaatcgcatggccttcggggcgcccctcaccaagctccaggtcatccagttcaagttggcagacatggccctggccctggagagtgcccggctgctgacctggcgcgctgccatgctgaaggataacaagaagcctttcatcaaggaggcagccatggccaagctggccgcctcggaggccgcgaccgccatcagccaccaggccatccagatcctgggcggcatgggctacgtgacagagatgccggcagagcggcactaccgcgacgcccgcatcactgagatctacgagggcaccagcgaaatccagcggctggtgatcgccgggcatctgctcaggagctaccggagctgagcccgcggcggactgccccaggactgcgggaaggcgcgggagccaggggcctccaccccaaccccggctcagagactgggcggcccggcgggggctccctggggaccccagatgggctcagtgctgccacccagatcagatcacatgggaatgaggccctccgaccattggcagctccgcctctgggcctttccgcctcctcaccactgtgcctcaagttcctcatctaagtggccctggcctccttntttcnttttttttnnnttncttagctatactcanggacacctcatttttcctcccncnttccctttttccctttcattaattcccatttctacattccctttttnttttctttcttttcctttatttcagatttcattatcattttttttttcattattactattctttttttccttttttttttcattttttttttntttt

SEQ ID NO: 27591 - DNA, 404 bp, Homo sapiens
ttttgagacagggtctcactccgtctcccaggcgggagtgcagtggtgtgatcatggctcactgaagcctccaactcctgggctcaagtgatcccctcacctcagcctttcgagtagctgagactattgctacgaatggcaaaagccgcaattacctttgcaccaacctaatataagcgtgcgccaccacaccctgctgtaaaaaaaaaaaaaaaaaaggtttttttgtagagacagatttctttacattgcccaggctagtcttgaactcctgggttcaagcaatcctcccacctcggcctcccaaagtgctgggattacaggtatgagccactgtagctggcctatattgaaatttttgatccatctagaatttgtttgcatataagatgtgaggaaagaat

SEQ ID NO: 27592 - DNA, 450 bp, Homo sapiens
gcagaattgattctacacttgtaacacgggcatatttggctgttattgcctacgttatccattttgacacctcccctactctcaaagcccctgcatgtcactcgcttcctctgcttttccccttcagattatttcacccatgttctatttggtcatgacctgtatgtgtacctcatctaagtgatgctttatgaattccataaagccactcatctttgaggtctccaagaacagagactattccctaatgatccttttgtgcagtgttagttgttaaatgtgctaacggatgccagcgtttgaaaatggtgctgatccatgacctcttctgacaatgttagattcctatccttcagagtgagaattttaggcatgaggctgcttgaggtactgggttgcccaagacaaacctgatctccagggctgaagtatgggcatctatgaatcaat

SEQ ID NO: 27593 - DNA, 315 bp, Homo sapiens
gcatctttaaaataatcaaatgtccacctccaccttgccccattgtttactagatttagacttatgagatggagcagagaaaagcctcactgggatgggtggagggtcttggtcttgtcttttggccttgagactttaggtactttccatacccaccaatatgtctagactcagaggctaacatgactgctagtgctcaccttggccctttagttcctgtctaagcatggatagacatgagttagtataaaccctttaaaagtcacaaagctaaatctggttctacttgcttgggtccttatcggagctccactc

SEQ ID NO: 27594 - DNA, 378 bp, Homo sapiens
gtctatctctcttgaccagtgctgtggggccctcaactctgaccttctcagcaatggggatccactgattatcccctcccagtgaaacagtgaatctgccccttgcccatcagactataggcttgcccaagggtctcatgttaaaaataaataaataaaattcttcctcagcccctctctgggttctgctctgtatatcaatctttctacctagctaaacttcgtggaagccatgtctatcccaccattgccaattcttcacctcctgtccttcaaccccagcagtctgacttccaaactactactcccctgaaagtgctctccaaggtgacttttgtcttagtctgcttgggctactgtaacaaaataccatagact

SEQ ID NO: 27595 - DNA, 439 bp, Homo sapiens
tttttcaacctaatggcaagtgtgtgtgtgtgttcttggagtagttctgctggctatgaagagtatgtagtaatatgctaaagctttgtaaactcttcttttgttgttttggaagatggagtgttgctctgttgcccaggctggagtgcagtgatgtgattttggctcactagagtctccaccttctgggctcaagcagtcctctcacctcagcctccctggtttgtggaactacaggggcatgccagcatgcccggataatttttgtattttttttcttttgtagatacagagtctcactatgttgcccaggctagtctcaaactcctgagctcaagcagtcctcctgcctcagcttcctgaagtgttgggattacaggcatgagccattgcacctggccctaaattttaacagatacaaaactataagtttatactt

SEQ ID NO: 27596 - DNA, 440 bp, Homo sapiens
aattataaaaccaggaaactgacaatacaatccacagactacattcagatgtcaccagtgttacatgcattcatatgtgatcgcatgcatgtacagttctaagcaattttatcacatgctccatcacacgcagcaaaaccacaaaccccccccccacccccccaacaacccccaaaccacccccaacatgatagactttttctggtggcatctctttctcctccacttgccccttaaaccttggtgacagtactttgtttctatctctataattttgtccactacgaaaatattacagagatggaactgtacagtacacatctttttgagatcggcttttttctttttttctttttttttgagacggagtctcactctgttgcccaggctagagtgcagtggtgcggtctcggctcactgcaagctccgcctcctgggtt

SEQ ID NO: 27597 - DNA, 391 bp, Homo sapiens
aagatggaatctcactgtcacccagcctggagtacagtggtacgatttttagctcgttgcaacctccgcctcccaggctcaggtgatcctcctgccttagcctcctgagtaactgggaccacaggtgctcactacacccggctaattattttttgtatttttggtaaagatggggtttcgccatgttgatcaggctgttcttgaactcctgagctcaggtgatccagccccccttgacctccccaagtgctgggattacaggtgtaaacactacaccggcctgacttacttaaatgttatgtcttgaaaagctttatactattctttatattcaggcccatctctccctaactttattacttttgagacagtctcactctgtccccaggct

SEQ ID NO: 27598 - DNA, 328 bp, Homo sapiens
  misc_feature (26)..(26): n is a, c, g, or t
ctactactactaaattcgcggccgcntcgacgacagggtattggtatgttgccaggctggtctcaagcccctaggctcgggtgatcctcccgcctcagcctcccagagtgctgggattacaggtctgagccactgtgcctggccagactttgtaatgtaagaaagtgttgcctagatcctccatggactccagcctgtctagattattcctgctcttcagtgattagagtggtttctaggcttcttgatggcgcaaggatcacaaaaaattatttttatgctaacagtgaaaagattacagcaagaatggtttggagtaaaaaaaaaa

SEQ ID NO: 27599 - DNA, 465 bp, Homo sapiens
caccactccttgctaatttttgatttttttttgtagagatgggggggggtctcactatgttgcccaggctggtcttgaactcgtgggctcaagtgatcctccagcctcagtctgccaagtagctgggataacagacgtgtgccaccatgcccagctaatttatttttattttttgtagagacagggtattggtatgttgccaggctggtctcaagcccctaggctcgggtgatcctcccgcctcagcctcccagagtgctgggattacaggtctgagccactgtgcctggccagactttgtaatgtaagaaagtgttgcctagatcctccatggactccagcctgtctagattattcctgctcttcagtgattagagtggtttctaggcttcttgatggcgcaaggatcacaaaaaattatttttatgctaacagtgaaaagattacagcaagaatggtttggag

SEQ ID NO: 27600 - DNA, 333 bp, Homo sapiens
tttttccaaacactgaagtacggtttcttcttttgttatttttattttactttttttggagacagggtctttctctttcacccaggctgaagtgcagtggagccatcataactcattacaggttcaaattctcaaattcctaggcttaagtgatcctctcatataagcctcctgaatcactaggactacaggcacacactgccacgcccggctaatttttctctacgttttggagagacggggttttgccatgttacccaggctggtattgaactcctagcctcaagcaatccttccatctcagtctcccaaactgctgggattataggcgta

SEQ ID NO: 27601 - DNA, 381 bp, Homo sapiens
ttttgagacagagtctccctatgttgcccagactgcggaaatgcttttctttctctgccacatggccaggttgcaaattttccaaacctctatgttctgcttcccttttaaaaataaggtccaactttaagtcatttttttactcccacatctgagtgtaggctgttagaagcagccaggcgacatcttgaatgctttgctgcctagaaatctctgccagatatcctaaatcatcactctcaagttcaaacttccacagatccctggggtgtgaacacaatgcagccaagatctttgctaaggcataacacatgtgaactttgctccagtcccaataagttcctcatttccatctgagaccttttcagcctgaacttcact

SEQ ID NO: 27602 - DNA, 401 bp, Homo sapiens
ctactactactaaattcgcggccgctcgactttttttttgagacggagtctcgctctgtcgcccaggctggagtgcagtggcgggatctcagctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccagagtgctgggattacaggcgtgagccaccgcgcccggcccagagctcttcttgagtgactccgcagtgtatctcctaggctgaaataaagcatctttcacaaatatatgacatttcatgg

SEQ ID NO: 27603 - DNA, 643 bp, Homo sapiens
attttgttactggattattcaagtgacataatattctcaatgtttatcttaaaatgtgacaagattgttttatttaaggtggaataatattccattttatgtatatgttatattttttgacgtatttttaaatcaagagacttctgggttcaagcgattctcctgcttcagcctcccaagtaactgggattttaggcgcccacgaccatgcccagctagttttttgtatttttagtagagacagggacagcctggtctcaaactcctggcctcaggtgatctgcccctaccttggcctcccaaattgctaggattacgggcttgagccactgtgcctggctttttttacgtattttggatatagatttataaatgagaaacatttataactttttaaaataatgactgcacctttgttatccaccaacattcaacttaggtttcatttttattgcatcatcaacagatttggtgtttttaaaaaaatttatagtggccattctaatgtgtgtgaggtgattttgtttgtcattgtgtttttttttttcatttctctataaactagtaattttctgtgtcctttcaaatgctttttctcatttgtgtacttttctaataaaaatttcatttgtccatttctaaa

SEQ ID NO: 27604 - DNA, 407 bp, Homo sapiens
gaagaatatagctggcaaagacaattccaaaaatatagtgtatacccatttttactttctgggtagagtatctaaggaactataaaatggccctagaaacaacaggaatgaagaatgggcctggtaattgttttcacccagtgaccagcttctgaataagtaacagttatagactgcaaatttaaacctagagtgactgattttacccacagcattttctttctccttacgattattgccttcacactaagaatttattatttattgaaatcatctgtatcaagtagcatcaaatttattttatcttgccagtttttatagatccacttttagtgtacactcttaagtagaaaatagaattttcttgcagttttaaaaatcctttatactgtggaatctctaataat

SEQ ID NO: 27605 - DNA, 427 bp, Homo sapiens
aaaaagaaatgccacagtgcttcagggaaccaggctgtgttcacacctgggttttcacaggacagagatttttagctttaaggctttggagatttggagaaaggagatttcagaaatcattagccatgttcctgccagcctcagcaggccagctaagaacagtgtgttccttaagggcaggaacaaattccttccacatgttttggtgtttttgtttcttcttaacgtgctatcagtgatgccatgggccaattaactttgggacttaaaatgtgacgatatctcatttattctacaccgttgctaaataagatgatcatgggataaaattttccaggtaactggactgtcatcctttgagaactgtattttaaaaatggaaatgtatctggactccattcagtgaataaaaacaataaagactgtt

SEQ ID NO: 27606 - DNA, 400 bp, Homo sapiens
cggagatgcagaattgtagatacccttcagtgtggttcaggacagtgtgttcagcgtttggccgccgttcagtaaattctgcatgaagcagtttgagctcgtggttttggatttacttttcaggagtatgttttccagtggaataaggcttactactgaatgggagctttctttgcctctctgagtgtagacaggagtgtttattttcattgtcttcccattttgttagattgtggacaagggaaaagttaaagcatattttggttaagtatttttaatagtctgggattctatccacctcctccataagggtttttactttagagaattataaagtaattttctaaagggagctgcttctcttggtgtttgaatcaaaagccaagaatcgacttgaaaa

SEQ ID NO: 27607 - DNA, 5458 bp, Homo sapiens
cggctcggccgcggggcgcgcaggcggctgctgggcggcctcggtgcgcgcctcccgccttcccagagacgtggcgcgaggcccgggccctgagcacctatcgcggggatccccggcgccaggagggggtgcagccggtgggcagcgccgcgcagggaggggccgcagcatcctcgccccccagcgcgcccgggcccgagaggaggaggccggggctctccgggcctcccgccgcttagcctgatgctggaaggacgaaggtgagtgaagatggcagagaggacgtgaccagcactcacccttgtccacctgcccagtggcaccgccatgcagaagcccagcggcctgaagccccccggccgtggggggaagcactccagccccatgggccggacatctactgggtcagcttcatcctcggcggcggtggccgctagctccaaggaaggctccccactgcacaaacagtcatctggaccctcctcctccccggccgcagctgctgcccccgagaagccgggccccaaggcggcggaagtgggggatgacttcctgggggactttgtggtgggcgagcgggtgtgggtgaacggcgtgaagccaggcgtggtgcagtatctgggagagacgcagttcgcaccgggccagtgggctggcgtggtgctggacgacccggtgggcaagaatgatggcgcggtgggcggcgtgcgctacttcgagtgcccggccctccagggtatcttcacgcggccctccaagctgacccggcagcccacggccgagggctcggggagtgatgcccactccgtggagtcgctgactgcccagaacctgtcattgcattcgggcacggccacgcccccgctgaccagccgcgtcatccccctgcgggagagcgtcctcaacagctccgtgaagaccggcaacgagtcgggatccaacctctcagacagcggctctgtgaagcggggcgaaaaggacctgcgcctgggggaccgcgtgctggttggcgggacgaagactggcgtggtgcggtacgtgggggagacagactttgccaagggcgagtggtgtggcgtggagctggacgagccccttgggaagaatgatggggcggtggcgggcaccaggtacttccagtgcccacccaagtttggtctcttcgcgcccatccacaaagtgatccgtatcggcttcccatctaccagcccagccaaggccaagaagaccaagcgtatggccatgggtgtgtcagcactgacccacagtcccagcagttcctccatcagctccgtcagctctgtggcctcctccgtggggggtcggcccagccgcagtggcctgctcacggagacctcttcacgctacgcccgcaagatctcgggcaccacggccttgcaggaggcactgaaggagaagcagcagcacattgagcagctgctggctgaacgagacctggaacgggctgaggtggccaaggccacaagccacatctgcgaggtggagaaggagattgccctgctcaaggcacagcatgagcagtatgttgcagaagccgaggagaagctgcagcgagcccggctgctcgtggagagcgtgcggaaagagaaggtggacctgtccaaccagctggaggaggagaggaggaaggtggaggatctgcagttccgcgtggaggaggagtccatcaccaagggagacctggagctgaccacagtggccgagaagtcgcgcgtgctgcagctggaggaggagctcaccctgcgccgaggtgaaatcgaggagctccagcagtgcctgttgcactcgggtcccccacctccggaccacccagacgccgccgagatcctgcggctacgggagcggctgctctcggccagcaaggaacaccagagggagagtggggtgctgcgggataaatacgagaaggccctgaaggcctaccaggcggaggtggacaagctccgcgcggccaacgagaagtacgcacaggaggtggcgggcctgaaggacaaggttcagcaggccaccagcgagaacatggggctaatggacaactggaaatccaagctggactcgctggcctcggaccaccagaagtccctggaggacctcaaagccaccctgaactcgggcccaggcgcccagcagaaggagatcggcgagctgaaggcagtgatggagggcatcaagatggagcaccagctggagctgggtaacttgcaggccaagcatgacctggagaccgccatgcacgtgaaggagaaggaggccctgcgagagaagctgcaggaggcccaggaggagctggctgggctgcagcggcactggcgggcccagctggaggtgcaagccagccagcaccggctggagctgcaggaggcccaggaccagcgccgggatgccgagctgcgtgtgcacgagctggaaaaactggacgtggagtaccggggccaggcgcaggctatcgagttcctcaaggagcagatctcgctggccgagaagaagatgttggactacgagcggctgcagcgggcagaagcccagggcaaacaggaggtcgagagtttgcgggagaagctcctggtggctgagaacagactccaggcggtcgaggccctgtgctcctcccagcacacccacatgattgagtcgaatgacatttcagaggagacgatcaggacgaaggaaactgtggagggcctgcaggacaagctgaacaagagggacaaagaggtgacagccttgacctcccagaccgagatgctcagggcccaagtaagtgcgctggagagcaagtgtaagtcaggcgagaagaaggtggacgccctcctgaaggagaagcggcgcctggaggcagagctggagaccgtgtcccggaagacccatgacgcctcgggccagctagtcctcatcagccaggagctgctgcggaaggagcggagcctgaacgaactgcgggtgttgctgctggaggccaatcgtcactccccagggccggagagggacctgagccgtgaggtacacaaggctgagtggcggatcaaggagcagaaactcaaggatgacatccggggcctgcgtgaaaagctgaccgggctggacaaagagaaatccctgtcggatcagaggcgctactccctcatcgacccgtcctcggcgcccgagcttctgcggctgcagcaccagctgatgagcacggaggacgccctgcgggatgcgctggaccaggctcagcaggtggagaagctgatggaggccatgaggagctgccctgacaaggcccagaccatcggcaattccggttctgcaaacggcatccaccagcaggacaaagctcagaaacaagaggacaagcactgatcctgaggggatactgtggagcagcccagtccacaccagagccccacgcggctgcccggcagtacctcctccaggcaggagccgggactgtcactttggagacaaaacagtgtttgtaacaataacgtactcaccgccgcggacaatcccccaccccgatccctcgccagaccaggacgcttcctcaagcccagccttctacagagagtgtgaacggtacagccctggcctgacccggggaccttcagcctggacacccggcagcttctggagtttgtcagtggaggcagaggggatccggccaggcccctctgtccagaaggagctgccctgaggaccatcttagcggccctgtcctctttttccgcccattctccctcgggtctccccagaggggccggcgggggctggggagggggtaagtttatccatgcagacaccaagggggagcatccagtctttaagagccaagtgggggccccttttccgaagccacttccaggccaaggcagtcgccagggcttcttgtccccaccttctgaaccttcttcaaacagtagtacaagctcccctcagccagcctgcctgcccagcgaggcccccaggttcaaggtgttggcgggggcggagggcaggggaacgggatccttctcccgctgcccaccaacaccaacacacacacacctctaagctgctggccgaagatgtcaccaaggccaaagacacagtattatgaaggtttggaaacccctctcctcacctcccaccgtgaccttgggcaaaccctggctcggagcccagggcagaggcagctcagagtggaggctctaggcaggtttgacaaaggtcagtaatacggtttcccctggggttgaccagatgttccaaaatatctgcatccacctggagatgcagctaagtgggtccttatgtacacaccacgttcacacacacacagagggaccacgtgtgcacgcatgaccgtgtgggtggcggcgtttgctgtgaaccatgctcaggccacacagagacacatacttggtttctgggactgagacccaggcctggcaggaccgtgcctacagatactgcaaacgttcctacagcctagaggtgcgtatacacacccaagtacacgcagccaggcattcaggggtgtgtttgccacatggagcatcccttcctggtcttgccaggcacctgcacagagcgtctccagccccatctcctaacgggggctgggggtaagagaaatctaactgcgctcccccaacccctcgccctgccatcttcccctcaagcctgctaagttatcccaggcctgtgcgtggtggaaaaagccagccttggccctgcagcctccacctcgccgctgggggaccaacaggttgcttacagctttgcaccccggcatcagcacaggggtccctgccccaccctccggcagctcagggagtgttttcctgtgaggcctcccccatcagtggaccagagggagaagcccgatgccccatcccggctttcccgtaacgcacaggacacgtgtgcaattcataggaacggcccagatcgccctcatgagtgccacctggtacaggtaggtggcgctcacgttcctgcccaaatgcagcccatcggggagtcacagtcagtccccccggcccccctcccagtccctgttggctttcggtagctctcgcatgcagttctattaacagccgtctagaagcgatgctttagtggcctaacccagggtcaaatacagctctttctagcaaaatcaggcagctctgccccatcggtaggggcaccgattagtctactaacagccagaggtccatctaggagggtgccgggaggagctgagcccccggaggtgggctcctggtgacgggtgtccaagaagcggtttccttgggagcttctgcctccgtgggcctctcagcccgccccgtgtggccgcccgggtgtggctcagccatgtcccctccccaggtccttcattcacccctcccctccccacagtggaattgttgaagtgtggcgagtctgtgctcgggacaataaagcttgtgacaggtccaggaaaaaaaaa

SEQ ID NO: 27608 - DNA, 362 bp, Homo sapiens
gggggaaaaaaaaaaagaatatatttttgtactggggtgtggtaaaagtatacagttcattttagtatttaatttattgaaaacatgagtcatcatacaaagcctagcataaaattatcatttgaaacatgtagaacccagaatttgctaatttttatgaatatgcattcacaaatagaacttaacataatctgttaagacattcactattattttgattttctgaaatattgacttaaaatgtaagagaatgcattttgcttaaaagtggctgctgtatttcagatgctggattatgaatgaattactgtgttgttagttcaaaatctcaaagcaaatgtaataaatttgtgtttaaaagt

SEQ ID NO: 27609 - DNA, 394 bp, Homo sapiens
tacttttcaaatcatatccatcaatttgcaaactctgtgaactccaacattactggcacaccaaaacccactttatcttaatacttaaaaattccagttcatgttgcttggataactttgaatgaaagacgttgtcttgtttcatgttacagtgaaagagcttatctcatattatagtgaaataatactgacaatgaatgaagattaagctgattccacacattacagaaaatacacaaaactgcacaaaaatttttctcaaatggttttgcaaggagagaggataaaataagtgccagaaagcagtttgccaatatcatttgtcattctgtgttcttgtgatattcatatgtaaaatacatgcagtttgtaaggaaataatgggttatattcc

SEQ ID NO: 27610 - DNA, 253 bp, Homo sapiens
aaatcagtgaaagtcctcagggcgaagtcaggtatctgagtagctcccttgagtacctcactagattttggcctagcacttcctcataatttgttctcttttttttctgaaatgttttgcttattttatttaacatttttagttttagttttcttctctaagtgggttcaattgaggccgggtgcagtggttcctgcctgtaatcccagcactttgatatgctgaagtggaaggattgcttgcggccaggagc

SEQ ID NO: 27611 - DNA, 2260 bp, Homo sapiens
attgattggagagatgcctcaagaagatctgcacgcggtggtgaagaattgcttcgcggtggtgaatagctctgtctctgaaggcatgtcagctgcaattttggaggcaatggatttagaagtaccggtattggccaggaacatccccgggaatgctgccgtggtgaagcatgaagtcacagggctactgttttccaatcctcaggagtttgttcatctggcaaagagactggttagtgatcctgcattagaaaaggaaatcgtagtgaacggaagggaatacgtgagaatgtatcattcatggcaggtggaaagagacacctaccaacagctcatcaggaagctggaaggaagcactgaagattgagggccccgcctcatcagacacctgctctctgacacacagctctgggtgcacactcagagacagagttctggatcacgtgggcccagtgcagttcaaataaaaccagcctcagcggaatcctagaaaatgttagtcgtgagtccccagagccactgcattcatcccatatccttctgtgcgttcagatgctgtcccaggcgtgttcaccagccagtcctgatggaggtgcatgagtgactgggttgactgggacagggaaaggggaactggttttcagggaatttgggagagaatttgattacctgccttagggctttggtgtggacaatagaggcttattttcaagcagtcatggttcagactcctcccgcctgccttctgaccaacctctccccatcgttgccagtttgaaaggcaaaagcaaaacagacgtgtcagctgagccgagtcctcgcaggatttttgttgtgatctcaggactctgacaggcacgtgggtgacccgaggcttctctgaacactagaaagcgctgtgagtgagctcacgcccggcacagctcacttttcaatggtggaattgaaagttgtgctttttagaaaagtggccaggctgcccgcaggccccgcccacctcttggctgaatttgagtggaaaaccaggaaggaacaagcgccacgtcacgcatagcctgcaaatcgcccgcgtgaccctgagatggaggcctgaggctttgggtccagggtgggctcttccccttcccacatcagggacccggggatggatgtcggaagggtcaccagcctccagcctttggcaggatggagcttgggtctgcagggctttgcagccacacagcgaggtcagtccggggccagccgcgccatcatggtaatggtggcctcgccccatccatgtcatccatgtcacatgaggacgtgcagtcttccttgtcctctcctagtggaatttgcctgggagaacctccactgaatactgaaattgttgcatgcctgtggattccttacgacaatggggaacgcggtgtttcccacctcttgtgggtagaaagcagtctgctttgaggaggcgagaaggcaaagccagggcagggcgttgctgtgggaagcgttcggtgaaagcgggtttcgacgcttaggagggccgagggagaagattccaccagcattgtccttgcttcaagttttaggatgtctgaactttcagctttcatgttttcaaccatcatttttttaatggcacaacctacatcttgtttttaaaagaagtagcctcaaattaaactccttaaactctgatgccctggggatgagaacaactagcttggatctcgtgccgtgtaattcaatgtttcattccgctgcctccatcatgtaatagaatcgctttccagaaaggcagttaactggaagcagcagaggctcccagccgtgagaggactgctcaacaatgccccccatcgccgcccccccacccctcgcaccccttgtgttttccctctgaggggcccaagggttatggctttcatgtctaggtgtggggacagaggagggagaggcagatcctgggccgggagaggatggcctggtctgaatctggagtaattaatgccacccaaagaaaaggccctgccaggtccaatgttgtcttagatctgatgatgctgctatttacaaaacactgatcgtccgaaagcttgaatctgttcctcctcgaatgaccctgtagatgcctgacctccaccgtacctccacatcactattcatgtccttctaggaaaatgtgcacatgcctcacgcactatgtgggaagggcgtgtttttaaattaataaagtgtgtcaccattaacaaaaaaaaatagcctctctttcttc

SEQ ID NO: 27612 - DNA, 521 bp, Homo sapiens
ggacatgcccatgacgaggctgttgatggccacatgtatagcacatacccacagtgaggacaacggtcacacgtaatgggacagtcccatgaagaggctactgactgtcacgtcaggacatgatcaagtatatctggacgtgcacatgacaaggttgttaatggacacatatataagacctgcccatgaagaggctgttgatggtcaaccagggcttgtgcccagaacatgccccatcaaaccccaacacactcctgctcccctcctgccgcgctcgaggccctgccccatcatcccaccgacagtactcctgtggcctgtggggtcagcagggccacctgtcaatgagtgcacagtcaccaagagggtaaaataaacacagagctgacacagccagtgcctggcagagccagcagcagaccctggtcacctcactaccgctctctcctcacttggatgaaatgcaggagtaaagtcaaagtggagacgtggaaaaccagaggcagcacacgcacacacat

SEQ ID NO: 27613 - DNA, 235 bp, Homo sapiens
cttggctgggattccctgggggcagagaggtgagatgtgttcacagccaggaggtcacagccctcctgactcaggtagggtggaacagactgggtaggtggcatcttggattctgactttgctctcttaatctatggtcttatttacggctggcttcatggacattcacctgtacaatcacacagaagtgccatcttaaaattccttgtaatattgaacaaggaactctgtgttt

SEQ ID NO: 27614 - DNA, 567 bp, Homo sapiens
ctctgtgttccgcccacccagatcctggtccacatcggcttcctgacggaggagtccggggacgtgttcagccctcgggtcctgaagggcgggcccctaggggagatggtgcagtgggcggacattctgactgcactctatgtcctgggccatggcctgcgggtcacagtctccctgaaggagctgcagagtaacttaggggtaccgccaggccggggaagctgcccgctcaccatgcccctgcccttcgacctcatctacaccgactaccacggcctgcagcagatgaagcggcacatgggactctccttcaagaagtaccggtgccgaatcagggtcatcgacacctttgggacggaacctgcgtacaaccacgaggagtacgccacgctgcacggctaccggaccaactggggctactggaacctcaaccccaagcagttcatgaccatgtttcctcatacccccgacaactccttcatgggcttcgtgtccgaggagctcaacgagacggagaagcggctcatcaaaggcggcaaggccagcaacatggccgtggtgtacggc

SEQ ID NO: 27615 - DNA, 2797 bp, Homo sapiens
  misc_feature (2756)..(2756): n is a, c, g, or t
tccctgaaggagctgcagagtaacttaggggtaccgccaggccggggaagctgcccgctcaccatgcccctgcccttcgacctcatctacaccgactaccacggcctgcagcagatgaagcggcacatgggactctccttcaagaagtaccggtgccgaatcagggtcatcgacacctttgggacggaacctgcgtacaaccacgaggagtacgccacgctgcacggctaccggaccaactggggctactggaacctcaaccccaagcagttcatgaccatgtttcgggaaggagaagttcctgggcatcctgaacaaatacatggagatccatggcaccgtgtactacgagagccagcggccccccgaggtgccagcctttgtgaagaaccacggcctcttaccgcagcctgagtttcagcagctgctgcgcaaggccaaactcttcatcgggtttggcttcccctacgagggccccgcccccctggaggccatcgccaatggttgcatcttcctgcagtcccgcttcagcccgccccacagctccctcaaccacgagttcttccgaggcaagcccacctccagagaggtgttctcccagcatccctacgcggagaacttcatcggcaagccccacgtgtggacagtcgactacaacaactcagaggagtttgaagcagccatcaaggccattatgagaactcaggtagacccctacctaccctacgagtacacctgcgaggggatgctggagcggatccacgcctacatccagcaccaggacttctgcagagctccagaccctgccctaccagaggcccacgccccgcagagcccctttgtcctggcccccaatgccacccacctcgagtgggctcggaacaccagcttggctcctggggcctggccccccgcgcacgccctgcgggcctggctggccgtgcctgggagggcctgcaccgacacctgcctggaccacgggctaatctgtgagccctccttcttccccttcctgaacagccaggacgccttcctcaagctgcaggtgccctgtgacagcaccgagtcggagatgaaccacctgtacccggcgttcgcccagcctggccaggagtgctacctgcagaaggagcctctgctcttcagctgcgccggctccaacaccaagtaccgccggctctgcccctgccgcgacttccgcaagggccaggtggccttgtgccagggctgtctgtgaatccgcctctgccgccctgcctggcacccacgctggctctctcctgccgcgggagaaagcaccagcaggttctgagccctggctgcttgtcctcctcgcaacccccccaggccggagcttccttccttagccgggaagctggcagaggagagccgtgcccgggaataggaggaggcagcatgccgagcccctgggacctcccaggcaggctccggttctctcctggggactcacagcagcatcgtggccaagcaggtgtcggactgctcagagtccgcatggcccaggagcaggtggtcggaggcccctggctttgtgcaaggccggatctgggccaggtggcgaaaggggcccagtcgttcttgggcccaggatggggcctctagacttgcaagggagaggaacagggaccaggctgccccacggtccctgaagggtccaaggaggggccctccccatggccctggagagtgggcctgggtggtacctgctccaggcagggaaactgggggctcgcccttctcctgtgaggggagccaggcacacagggcccattggtgtttgggatgtggacagaggggcagggggctgggagaaggctaagccgaggggtcctgtttgtgcctccccttagtcccttccctcccgatttcccgattcccccaccctccctctacacttgaggaccacagttgggggtgtagggaccacccagaccctggttgaattgtttctctctcctgcttgttccaacccttttcactctgggcttctcccaaaacccatcctggcatgacctgcaactccaggtggtggatttgttccaaagcctcaatccctaccccctccaaggggcaggtttccagtccagcctcagagatcaggctctgggacccctgcctggggggtggccttcatgcaccagccacttccgcaggtgctgactcccgcactccctggcattttttgcagacaagggcttgggatggaccctcagccccatggtacgccctgcccagtttccagatgccctgtccacttaccctaggtagccccccaccccatcagtgccgagtccttgtccctacctccagcttcctccagcctcaaaccgcctctggatctagctgtccttctccgagtggcacgcctgccccaggatgccccctttccctcccccccatgcccagagccccgcctgcctcagcgggtcaggccttcagaacactgccacccacccagttttataatcccgctccctctccaggcaaccccacccaccagcctaggcctgctcctccacccttcccgggaggcagccccgggatgctgagagttggtggaggggccaggctggacgcttcctgtgggagtcccctccagacctggctggcccctgcagccacagaaaccacgatggcaaaaaatctcattggttctcaaggactaacctgtgggggaaagcaatagagacactctttttctctctttttttaaagatttatttcatcacctgagnatatttactggatgtggtcagttttctgcccgcgtcttggt

SEQ ID NO: 27616 - DNA, 2214 bp, Homo sapiens
cggctccctgggcatggcacaggatgtgagagcccaccagacctccacccccaatgccgagcatggcagggcccccgacggctgggccttctcccgccccatgtgtctgcccatccctcccacaggtagacccctacctaccctacgagtacacctgcgaggggatgctggagcggatccacgcctacatccagcaccaggacttctgcagagctccagaccctgccctaccagaggcccacgccccgcagagcccctttgtcctggcccccaatgccacccacctcgagtgggctcggaacaccagcttggctcctggggcctggccccccgcgcacgccctgcgggcctggctggccgtgcctgggagggcctgcaccgacacctgcctggaccacgggctaatctgtgagccctccttcttccccttcctgaacagccaggacgccttcctcaagctgcaggtgccctgtgacagcaccgagtcggagatgaaccacctgtacccggcgttcgcccagcctggccaggagtgctacctgcagaaggagcctctgctcttcagctgcgccggctccaacaccaagtaccgccggctctgcccctgccgcgacttccgcaagggccaggtggccttgtgccagggctgtctgtgaatccgcctctgccgccctgcctggcacccacgctggctctctcctgccgcgggagaaagcaccagcaggttctgagccctggctgcttgtcctcctcgcaacccccccaggccggagcttccttccttagccgggaagctggcagaggagagccgtgcccgggaataggaggaggcagcatgccgagcccctgggacctcccaggcaggctccggttctctcctggggactcacagcagcatcgtggccaagcaggtgtcggactgctcagagtccgcatggcccaggagcaggtggtcggaggcccctggctttgtgcaaggccggatctgggccaggtggcgaaaggggcccagtcgttcttgggcccaggatggggcctctagacttgcaagggagaggaacagggaccaggctgccccacggtccctgaagggtccaaggaggggccctccccatggccctggagagtgggcctgggtggtacctgctccaggcagggaaactgggggctcgcccttctcctgtgaggggagccaggcacacagggcccattggtgtttgggatgtggacagaggggcagggggctgggagaaggctaagccgaggggtcctgtttgtgcctccccttagtcccttccctcccgatttcccgattcccccaccctccctctacacttgaggaccacagttgggggtgtagggaccacccagaccctggttgaattgtttctctctcctgcttgttccaacccttttcactctgggcttctcccaaaacccatcctggcatgacctgcaactccaggtggtggatttgttccaaagcctcaatccctaccccctccaaggggcaggtttccagtccagcctcagagatcaggctctgggacccctgcctggggggtggccttcatgcaccagccacttccgcaggtgctgactcccgcactccctggcattttttgcagacaagggcttgggatggaccctcagccccatggtacgccctgcccagtttccagatgccctgtccacttaccctaggtagccccccaccccatcagtgccgagtccttgtccctacctccagcttcctccagcctcaaaccgcctctggatctagctgtccttctccgagtggcacgcctgccccaggatgccccctttccctcccccccatgcccagagccccgcctgcctcagcgggtcaggccttcagaacactgccacccacccagttttataatcccgctccctctccaggcaaccccacccaccagcctaggcctgctcctccacccttcccgggaggcagccccgggatgctgagagttggtggaggggccaggctggacgcttcctgtgggagtcccctccagacctggctggcccctgcagccacagaaaccacgatggcaaaaaatctcattggttctcaaggactaacctgtgggggaaagcaatagagacactctttttctctctttttttaaagatttatttcttgaaataataaatattttattgggatgtgaggtgcagaagaggaactgt

SEQ ID NO: 27617 - DNA, 2795 bp, Homo sapiens
tccctgaaggagctgcagagtaacttaggggtaccgccaggccggggaagctgcccgctcaccatgcccctgcccttcgacctcatctacaccgactaccacggcctgcagcagatgaagcggcacatgggactctccttcaagaagtaccggtgccgaatcagggtcatcgacacctttgggacggaacctgcgtacaaccacgaggagtacgccacgctgcacggctaccggaccaactggggctactggaacctcaaccccaagcagttcatgaccatgtttcgggaaggagaagttcctgggcatcctgaacaaatacatggagatccatggcaccgtgtactacgagagccagcggccccccgaggtgccagcctttgtgaagaaccacggcctcttaccgcagcctgagtttcagcagctgctgcgcaaggccaaactcttcatcgggtttggcttcccctacgagggccccgcccccctggaggccatcgccaatggttgcatcttcctgcagtcccgcttcagcccgccccacagctccctcaaccacgagttcttccgaggcaagcccacctccagagaggtgttctcccagcatccctacgcggagaacttcatcggcaagccccacgtgtggacagtcgactacaacaactcagaggagtttgaagcagccatcaaggccattatgagaactcaggtagacccctacctaccctacgagtacacctgcgaggggatgctggagcggatccacgcctacatccagcaccaggacttctgcagagctccagaccctgccctaccagaggcccacgccccgcagagcccctttgtcctggcccccaatgccacccacctcgagtgggctcggaacaccagcttggctcctggggcctggccccccgcgcacgccctgcgggcctggctggccgtgcctgggagggcctgcaccgacacctgcctggaccacgggctaatctgtgagccctccttcttccccttcctgaacagccaggacgccttcctcaagctgcaggtgccctgtgacagcaccgagtcggagatgaaccacctgtacccggcgttcgcccagcctggccaggagtgctacctgcagaaggagcctctgctcttcagctgcgccggctccaacaccaagtaccgccggctctgcccctgccgcgacttccgcaagggccaggtggccttgtgccagggctgtctgtgaatccgcctctgccgccctgcctggcacccacgctggctctctcctgccgcgggagaaagcaccagcaggttctgagccctggctgcttgtcctcctcgcaacccccccaggccggagcttccttccttagccgggaagctggcagaggagagccgtgcccgggaataggaggaggcagcatgccgagcccctgggacctcccaggcaggctccggttctctcctggggactcacagcagcatcgtggccaagcaggtgtcggactgctcagagtccgcatggcccaggagcaggtggtcggaggcccctggctttgtgcaaggccggatctgggccaggtggcgaaaggggcccagtcgttcttgggcccaggatggggcctctagacttgcaagggagaggaacagggaccaggctgccccacggtccctgaagggtccaaggaggggccctccccatggccctggagagtgggcctgggtggtacctgctccaggcagggaaactgggggctcgcccttctcctgtgaggggagccaggcacacagggcccattggtgtttgggatgtggacagaggggcagggggctgggagaaggctaagccgaggggtcctgtttgtgcctccccttagtcccttccctcccgatttcccgattcccccaccctccctctacacttgaggaccacagttgggggtgtagggaccacccagaccctggttgaattgtttctctctcctgcttgttccaacccttttcactctgggcttctcccaaaacccatcctggcatgacctgcaactccaggtggtggatttgttccaaagcctcaatccctaccccctccaaggggcaggtttccagtccagcctcagagatcaggctctgggacccctgcctggggggtggccttcatgcaccagccacttccgcaggtgctgactcccgcactccctggcattttttgcagacaagggcttgggatggaccctcagccccatggtacgccctgcccagtttccagatgccctgtccacttaccctaggtagccccccaccccatcagtgccgagtccttgtccctacctccagcttcctccagcctcaaaccgcctctggatctagctgtccttctccgagtggcacgcctgccccaggatgccccctttccctcccccccatgcccagagccccgcctgcctcagcgggtcaggccttcagaacactgccacccacccagttttataatcccgctccctctccaggcaaccccacccaccagcctaggcctgctcctccacccttcccgggaggcagccccgggatgctgagagttggtggaggggccaggctggacgcttcctgtgggagtcccctccagacctggctggcccctgcagccacagaaaccacgatggcaaaaaatctcattggttctcaaggactaacctgtgggggaaagcaatagagacactctttttctctctttttttaaagatttatttcttgaaataataaatattttattgggatgtgaggtgcagaagaggaactgt

SEQ ID NO: 27618 - DNA, 359 bp, Homo sapiens
ctcccaagtagttgggattacaggcccgcatcaccatgcccagctaatttttgtatttttagtagaggcggggtttcaccgtgttagccaggatggtcttgatctcctgaccttgtgatctgcccgcctcagcctcccaaagtgctaggattacaggcttgagccaccgcacccagccaacagtcactcttaatacctcagcccagaagtgacactgattgattcttctcacaggccgttggccaaaactagtcacatgacctatctcaccatcaggggcgggaaagaattcactgagttcacgttcttgcagcacaagccctgacctgccgctggcagtgctggggagccaggggtcc

SEQ ID NO: 27619 - DNA, 398 bp, Homo sapiens
actccatctcagaaaaaaaaaaaagcccggcacagtggctcacgcctgtaatcccaacactttaggaggccgagacaggcagatcacaaggtcaggagattgagaccatcctggctaacatgatgaaaccccatctctagtaaaaatacaaagaattagctgggcgtggtggcaggcgcctgtagtcccagctactcgggaggctgaggcaggagaatggcatgagctggaaggcggagcttgcagtgagccaagattgcaccactgcactccagcctgggggacaaagcgagactccgtctcaaaataaaaaaaaattgtatcgccaccaaatgctgaggagatcactcatacacgtgaaatgttcctgcttagaaaaacagtttggcagattaaaa

SEQ ID NO: 27620 - DNA, 279 bp, Homo sapiens
actgttaacttcccagttgtggacatagacgagagctagaaaatgaaaattaagtcaattaaaacattccctctggatatcacagacaagcttctttctcaaaagattttctgttcacactttgttgacttgcaaggtttggatgggtaacacccagcatgacagatgataaaaaaacgacagttttcttcacttgttcacaaagtttgcactgtgattttgcatcagactcccatttgggaaaactttgatgttgctttatacctcccccttaacaca

SEQ ID NO: 27621 - DNA, 751 bp, Homo sapiens
tgttcttaagagacccaacattttccttttttttctctggaatcaaatggagtcaccttagatgaccatttaccctctagcagtggtaaacctagtcttttggatacttgaaagaatacccctttatgctggctggagggaggatgaaatttggaaaagactaaattagattcaaacttgttagggtatttagttactaggagcaccagaaaggcttatttataaatcgccataccgtacctaagccgccagggagtgggtcaggctgatgctgctgcacgttttactgccccaggctggggcgtcccatggtgcggccgtcggtaacccacaacagggcttgacagtgctgtctcaggaaatgcttccatctgaccagacatctttcgttgaggggcaaaaattagatatgactactgttctctctgatgtggatatggagaatgattgatcatactttacatgatacatagctgtatattaacagttcatcagtaggttgcttctgagccttctcgtttatacactattcgatctgtattgtgatttattatttgtttcattattattgttattaatttattattgaagtttattttaattataatattgtgtaagtctatgttatagtagcatggcatggtggcaccctcctgtatttccagctattcgggaggctgaagtgggaggatcgcttgagcccaggagtttgagtccagcctaggcaatgtatcgagaccctaaaaaaaaa

SEQ ID NO: 27622 - DNA, 614 bp, Homo sapiens
  misc_feature (76)..(76): n is a, c, g, or t
cagtactatgttttgctcatcatcactgatgggggtcatttctgacatgacgcagaccaaggaggccatcgtcagngcctcctcattgcccatgtctatcattatcgtcggtgtaggaccagccatgtttgaggcaatggaagagttggacggtgatgatgtgcgcgtgtcctctaggggacgctacgcagagcgggacatcgttcagttcgtcccattccgagactatgttgaccggtcggggaaccaggtgttgagcatggcccgactggccaaggatgtgctggccgagatcccggagcagctgctgtcctatatgcgcaccagagacatccagcctcggcccccaccccctgccaaccccagcccgatcccagctccagagcagccctgaggattccacatatccaatgcctcacagtctgcaagcctgctcacccactgcttctgctttaagccagaggcacctggaaccctggacttcactgggagggccaacttggaggatcagtgctggctgacaagccctccgcctccttgcctgcagagggcctggcactatcaccacctctctgccttcatgccaataataaagctgatctttattccaaaaa

SEQ ID NO: 27623 - DNA, 356 bp, Homo sapiens
gagcactgcggtaccgtggaaggggtttcggcgttttttttttgaaaattttttttaaatgttttttttttaagacagggtcgtactttcacccaggccggagtgcagtggcgtgatctcagctcactgcaacctccacctcctgtgctcaaggaatcctccaacctcagcctgctgagtaactgggactacaggcacatatcaccacaacagctaatttttgtattttttgtagagatgtggttttgtcatgttgcccaggctgcagtatttttttttttttaatttttaaatgttacatatttaggctaggattggtggctgaaggccataatcccagctctctgggaggccaa

SEQ ID NO: 27624 - DNA, 271 bp, Homo sapiens
gaaagcaaagttctttttcaactggacacccaaggtaggggagaacatcctccttacctacaaaggaattcttaacaacttgaggtccaggcccacgtcaggtatttagcaatggttttagacttacagtatgccaatttgcaaaatggagaaggttaactttttgcataagaggttttcttttctgctttgtcaacttttctctacctgaagaatggtatcttacagacagccttgttcctataaccaaacactctcatatgaactaatt

SEQ ID NO: 27625 - DNA, 442 bp, Homo sapiens
ccctgaatttagactttgctctgtgttctcccggtaactgtcagacaaaaagtttattggctctgaggaactgagaaatgttgggaacctggtttctgctgtacacaggaaagatttgtaagtgagctctctctttgaaaacaggacccaggctgggcacagcagctcatgcctgtaatcctagtattataggaggcagaggctcgggaggattgcttgagcccaggagttcaagatcagcctaggcaacatagggagaccctatccctacaaaaaatttctgaaaaattacctgggcattgtggggcacacctgttgtcccagctactctggaggctgagtccggaggaacgtttgagcctgggagtttgagtttgcagcttgcagtgagctgtgattgcaccactgtactccagattaataaagatgtttgcaaaaaaaa

SEQ ID NO: 27626 - DNA, 4081 bp, Homo sapiens
ccctgaatttagactttgctctgtgttctcccggtaactgtcagacaaaaagtttattggctctgaggaactgagaaatgttgggaacctggtttctgctgtacacaggaaagatttgtaagtgagctctctctttgaaaacaggacccaggctgggcacagcagctcatgcctgtaatcctagtattataggaggcagaggctcgggaggattgcttgagcccaggagttcaagatcagcctaggcaacatagggagaccctatccctacaaaaaatttctgaaaaattacctgggcattgtggggcacacctgttgtcccagctactctggaggctgagtccggaggaacgtttgagcctgggagtttgagtttgcagcttgcagtgagctgtgattgcaccactgtactccagcttgggcaacagagcaagatcctgtctcaaaaggaaaaagaaaacaggacctaggtgtttggggtacactgccacccagggagtggatcaaaaatatacatagaaagagaatgagcatgtctctataattgtcttctaggaccatattgctgttagaagtcctaaaagaggatgggttgtaatttagcataatattctgaattcattccaagtttaaaatcctgtcattctctggctcttcttttttcacatcaaaatgatgctgttggacttagaggcttccgaactgttttattgagggctactatctgcctccacaattttattaaaaccactccacctttagacaaaggtgacttttgtctgattttacaaatcagattttattcaagctttctaaatatctgtgaagtagaccctagaaaattgtctcgtttattttaaatagaatctatgcttccaccaataaaccatcgggagctaagaaacaacataatgttgacaaatcaggaacctaacagattattttgtctctcattattaatttgaaagagcctctaaacttttgagaaatcaatgtgtcttcttaagaaagttaagcaccctctcttaactttcccctctatttgctctcctttttctttcttcttaagagtatttatattattttgttaagcaaaaatggctaagattgctctaaaatttgcaaaatgaggagtggattgcaaataattgagggatttatttctttaactttataagactttaaaaaaaaaacccaaattctaagcactgacatgaaagttgcctttgagaagcttgttattcattatacaaaaagtatttgcccattcctattctaagatttgcagaatatgtcaccctatctagcttttgagtttgctatctggtttaatgttgtatttataatttaaagtggaaatcagaaactgtttcaagaacctgtattctattccttactgagtgtcccttctttaaatagtgtttgctgaattaagccgatgggggcagtggcgttaagtggtggaaaaaggaaagtatatatgttagagttttgaatgagggataaatagaaagcagaatgaattaatggaaaagaactcggctgttaggccattctctaaattctagtttagccaaaagtttatgtgtggtttggggcttcatttatttatctcatgagtaaaatggaataatacctaacaggcaggctctggaagttggaaatcacatacacacacacacacacagacacacacacacacgatcaatcatgtagctcatattagatgttcaataaataacagctactacagatgcctatcagttgagtaagtagttcattaaattgagctcccaaaggtctcttctcttcacatccatatccgtttctgcagcaatcaaatagatacatgattgtttttctgtaagaaattactgcaaagagaatctttttctcctactaactgttccttctacctggtataggagataaatgtacgtttcttaattagctgactttttagtgtgtcatttctgaaggaaaaataaattaaccttaaagtggcatgtaggtccaattcagttttcctacatgttccaaaattttatttaaattactgtgtccaaaattatgaggacagtgtcattcattcaccatagtttatatttttagttatatatcaaacttccttggcacctaggataagaacatttcttttgaagttatccaatttttttttatttttacttgacttgaaggaaagttggaaaatatggtggaaaaaatcttccgcattaaaagggggaaaaaacacaaccatttacgatctcagtcagcagatttactctactcaaggaaaaaaagaaacaatcttattggaagcagatgttgacactgtgtcagttattgaagacggaaggagttcacttgagccattgcagttacaaaggggtattgatggcagtttggattcctgattgatcacctttgcagccaagggaaagacagcagaaactgtatgggatcagaaatgaaatcagcctgccagtttaatggagaggctcctagaaactcattttttttctttcctgtaagataaaagacatctttcagaataagaaaggcttgtttgagagagaaattacagtttattctctgaaaatatttaaaggccaaagtgccctttaaatctattattaaagcattgaaactgttattaaaatcattatagaaaaattaggtaaaaattttagcctaactttcaacatccattcaaaaacgaatgttgaaaacaaacatataacctataaaaaagtgaatggctctggcaagtgggggcatgggtggagtccataaggaaacctcagtctcaataacttcaaaatgttacttttcatggtaacttggtcatggagattggtcacagcacagacatttagaattttttagcaggttttttttttcttttgaatcttgtagtgctctctgggaattgcaccatgtacacttttacaacctacagaaatcgtcattattgttaaagtatctcaacttttctatttcttttatggtctattgtgcttttttgtttaaaaatacttttatagttttaaagtattggtcaaagtagtattctcttgaagttctagtcaatttaatttgatccaataagtttttctgaatctcctttttaagttccaagaaattctattataaataagtgtacttttaccaattccattgtataagcaaacagacaccttttagaaaaggataagtaatcatcaatttgttttttttaaaaaaaaaacaatttctagactactaaatttggcataagaataattcttttaaaatgcaacatactttaattagtttttttggtatatgcataagatgtgaactttcctattgatatcactttatattaatagagatgtacatttctttctatgccgtggctagagcaaaagttaataatgattatttacacaattgatttaatttcttaggatatgtataatattgggatattatatctgatttaaaaatactattccatacattttttttttcaggagataaaacataggggaaaggttttcatgtgaattctttgtatcactttgaagtacatatatttaaagggaagatggatacaatttgtttttattatataaatctaggtaaggtgaaatgcttttgtcaacaaaaatacagtgtagtgaattttatatttgtcacttgattaggtaaactgaaaactaacaatagaaatattattttactgcattgaaataccatgaactttcagacttgttagttctacaagcagttgtgctaccttaattttgtgtttccagaaataaaaattaaccttagttatgctgtcatttttaactaataaaaaaagtataattcataaaacttttggctttataagataattataaaattatatatttttttctgtttttgtggggttgggaaaacattttcttatttctattcactcttcaaatgcaggtctcataatatgtgtcaatgatataagatgatggaagactttgtaataaaaacatatgtcattatcttcaatttgttcaataaataatttaatgtgaatttgaatgtttgtatt

SEQ ID NO: 27627 - DNA, 4147 bp, Homo sapiens
ccctgaatttagactttgctctgtgttctcccggtaactgtcagacaaaaagtttattggctctgaggaactgagaaatgttgggaacctggtttctgctgtacacaggaaagatttgtaagtgagctctctctttgaaaacaggacccaggctgggcacagcagctcatgcctgtaatcctagtattataggaggcagaggctcgggaggattgcttgagcccaggagttcaagatcagcctaggcaacatagggagaccctatccctacaaaaaatttctgaaaaattacctgggcattgtggggcacacctgttgtcccagctactctggaggctgagtccggaggaacgtttgagcctgggagtttgagtttgcagcttgcagtgagctgtgattgcaccactgtactccagcttgggcaacagagcaagatcctgtctcaaaaggaaaaagaaaacaggacctaggtgtttggggtacactgccacccagggagtggatcaaaaatatacatagaaagagaatgagcatgtctctataattgtcttctaggaccatattgctgttagaagtcctaaaagaggatgggttgtaatttagcataatattctgaattcattccaagtttaaaatcctgtcattctctggctcttcttttttcacatcaaaatgatgctgttggacttagaggcttccgaactgttttattgagggctactatctgcctccacaattttattaaaaccactccacctttagacaaaggtgacttttgtctgattttacaaatcagattttattcaagctttctaaatatctgtgaagtagaccctagaaaattgtctcgtttattttaaatagaatctatgcttccaccaataaaccatcgggagctaagaaacaacataatgttgacaaatcaggaacctaacagattattttgtctctcattattaatttgaaagagcctctaaacttttgagaaatcaatgtgtcttcttaagaaagttaagcaccctctcttaactttcccctctatttgctctcctttttctttcttcttaagagtatttatattattttgttaagcaaaaatggctaagattgctctaaaatttgcaaaatgaggagtggattgcaaataattgagggatttatttctttaactttataagactttaaaaaaaaaacccaaattctaagcactgacatgaaagttgcctttgagaagcttgttattcattatacaaaaagtatttgcccattcctattctaagatttgcagaatatgtcaccctatctagcttttgagtttgctatctggtttaatgttgtatttataatttaaagtggaaatcagaaactgtttcaagaacctgtattctattccttactgagtgtcccttctttaaatagtgtttgctgaattaagccgatgggggcagtggcgttaagtggtggaaaaaggaaagtatatatgttagagttttgaatgagggataaatagaaagcagaatgaattaatggaaaagaactcggctgttaggccattctctaaattctagtttagccaaaagtttatgtgtggtttggggcttcatttatttatctcatgagtaaaatggaataatacctaacaggcaggctctggaagttggaaatcacatacacacacacacacacagacacacacacacacgatcaatcatgtagctcatattagatgttcaataaataacagctactacagatgcctatcagttgagtaagtagttcattaaattgagctcccaaaggtctcttctcttcacatccatatccgtttctgcagcaatcaaatagatacatgattgtttttctgtaagaaattactgcaaagagaatctttttctcctactaactgttccttctacctggtataggagataaatgtacgtttcttaattagctgactttttagtgtgtcatttctgaaggaaaaataaattaaccttaaagtggcatgtaggtccaattcagttttcctacatgttccaaaattttatttaaattactgtgtccaaaattatgaggacagtgtcattcattcaccatagtttatatttttagttatatatcaaacttccttggcacctaggataagaacatttcttttgaagttatccaatttttttttatttttacttgacttgaaggaaagttggaaaatatggtggaaaaaatcttccgcattaaaagggggaaaaaacacaaccatttacgatctcagtcagcagatttactctactcaaggaaaaaaagaaacaatcttattggaagcagatgttgacactgtgtcagttattgaagacggaaggagttcacttgagccattgcagttacaaaggggtattgatggcagtttggattcctgattgatcacctttgcagccaagggaaagacagcagaaactgtatgggatcagaaatgaaatcagcctgccagtttaatggagaggctcctagaaactcattttttttctttcctgtaagataaaagacatctttcagaataagaaaggcttgtttgagagagaaattacagtttattctctgaaaatatttaaaggccaaagtgccctttaaatctattattaaagcattgaaactgttattaaaatcattatagaaaaattaggtaaaaattttagcctaactttcaacatccattcaaaaacgaatgttgaaaacaaacatataacctataaaaaagtgaatggctctggcaagtgggggcatgggtggagtccataaggaaacctcagtctcaataacttcaaaatgttacttttcatggtaacttggtcatggagattggtcacagcacagacatttagaattttttagcaggttttttttttcttttgaatcttgtagtgctctctgggaattgcaccatgtacacttttacaacctacagaaatcgtcattattgttaaagtatctcaacttttctatttcttttatggtctattgtgcttttttgtttaaaaatacttttatagttttaaagtattggtcaaagtagtattctcttgaagttctagtcaatttaatttgatccaataagtttttctgaatctcctttttaagttccaagaaattctattataaataagtgtacttttaccaattccattgtataagcaaacagacaccttttagaaaaggataagtaatcatcaatttgttttttttaaaaaaaaaacaatttctagactactaaatttggcataagaataattcttttaaaatgcaacatactttaattagtttttttggtatatgcataagatgtgaactttcctattgatatcactttatattaatagagatgtacatttctttctatgccgtggctagagcaaaagttaataatgattatttacacaattgatttaatttcttaggatatgtataatattgggatattatatctgatttaaaaatactattccatacattttttttttcaggagataaaacataggggaaaggttttcatgtgaattctttgtatcactttgaagtacatatatttaaagggaagatggatacaatttgtttttattatataaatctaggtaaggtgaaatgcttttgtcaacaaaaatacagtgtagtgaattttatatttgtcacttgattaggtaaactgaaaactaacaatagaaatattattttactgcattgaaataccatgaactttcagacttgttagttctacaagcagttgtgctaccttaattttgtgtttccagaaataaaaattaaccttagttatgctgtcatttttaactaataaaaaaagtataattcataaaacttttggctttataagataattataaaattatatatttttttctgtttttgtggggttgggaaaacattttcttatttctattcactcttcaaatgcaggtctcataatatgtgtcaatgatataagatgatggaagactttgtaataaaaacatatgtcattatcttctaactggagcaacttatgcatggcggcggattggagctccttggccaatgagcctttagggagtgggttacttgattggcgggggtaggacacagagggatggagcctggg

SEQ ID NO: 27628 - DNA, 1788 bp, Homo sapiens
ccctgaatttagactttgctctgtgttctcccggtaactgtcagacaaaaagtttattggctctgaggaactgagaaatgttgggaacctggtttctgctgtacacaggaaagatttgtaagtgagctctctctttgaaaacaggacccaggctgggcacagcagctcatgcctgtaatcctagtattataggaggcagaggctcgggaggattgcttgagcccaggagttcaagatcagcctaggcaacatagggagaccctatccctacaaaaaatttctgaaaaattacctgggcattgtggggcacacctgttgtcccagctactctggaggctgagtccggaggaacgtttgagcctgggagtttgagtttgcagcttgcagtgagctgtgattgcaccactgtactccagcttgggcaacagagcaagatcctgtctcaaaaggaaaaagaaaacaggacctaggtgtttggggtacactgccacccagggagtggatcaaaaatatacatagaaagagaatgagcatgtctctataattgtcttctaggaccatattgctgttagaagtcctaaaagaggatgggttgtaatttagcataatattctgaattcattccaagtttaaaatcctgtcattctctggctcttcttttttcacatcaaaatgatgctgttggacttagaggcttccgaactgttttattgagggctactatctgcctccacaattttattaaaaccactccacctttagacaaaggtgacttttgtctgattttacaaatcagattttattcaagctttctaaatatctgtgaagtagaccctagaaaattgtctcgtttattttaaatagaatctatgcttccaccaataaaccatcgggagctaagaaacaacataatgttgacaaatcaggaacctaacagattattttgtctctcattattaatttgaaagagcctctaaacttttgagaaatcaatgtgtcttcttaagaaagttaagcaccctctcttaactttcccctctatttgctctcctttttctttcttcttaagagtatttatattattttgttaagcaaaaatggctaagattgctctaaaatttgcaaaatgaggagtggattgcaaataattgagggatttatttctttaactttataagactttaaaaaaaaaacccaaattctaagcactgacatgaaagttgcctttgagaagcttgttattcattatacaaaaagtatttgcccattcctattctaagatttgcagaatatgtcaccctatctagcttttgagtttgctatctggtttaatgttgtatttataatttaaagtggaaatcagaaactgtttcaagaacctgtattctattccttactgagtgtcccttctttaaatagtgtttgctgaattaagccgatgggggcagtggcgttaagtggtggaaaaaggaaagtatatatgttagagttttgaatgagggataaatagaaataaaaattaaccttagttatgctgtcatttttaactaataaaaaaagtataattcataaaacttttggctttataagataattataaaattatatatttttttctgtttttgtggggttgggaaaacattttcttatttctattcactcttcaaatgcaggtctcataatatgtgtcaatgatataagatgatggaagactttgtaataaaaacatatgtcattatcttcaatttgttcaataaataatttaatgtgaatttgaatgtttgtatt

SEQ ID NO: 27629 - DNA, 929 bp, Homo sapiens
  misc_feature (611)..(611): n is a, c, g, or t
  misc_feature (616)..(617): n is a, c, g, or t
gctggaggggcgaggaccgggtataagaagcctcgtggccttgcccgggcagccgcaggttccccgcgcgccccgagcccccgcgccatgaagctcgccgccctcctggggctctgcgtggccctgtcctgcagctccgctgctgctttcttagtgggctcggccaagcctgtggcccagcctgtcgctgcgctggagtcggcggcggaggccggggccgggaccctggccaaccccctcggcaccctcaacccgctgaagctcctgctgagcagcctgggcatccccgtgaaccacctcatagagggctcccagaagtgtgtggctgagctgggtccccaggccgtgggggccgtgaaggccctgaaggccctgctgggggccctgacagtgtttggctgagccgagactggagcatctacacctgaggacaagacgctgcccacccgcgagggctgaaaaccccgccgcggggaggaccgtccatccccttcccccggcccctctcaataaacgtggttaagagcaaaaaaaaaaaaaacaaaaaaaaaaaaaacaaaaaaaaaaaaaaaataaacacaataaaaaaaaaaaaaaaaaaaagggggggngcccnnaaaaaaatccccccgagggaggaggccccaccaagttagtagagccacccgacccgtttttgtgttgaacaacacgaggggggcccccacaaaagagagggcagcagcctaataattaaccacgcgaacgcacacgccgccgccgtttaaaaaccaacccgatcggagatgagtgaaaacaaccagatcgacccgccgcgcgaacacacgtgggcagaagcaaacacccacacctcgtggggggggggcaacaacaaatctgcgggcgcaaccacccacaagagaaaaatacaccccccgagagcgacaaaa

SEQ ID NO: 27630 - DNA, 566 bp, Homo sapiens
gctggaggggcgaggaccgggtataagaagcctcgtggccttgcccgggcagccgcaggttccccgcgcgccccgagcccccgcgccatgaagctcgccgccctcctggggctctgcgtggccctgtcctgcagctccgctgctgctttcttagtgggctcggccaagcctgtggcccagcctgtcgctgcgctggagtcggcggcggaggccggggccgggaccctggccaaccccctcggcaccctcaacccgctgaagctcctgctgagcagcctgggcatccccgtgaaccacctcatagagggctcccagaagtgtgtggctgagctgggtccccaggccgtgggggccgtgaaggccctgaaggccctgctgggggccctgacagtgtttggctgagccgagactggagcatctacacctgaggacaagacgctgcccacccgcgagggctgaaaaccccgccgcggggaggaccgtccatccccttcccccggcccctctcaataaacgtggttaagagcatcacccttaaacgctgagaccaaaccacttgcgggcga

SEQ ID NO: 27631 - DNA, 577 bp, Homo sapiens
gctggaggggcgaggaccgggtataagaagcctcgtggccttgcccgggcagccgcaggttccccgcgcgccccgagcccccgcgccatgaagctcgccgccctcctggggctctgcgtggccctgtcctgcagctccgctgctgctttcttagtgggctcggccaagcctgtggcccagcctgtcgctgcgctggagtcggcggcggaggccggggccgggaccctggccaaccccctcggcaccctcaacccgctgaagctcctgctgagcagcctgggcatccccgtgaaccacctcatagagggctcccagaagtgtgtggctgagctgggtccccaggccgtgggggccgtgaaggccctgaaggccctgctgggggccctgacagtgtttggctgagccgagactggagcatctacacctgatgtctgtgccaggcctggtcacgatggctgtgaggttagaagcgcagatagtggtccagcagggtggtggcagagccaacgtcatgattgatgtgtccgtctcactcatgtgagtctttgaatgcagcctcagcgtcttgtacagccta

SEQ ID NO: 27632 - DNA, 390 bp, Homo sapiens
gctggaggggcgaggaccgggtataagaagcctcgtggccttgcccgggcagccgcaggttccccgcgcgccccgagcccccgcgccatgaagctcgccgccctcctggggctctgcgtggccctgtcctgcagctccgctgctgctttcttagtgggctcggccaagcctgtggcccagcctgtcgctgcgctggagtcggcggcggaggccggggccgggaccctggccaaccccctcggcaccctcaacccgctgaagctcctgctgagcagcctgggcatccccgtgaaccacctcatagagggctcccagaagtgtgtgactctgagcctcgggcagaccggacagcactcgcctcgggattcgcccgggaagttcctgcctcac

SEQ ID NO: 27633 - DNA, 464 bp, Homo sapiens
gcgcgggcatcccttcccggccagcctcaaaactgcaccagaggtgtcccggccctacgtcagggctgtttcccgtcctgcccctccaagccctgtccctgggagaagcccgggtctccgggtgggaactgggtggggcgcatccgagctgcaggggcggggaaggcggaggtggccccgcgcgggtgcgcgtcccccggagacgccagcggaaccgccccgctcccgctccccacagagccggccgctgccgcgcccccgcctgagttcttggtggcagggctgggggcactcaagctcggcttctgctttccagggggccctgacagtgtttggctgagccgagactggagcatctacacctgaggacaagacgctgcccacccgcgagggctgaaaaccccgccgcggggaggaccgtccatccccttcccccggcccctctcaataaacgtggttaagag

SEQ ID NO: 27634 - DNA, 327 bp, Homo sapiens
aaataaaccttctgaactgacaacttctattatacggtttttccatttggactctgcatgcttaaatgggccattaatcacagcaggcacatgtatgtggaagagctttgtaaactgcaaaacatacaaatcctgttcccttcttattttctaaaatagccatgtttaatctactttttagctgcttccttttatgaattataaagaattatattgtaatttttttttcctccctttcagtatttagtgtctctgatccgggacaagctaggatggatgtgggttttctactttttcattctcatggtaagtgtgtgcccctttaaa

SEQ ID NO: 27635 - DNA, 2332 bp, Homo sapiens
cgcattcagtatcctgtccccaaatccagggcactgtaattgaaggcagcttccaccacccgtactccaggcagctgtcctcttgctgtggtcaaggagccccaggatagtccagctccaggaataccttggagctttcatctaattcccatctagcttctaaagactgggcccatgtaacttgtgttccatttctgacatccatgctaagtagcgggaagtatctggtgatgaactttctgatgtgatcatactaggaactgtagtagaaagaaaacttttatctattataaggatcactgttgttcatctgagcctctggtctcagttctctgctccgcctatggcaaattatttgtatgtattgttctttttttgggaactgaaatgtgatgttgagtgttttgtaatattagccataattttcaaaatcattttctaattcattgaagattaaacattatctttgtatgaagtcaaaatgaatgtaattgtccaaatccattattatgttcaaaacatgacactctaacagaagtaaactgttgctgcatatttaatactattttctctttacagacaagttgtacaattgtgtttatctcgccattaatagtgagggaaatattctctctcgtgctaaggagacaggctcacatattgagggagtgaccggtgcccgcgagacagaaagaacaatgtcagccacatcaggaccgctggggcttcgagtctgccctaatttgggtttgtctaggagctccagcctgatcttggattgtcaggcgtctctcaacactgccagccacctgagatgctgaccagcagtgaaggctgcactagttttctacactacaggaattactgttgatgatttttgctgttgtttcatgaatgtgccgagtgacttctgactctgccagcatctttgacctctgactctgcccgcgtctttgtttggcctattgaggtttagcgttttaaccttaactgttgttttggacttgaactttctctagccttgaaaatggagtgaacaggaggcaaagccacgcgtggtttgtgttggtggtatgttccacaaatggaagagatcattgcattttgctttggtaatgagtttacagagagtgggtcatctttgaagcatcaaatcctgatcaaatgctcaagctggaccgagctgcaagcctgccttggacaaagaatccctctgttcactgtggtgggaaagatcacactacatgcctgttgattggctcagtcactctgtgtctgatctaaacgtcattcagccctagaagcatgaattgcttcaaattattgtcaacttgttctcttccattttcattcaaattaactttgactcctggaagtattgagtcttcctttcaaggaccataaggtacatcagttatcttgaacattctgacgtgtaaaggaccataaggtacatcatttatcttgaacattccgacgtgtaactcacagccgaagcactccatcccagatttgttgtctgggaactttaggatcctctaggaagctaatctgcttagtctatttttagaggattgatctctggcacaaccagcttcctggagttacctcagcagaagactagaattagagaaaagggaaagaccttttcttctagtaagtgtcaagtacagatgctctttgacttatgatggggttatgtcccagtaaacccattggaagtcaaatgcatttaatacccctgactggacaccacagcttagcctcgtccaccctaaatgtactcagaacacttagaattgcccacagttgggcagaatcatctaacacaaactctattttataatcgagtgttgaatatatcatgtaatttattgaatattgtacattatgttgaaattgcaaccatttcacaccattgtaaagtccaaaaatcagaagctgaggactgtctgtacatgacattgaatcacatgaatggattactagggcctgaggggtgtccgttctttagaaaaatgtagagtatatatatcttcagggctgtgaattccatactagttatcaatattttaagatcattctgtatatacatattttaaattatgcaagcaaactaggaggagaatgtgcaattttgagggatacctaatttgcattcggttaggggatatttttcaacctcttgctttatactctgatatggggtgtgtttatgaacttgttaatgttatttaatcatgcagatttccaatcagtgtattgctcatttactgacaaaaagggaaaatacgaaacacagaaagggaaaataaactgacttttataatga

SEQ ID NO: 27636 - DNA, 2278 bp, Homo sapiens
cgcattcagtatcctgtccccaaatccagggcactgtaattgaaggcagcttccaccacccgtactccaggcagctgtcctcttgctgtggtcaaggagccccaggatagtccagctccaggaataccttggagctttcatctaattcccatctagcttctaaagactgggcccatgtaacttgtgttccatttctgacatccatgctaagtagcgggaagtatctggtgatgaactttctgatgtgatcatactaggaactgtagtagaaagaaaacttttatctattataaggatcactgttgttcatctgagcctctggtctcagttctctgctccgcctatggcaaattatttgtatgtattgttctttttttgggaactgaaatgtgatgttgagtgttttgtaatattagccataattttcaaaatcattttctaattcattgaagattaaacattatctttgtatgaagtcaaaatgaatgtaattgtccaaatccattattatgttcaaaacatgacactctaacagaagtaaactgttgctgcatatttaatactattttctctttacagacaagttgtacaattgtgtttatctcgccattaatagtgagggaaatattctctctcgtgctaaggagacaggctcacatattgagggagtgaccggtgcccgcgagacagaaagaacaatgtcagccacatcaggaccgctggggcttcgagtctgccctaatttgggtttgtctaggagctccagcctgatcttggattgtcaggcgtctctcaacactgccagccacctgagatgctgaccagcagtgaaggctgcactagttttctacactacaggaattactgttgatgatttttgctgttgtttcatgaatgtgccgagtgacttctgactctgccagcatctttgacctctgactctgcccgcgtctttgtttggcctattgaggtttagcgttttaaccttaactgttgttttggacttgaactttctctagccttgccacaaatggaagagatcattgcattttgctttggtaatgagtttacagagagtgggtcatctttgaagcatcaaatcctgatcaaatgctcaagctggaccgagctgcaagcctgccttggacaaagaatccctctgttcactgtggtgggaaagatcacactacatgcctgttgattggctcagtcactctgtgtctgatctaaacgtcattcagccctagaagcatgaattgcttcaaattattgtcaacttgttctcttccattttcattcaaattaactttgactcctggaagtattgagtcttcctttcaaggaccataaggtacatcagttatcttgaacattctgacgtgtaaaggaccataaggtacatcatttatcttgaacattccgacgtgtaactcacagccgaagcactccatcccagatttgttgtctgggaactttaggatcctctaggaagctaatctgcttagtctatttttagaggattgatctctggcacaaccagcttcctggagttacctcagcagaagactagaattagagaaaagggaaagaccttttcttctagtaagtgtcaagtacagatgctctttgacttatgatggggttatgtcccagtaaacccattggaagtcaaatgcatttaatacccctgactggacaccacagcttagcctcgtccaccctaaatgtactcagaacacttagaattgcccacagttgggcagaatcatctaacacaaactctattttataatcgagtgttgaatatatcatgtaatttattgaatattgtacattatgttgaaattgcaaccatttcacaccattgtaaagtccaaaaatcagaagctgaggactgtctgtacatgacattgaatcacatgaatggattactagggcctgaggggtgtccgttctttagaaaaatgtagagtatatatatcttcagggctgtgaattccatactagttatcaatattttaagatcattctgtatatacatattttaaattatgcaagcaaactaggaggagaatgtgcaattttgagggatacctaatttgcattcggttaggggatatttttcaacctcttgctttatactctgatatggggtgtgtttatgaacttgttaatgttatttaatcatgcagatttccaatcagtgtattgctcatttactgacaaaaagggaaaatacgaaacacagaaagggaaaataaactgacttttataatga

SEQ ID NO: 27637 - DNA, 3068 bp, Homo sapiens
cgcattcagtatcctgtccccaaatccagggcactgtaattgaaggcagcttccaccacccgtactccaggcagctgtcctcttgctgtggtcaaggagccccaggatagtccagctccaggaataccttggagctttcatctaattcccatctagcttctaaagactgggcccatgtaacttgtgttccatttctgacatccatgctaagtagcgggaagtatctggtgatgaactttctgatgtgatcatactaggaactgtagtagaaagaaaacttttatctattataaggatcactgttgttcatctgagcctctggtctcagttctctgctccgcctatggcaaattatttgtatgtattgttctttttttgggaactgaaatgtgatgttgagtgttttgtaatattagccataattttcaaaatcattttctaattcattgaagattaaacattatctttgtatgaagtcaaaatgaatgtaattgtccaaatccattattatgttcaaaacatgacactctaacagaagtaaactgttgctgcatatttaatactattttctctttacagacaagttgtacaattgtgtttatctcgccattaatagtgagggaaatattctctctcgtgctaaggagacaggctcacatattgagggagtgaccggtgcccgcgagacagaaagaacaatgtcagccacatcaggaccgctggggcttcgagtctgccctaatttgggtttgtctaggagctccagcctgatcttggattgtcaggcgtctctcaacactgccagccacctgagatgctgaccagcagtgaaggctgcactagttttctacactacaggaattactgttgatgatttttgctgttgtttcatgaatgtgccgagtgacttctgactctgccagcatctttgacctctgactctgcccgcgtctttgtttggcctattgaggtttagcgttttaaccttaactgttgttttggacttgaactttctctagccttgaaaatggagtgaacaggaggcaaagccacgcgtggtttgtgttggtggtatgttccacaaatggaagagatcattgcattttgctttggtaatgagtttacagagagtgggtcatctttgaagcatcaaatcctgatcaaatgctcaagctggaccgagctgcaagcctgccttggacaaagaatccctctgttcactgtggtgggaaagatcacactacatgcctgttgattggctcagtcactctgtgtctgatctaaacgtcattcagccctagaagcatgaattgcttcaaattattgtcaacttgttctcttccattttcattcaaattaactttgactcctggaagtattgagtcttcctttcaaggaccataaggtacatcagttatcttgaacattctgacgtgtaaaggaccataaggtacatcatttatcttgaacattccgacgtgtaactcacagccgaagcactccatcccagatttgttgtctgggaactttaggatcctctaggaagctaatctgcttagtctatttttagaggattgatctctggcacaaccagcttcctggagttacctcagcagaagactagaattagagaaaagggaaagaccttttcttctagtaagtgtcaagtacagatgctctttgacttatgatggggttatgtcccagtaaacccattggaagtcaaatgcatttaatacccctgactggacaccacagcttagcctcgtccaccctaaatgtactcagaacacttagaattgcccacagttgggcagaatcatctaacacaaactctattttataatcgagtgttgaatatatcatgtaatttattgaatattgtacattatgttgaaattgcaaccatttcacaccattgtaaagtccaaaaatcagaagctgaggactgtctgtacatgacattgaatcacatgaatggattactagggcctgaggggtgtccgttctttagaaaaatgtagagtatatatatcttcagggctgtgaattccatactagttatcaatattttaagatcattctgtatatacatattttaaattatgcaagcaaactaggaggagaatgtgcaattttgagggatacctaatttgcattcggttaggggatatttttcaacctcttgctttatactctgatatggggtgtgtttatgaacttgttaatgttatttaatcatgcagatttccaatcagtgtattgctcatttactgacaaaaagggaaaatacgaaacacagaaagggaaaataaactgacttttataatgaaaaaaagagagagaagaaacagaaaaaaaaaaaacaacacaaaaagagagaaacaaaaaaaaagcaaaaacacaaaaggaaacaagaaaaaaaggaggaaccacaaaaaaagacgcaatcacaaaaaaaaaagcacaggacaaggggccgaatcagaatcacagacagaccaagaagaaggggaaaaaaaggacaagaatggaaaaatatgggagcgagggcaactatcaaccttagtgcgggaggaacaattaatgtggcgcaaaaaccatgtaacatctacgacgaaaagagtatacaacaccttacagagaggggtagagattatttacaaaactcttgtcagagtgtgttatcaacagtgtgtcttacaaatattgtgagcagcgccaatataattgacgtgcgacattaaattatgacagaacatattcgagcggggacacacaagcgcacagtaccagaagacacctcagacagaaaacaccgcaaagatcaaacaaccccacgagagagaagacacaaagagatcaaaaagagaggatagcgagcgcgtgcgcaggcagatgagagtgcagccgagacagagatagagataggcaaccaggagggcgggccggcaggcgagccgaggaacgatcaagtgagccgcagagagaggggcgggcgacggaggcgagtgagaggcaggagtgcgcgccaacacagagcgccgcgctcagcggcacgccgcgac

SEQ ID NO: 27638 - DNA, 2448 bp, Homo sapiens
ttttaggtctctcgggtattgaggcagaagaaaactttgaagaagactcacacaggccattaattaatggtggtgaaaatgaagacgaatatgagccgaattattcaatccaagatgatagttctgttgcccaagtcaaggcgataagcttctaccaggcatgttgccttcctggagtcataccgtactcactggcctacgcctgcttgaagttagtgaattactccttcttcttctggctccccttttatctgagtaacaacttcggctggaaggaggcggaagccgacaagctgtccatttggtacgacgttggagggatcataggtggaactttgcaaggcttcatctctgatgtactacagaagagagcgccggttcttgccctgagtctgcttctggcagttgggtccctcatcgggtatagtcgttctccaaatgataagtccatcaatgcccttctgatgactgttacaggattttttattggtggaccttctaatatgattagttctgctatttctgcggacttgggtcgccaggagctcatccaaaggagcagtgaagctttggccactgtcacaggaattgtggatggttcggggagcattggagctgcagtgggccagtatttagtgtctctgatccgggacaagctaggatggatgtgggttttctactttttcattctcatgacaagttgtacaattgtgtttatctcgccattaatagtgagggaaatattctctctcgtgctaaggagacaggctcacatattgagggagtgaccggtgcccgcgagacagaaagaacaatgtcagccacatcaggaccgctggggcttcgagtctgccctaatttgggtttgtctaggagctccagcctgatcttggattgtcaggcgtctctcaacactgccagccacctgagatgctgaccagcagtgaaggctgcactagttttctacactacaggaattactgttgatgatttttgctgttgtttcatgaatgtgccgagtgacttctgactctgccagcatctttgacctctgactctgcccgcgtctttgtttggcctattgaggtttagcgttttaaccttaactgttgttttggacttgaactttctctagccttgaaaatggagtgaacaggaggcaaagccacgcgtggtttgtgttggtggtatgttccacaaatggaagagatcattgcattttgctttggtaatgagtttacagagagtgggtcatctttgaagcatcaaatcctgatcaaatgctcaagctggaccgagctgcaagcctgccttggacaaagaatccctctgttcactgtggtgggaaagatcacactacatgcctgttgattggctcagtcactctgtgtctgatctaaacgtcattcagccctagaagcatgaattgcttcaaattattgtcaacttgttctcttccattttcattcaaattaactttgactcctggaagtattgagtcttcctttcaaggaccataaggtacatcagttatcttgaacattctgacgtgtaaaggaccataaggtacatcatttatcttgaacattccgacgtgtaactcacagccgaagcactccatcccagatttgttgtctgggaactttaggatcctctaggaagctaatctgcttagtctatttttagaggattgatctctggcacaaccagcttcctggagttacctcagcagaagactagaattagagaaaagggaaagaccttttcttctagtaagtgtcaagtacagatgctctttgacttatgatggggttatgtcccagtaaacccattggaagtcaaatgcatttaatacccctgactggacaccacagcttagcctcgtccaccctaaatgtactcagaacacttagaattgcccacagttgggcagaatcatctaacacaaactctattttataatcgagtgttgaatatatcatgtaatttattgaatattgtacattatgttgaaattgcaaccatttcacaccattgtaaagtccaaaaatcagaagctgaggactgtctgtacatgacattgaatcacatgaatggattactagggcctgaggggtgtccgttctttagaaaaatgtagagtatatatatcttcagggctgtgaattccatactagttatcaatattttaagatcattctgtatatacatattttaaattatgcaagcaaactaggaggagaatgtgcaattttgagggatacctaatttgcattcggttaggggatatttttcaacctcttgctttatactctgatatggggtgtgtttatgaacttgttaatgttatttaatcatgcagatttccaatcagtgtattgctcatttactgacaaaaagggaaaatacgaaacacagaaagggaaaataaactgacttttataatga

SEQ ID NO: 27639 - DNA, 2388 bp, Homo sapiens
ttttaggtctctcgggtattgaggcagaagaaaactttgaagaagactcacacaggccattaattaatggtggtgaaaatgaagacgaatatgagccgaattattcaatccaagatgatagttctgttgcccaagtcaaggcgataagcttctaccaggcatgttgccttcctggagtcataccgtactcactggcctacgcctgcttgaagttagtgaattactccttcttcttctggctccccttttatctgagtaacaacttcggctggaaggaggcggaagccgacaagctgtccatttggtacgacgttggagggatcataggtggaactttgcaaggcttcatctctgatgtactacagaagagagcgccggttcttgccctgagtctgcttctggcagttgggtccctcatcgggtatagtcgttctccaaatgataagtccatcaatgcccttctgatgactgttacaggattttttattggtggaccttctaatatgattagttctgctatttctgcggacttgggtcgccaggagctcatccaaaggagcagtgaagctttggccactgtcacaggaattgtggatggttcggggagcattggagctgcagtgggccagtatttagtgtctctgatccgggacaagctaggatggatgtgggttttctactttttcattctcatgctaaggagacaggctcacatattgagggagtgaccggtgcccgcgagacagaaagaacaatgtcagccacatcaggaccgctggggcttcgagtctgccctaatttgggtttgtctaggagctccagcctgatcttggattgtcaggcgtctctcaacactgccagccacctgagatgctgaccagcagtgaaggctgcactagttttctacactacaggaattactgttgatgatttttgctgttgtttcatgaatgtgccgagtgacttctgactctgccagcatctttgacctctgactctgcccgcgtctttgtttggcctattgaggtttagcgttttaaccttaactgttgttttggacttgaactttctctagccttgaaaatggagtgaacaggaggcaaagccacgcgtggtttgtgttggtggtatgttccacaaatggaagagatcattgcattttgctttggtaatgagtttacagagagtgggtcatctttgaagcatcaaatcctgatcaaatgctcaagctggaccgagctgcaagcctgccttggacaaagaatccctctgttcactgtggtgggaaagatcacactacatgcctgttgattggctcagtcactctgtgtctgatctaaacgtcattcagccctagaagcatgaattgcttcaaattattgtcaacttgttctcttccattttcattcaaattaactttgactcctggaagtattgagtcttcctttcaaggaccataaggtacatcagttatcttgaacattctgacgtgtaaaggaccataaggtacatcatttatcttgaacattccgacgtgtaactcacagccgaagcactccatcccagatttgttgtctgggaactttaggatcctctaggaagctaatctgcttagtctatttttagaggattgatctctggcacaaccagcttcctggagttacctcagcagaagactagaattagagaaaagggaaagaccttttcttctagtaagtgtcaagtacagatgctctttgacttatgatggggttatgtcccagtaaacccattggaagtcaaatgcatttaatacccctgactggacaccacagcttagcctcgtccaccctaaatgtactcagaacacttagaattgcccacagttgggcagaatcatctaacacaaactctattttataatcgagtgttgaatatatcatgtaatttattgaatattgtacattatgttgaaattgcaaccatttcacaccattgtaaagtccaaaaatcagaagctgaggactgtctgtacatgacattgaatcacatgaatggattactagggcctgaggggtgtccgttctttagaaaaatgtagagtatatatatcttcagggctgtgaattccatactagttatcaatattttaagatcattctgtatatacatattttaaattatgcaagcaaactaggaggagaatgtgcaattttgagggatacctaatttgcattcggttaggggatatttttcaacctcttgctttatactctgatatggggtgtgtttatgaacttgttaatgttatttaatcatgcagatttccaatcagtgtattgctcatttactgacaaaaagggaaaatacgaaacacagaaagggaaaataaactgacttttataatga

SEQ ID NO: 27640 - DNA, 1716 bp, Homo sapiens
cgaggattaccgtgagacgacctctaaggagacaggctcacatattgagggagtgaccggtgcccgcgagacagaaagaacaatgtcagccacatcaggaccgctggggcttcgagtctgccctaatttgggtttgtctaggagctccagcctgatcttggattgtcaggcgtctctcaacactgccagccacctgagatgctgaccagcagtgaaggctgcactagttttctacactacaggaattactgttgatgatttttgctgttgtttcatgaatgtgccgagtgacttctgactctgccagcatctttgacctctgactctgcccgcgtctttgtttggcctattgaggtttagcgttttaaccttaactgttgttttggacttgaactttctctagccttgaaaatggagtgaacaggaggcaaagccacgcgtggtttgtgttggtggtatgttccacaaatggaagagatcattgcattttgctttggtaatgagtttacagagagtgggtcatctttgaagcatcaaatcctgatcaaatgctcaagctggaccgagctgcaagcctgccttggacaaagaatccctctgttcactgtggtgggaaagatcacactacatgcctgttgattggctcagtcactctgtgtctgatctaaacgtcattcagccctagaagcatgaattgcttcaaattattgtcaacttgttctcttccattttcattcaaattaactttgactcctggaagtattgagtcttcctttcaaggaccataaggtacatcagttatcttgaacattctgacgtgtaaaggaccataaggtacatcatttatcttgaacattccgacgtgtaactcacagccgaagcactccatcccagatttgttgtctgggaactttaggatcctctaggaagctaatctgcttagtctatttttagaggattgatctctggcacaaccagcttcctggagttacctcagcagaagactagaattagagaaaagggaaagaccttttcttctagtaagtgtcaagtacagatgctctttgacttatgatggggttatgtcccagtaaacccattggaagtcaaatgcatttaatacccctgactggacaccacagcttagcctcgtccaccctaaatgtactcagaacacttagaattgcccacagttgggcagaatcatctaacacaaactctattttataatcgagtgttgaatatatcatgtaatttattgaatattgtacattatgttgaaattgcaaccatttcacaccattgtaaagtccaaaaatcagaagctgaggactgtctgtacatgacattgaatcacatgaatggattactagggcctgaggggtgtccgttctttagaaaaatgtagagtatatatatcttcagggctgtgaattccatactagttatcaatattttaagatcattctgtatatacatattttaaattatgcaagcaaactaggaggagaatgtgcaattttgagggatacctaatttgcattcggttaggggatatttttcaacctcttgctttatactctgatatggggtgtgtttatgaacttgttaatgttatttaatcatgcagatttccaatcagtgtattgctcatttactgacaaaaagggaaaatacgaaacacagaaagggaaaataaactgacttttataatga

SEQ ID NO: 27641 - DNA, 2320 bp, Homo sapiens
ttttaggtctctcgggtattgaggcagaagaaaactttgaagaagactcacacaggccattaattaatggtggtgaaaatgaagacgaatatgagccgaattattcaatccaagatgatagttctgttgcccaagtcaaggcgataagcttctaccaggcatgttgccttcctggagtcataccgtactcactggcctacgcctgcttgaagttagtgaattactccttcttcttctggctccccttttatctgagtaacaacttcggctggaaggaggcggaagccgacaagctgtccatttggtacgacgttggagggatcataggtggaactttgcaaggcttcatctctgatgtactacagaagagagcgccggttcttgccctgagtctgcttctggcagttgggtccctcatcgggtatagtcgttctccaaatgataagtccatcaatgcccttctgatgactgttacaggattttttattggtggaccttctaatatgattagttctgctatttctgcggacttgggtcgccaggagctcatccaaaggagcagtgaagctttggccactgtcacaggaattgtggatggttcggggagcattggagctgcagtgggccagacaagttgtacaattgtgtttatctcgccattaatagtgagggaaatattctctctcgtgctaaggagacaggctcacatattgagggagtgaccggtgcccgcgagacagaaagaacaatgtcacctgatcttggattgtcaggcgtctctcaacactgccagccacctgagatgctgaccagcagtgaaggctgcactagttttctacactacaggaattactgttgatgatttttgctgttgtttcatgaatgtgccgagtgacttctgactctgccagcatctttgacctctgactctgcccgcgtctttgtttggcctattgaggtttagcgttttaaccttaactgttgttttggacttgaactttctctagccttgaaaatggagtgaacaggaggcaaagccacgcgtggtttgtgttggtggtatgttccacaaatggaagagatcattgcattttgctttggtaatgagtttacagagagtgggtcatctttgaagcatcaaatcctgatcaaatgctcaagctggaccgagctgcaagcctgccttggacaaagaatccctctgttcactgtggtgggaaagatcacactacatgcctgttgattggctcagtcactctgtgtctgatctaaacgtcattcagccctagaagcatgaattgcttcaaattattgtcaacttgttctcttccattttcattcaaattaactttgactcctggaagtattgagtcttcctttcaaggaccataaggtacatcagttatcttgaacattctgacgtgtaaaggaccataaggtacatcatttatcttgaacattccgacgtgtaactcacagccgaagcactccatcccagatttgttgtctgggaactttaggatcctctaggaagctaatctgcttagtctatttttagaggattgatctctggcacaaccagcttcctggagttacctcagcagaagactagaattagagaaaagggaaagaccttttcttctagtaagtgtcaagtacagatgctctttgacttatgatggggttatgtcccagtaaacccattggaagtcaaatgcatttaatacccctgactggacaccacagcttagcctcgtccaccctaaatgtactcagaacacttagaattgcccacagttgggcagaatcatctaacacaaactctattttataatcgagtgttgaatatatcatgtaatttattgaatattgtacattatgttgaaattgcaaccatttcacaccattgtaaagtccaaaaatcagaagctgaggactgtctgtacatgacattgaatcacatgaatggattactagggcctgaggggtgtccgttctttagaaaaatgtagagtatatatatcttcagggctgtgaattccatactagttatcaatattttaagatcattctgtatatacatattttaaattatgcaagcaaactaggaggagaatgtgcaattttgagggatacctaatttgcattcggttaggggatatttttcaacctcttgctttatactctgatatggggtgtgtttatgaacttgttaatgttatttaatcatgcagatttccaatcagtgtattgctcatttactgacaaaaagggaaaatacgaaacacagaaagggaaaataaactgacttttataatga

SEQ ID NO: 27642 - DNA, 306 bp, Homo sapiens
tgaggggtgtccgttctttagaaaaatgtagagtatatatatcttcagggctgtgaattccatactagttatcaatattttaagatcattctgtatatacatattttaaattatgcaagcaaactaggaggagaatgtgcaattttgagggatacctaatttgcattcggttaggggatatttttcaacctcttgctttatactctgatatggggtgtgtttatgaacttgttaatgttatttaatcatgcagatttccaatcagtgtattgctcatttactgaccaggtgggactcttcccacca

SEQ ID NO: 27643 - DNA, 3653 bp, Homo sapiens
agggccgtccgctctgctgccgccgctgttgcagccaccgccgttgccgcctccctgccggcaagtgtgtggaagctgagcgttgtcgccgccgctatggggagaaagtcaagcaaagccaaggagaagaagcagaagcggttggaggagcgagcagccatggatgccgtttgtgccaaagtggacgctgccaacaggcttggagaccctctggaggctttcccagtgttcaagaaatatgatagaaacgggttgaatgtctccattgaatgtaagcgagtgtctggactggagccagccaccgtggattgggccttcgacctgaccaaaacgaatatgcaaaccatgtatgagcagagcgagtggggctggaaggaccgagagaaacgggaggaaatgacagatgaccgagcctggtacctcatcgcgtgggaaaacagctccgtccctgttgccttttctcacttccggtttgacgtggagtgtggggatgaagtcctgtactgctatgaagtgcagttggaaagcaaggtgcggcggaaaggcctggggaagttcctcatacagatcctgcagctcatggccaacagcacacagatgaagaaggttatgttaacagtatttaaacacaatcatggtgcctaccagttcttcagagaagcgttgcaatttgaaattgatgactcttcccccagcatgtccggttgctgtggggaggattgctcctatgagatcctgagccggaggaccaagtttggggacagccatcactcccacgcgggtgggcactgtggtggctgctgccactgaactctcagagccactttcaagtcacaatgctctctcctaaggcctttcctctttcctggtctcactgttcaccgggtgtcctcagagctgtggcctccccagccctgcacgtgccaggctgcgccctgagagcacagaaccctggggagaagtggtatcagctgctcctcctctcctaggagaccagagtgctagaagggaatgaaagggagagggaagagtaggtggggccgggcagtgaagctcatcctccacagtggctgcctcctcatttggctcctggggcctgcagtggaggttctcgcacctctgcagcccctagattcctggcaacctcccctcccctgacacatacacacttggacaaatggaatgtttatgtccacctttatgaaagttctggagtcctgggtctggggtttgctggtccccaaagaggaacacactgggtgtaagatctgggtgtagagggcggcttcagagagactcacgcttgcgcagttggaattgctgttaacggagactgggaagatcttttgtgccaagatgcagggaaatgaagaaagctctttccagctgtttttatggattcatggagtgggctcatgttgggaccagctgactctgggaggaagactgcctctccatcgctgtcagagagcctgaaaggaccaacaatgaggtgttcttgggacccgccatggggatgattgcttctctaggctcctggatgttgctgcattctaagcttaacctcctggtctcatggcagtgacttgagcttttgattcatagaagaaagccagaggttctgcttgttcttgtctgccagccctcgtcgttctttctcctctgcctctcacctctaccccaaatacctctgttcttagtctcaaggggagaataacatcagggagcccctcatcttccccagaaggacttctcgttcctcatgtagttaactccattgattttcctatcttggtgctgatagctctctaagggtagggcacacctccccacagccaccctccctcttcagagagcccccagccagcagcaggcccctctgcctgcactcctcaggcttgcccctcgctgcctcagtgaggcactagtgccactgccgtggcccagccgggccatagctcaggctgcagcagaaatgcctctcagtggccaacagttgcttttctctctggtgtcaccctgtggcaacaggctggagcaggggaaggagaaagccttcctcttctctcataggatagaaaggcaggctcagaactaatgctcatcctgatctctaggccttgttcctcttccagggaagaaaagccaaatccttatcaaggaaaaagcacctaacagctccctttggatatccctgagctctgctgtggggagtatcataaaggttctagccttcgtgaagttgttctcgtggaggtctgttggtccctctgacctcagcatctgctcacatcccaccctctgcccaactctggcagtctctcctggcagatctccccagagtggtccttgcttctcacctggattcctgcttgtgcaggagcctgtgtacacagggcctccctcacccagcctggcccctctgctgagcactttgcgctgctcttgatgggcagcagtgggactgggaactccttagagagggccttgcagctttacactggaataagtctgcctctgcctctgcctcaccctgctggctcctggtgggtttcatcccaggcagagttgacattgctggaggggtttggtggactcctaagaatcatgaaaccacaggagcatgtttaggaagagatttgtctctggtccctgtctctgaaaggacacagatgctaaatatttattgtcttagatcatggattcctgatacctctcactcaaggggaccaaaagggacccccccgtgttcatcccttgtaaggtgagttcagtctacgttgtctctttccagtcactggatgcgtggcaccaactggtcaatgggtgcttggtgccataccctgctcaccctagtctctgcaggccatgtcctgaagggttcctcaggaggtcgggactagggtgggagaggcactatctgagacctgcaatcactcttgttggtcttgagcccattcatttccaaaacatccatctttctccacttcccccaggtcttggttttgagaaacagcaggcatggctgagtgcggtggcttacacctgtaatcccagcactttgggaggctgaggcaggcgggtcacctgaggtcaggagttcaagaccagcctggtcaacatggcaaaagcccatctctactaaaaaatacaaaaattagccaggcgtggttgtggcctgtaatcccagctactcgggaggctgaggcaggagactcgcttgaacccaggaggtggaggttgtggtgagctgagatcacgccattgcactccagcctaggcgacagagtgagactccatctcaaaaaaaaaaaaagagaaacatagcaggccttttttaccaggctttttgtgttttgtttgtttgtttggagcatgttaagatttttttaagatttttaaaattttagttatatccaccctatttcaggttatttttgttggtgtcaagtatgtataggacatgtgaatggttctttttaatttttttttaagaggaaatttggaagataaactccttgatatatatatatatatatatttttttttctttagcagcttgttatcactggaatcaaagggaaaaagtgatctcttcttgcattggttgtatttgtatgtcacaaataaaagacactttggtcaaaaaaaga

SEQ ID NO: 27644 - DNA, 1656 bp, Homo sapiens
agggccgtccgctctgctgccgccgctgttgcagccaccgccgttgccgcctccctgccggcaagtgtgtggaagctgagcgttgtcgccgccgctatggggagaaagtcaagcaaagccaaggagaagaagcagaagcggttggaggagcgagcagccatggatgccgtttgtgccaaagtggacgctgccaacaggcttggagaccctctggaggctttcccagtgttcaagaaatatgatagaaacgggttgaatgtctccattgaatgtaagcgagtgtctggactggagccagccaccgtggattgggccttcgacctgaccaaaacgaatatgcaaaccatgtatgagcagagcgagtggggctggaaggaccgagagaaacgggaggaaatgacagatgaccgagcctggtacctcatcgcgtgggaaaacagctccgtccctgttgccttttctcacttccggtttgacgtggagtgtggggatgaagtcctgtactgctatgaagtgcagttggaaagcaaggtgcggcggaaaggcctggggaagttcctcatacagatcctgcagctcatggccaacagcacacagatgaagaaggttatgttaacagtatttaaacacaatcatggtgcctaccagttcttcagagaagcgttgcaatttgaaattgatgactcttcccccagcatgtccggttgctgtggggaggattgctcctatgagatcctgagccggaggaccaagtttggggacagccatcactcccacgcgggtgggcactgtggtggctgctgccactgaactctcagagccactttcaagtcacaatgctctctcctaaggcctttcctctttcctggtctcactgttcaccgggtgtcctcagagctgtggcctccccagccctgcacgtgccaggctgcgccctgagagcacagaaccctggggagaagtggtatcagctgctcctcctctcctaggagaccagagtgctagaagggaatgaaagggagagggaagagtaggtggggccgggcagtgaagctcatcctccacagtggctgcctcctcatttggctcctggggcctgcagtggaggttctcgcacctctgcagcccctagattcctggcaacctcccctcccctgacacatacacacttggacaaatggaatgtttatgtccacctttatgaaagttctggagtcctgggtctggggtttgctggtccccaaagaggaacacactgggtgtaagatctgggtgtagagggcggcttcagagagactcacgcttgcgcagttggaattgctgttaacggagactgggaagatcttttgtgccaagatgcagggaaatgaagaaagctctttccagctgtttttatggattcatggagtgggctcatgttgggaccagctgactctgggaggaagactgcctctccatcgctgtcagagagcctgaaaggaccaacaatgagatcatggattcctgatacctctcactcaaggggaccaaaagggacccccccgtgttcatcccttgtaagcttgttatcactggaatcaaagggaaaaagtgatctcttcttgcattggttgtatttgtatgtcacaaataaaagacactttggtcaaaaaaaga

SEQ ID NO: 27645 - DNA, 3815 bp, Homo sapiens
cttgattttccatttggagttgtaaccaggtaaagtcagtgtgcagcagatcaggtagcctcttctttgggttagctgtgctgtgagcaggttgtatgcccacaggctaatgaggtctcctcttgccctgtcaggtgatgccaaacttaactctcctgggcctttccaccaaagccttcctcgcacatgtgacttcagagctaggcaaatggtgggttttgggaggctgctcctggttctgaagttagtctcccgttgtgggtccccacagcatcccactccaagacaacagctcttgggataggatctgcacctccgccccacttgtctgtgctgttcctcttttctttccctccacagcttggagaccctctggaggctttcccagtgttcaagaaatatgatagaaacgggttgaatgtctccattgaatgtaagcgagtgtctggactggagccagccaccgtggattgggccttcgacctgaccaaaacgaatatgcaaaccatgtatgagcagagcgagtggggctggaaggaccgagagaaacgggaggaaatgacagatgaccgagcctggtacctcatcgcgtgggaaaacagctccgtccctgttgccttttctcacttccggtttgacgtggagtgtggggatgaagtcctgtactgctatgaagtgcagttggaaagcaaggtgcggcggaaaggcctggggaagttcctcatacagatcctgcagctcatggccaacagcacacagatgaagaaggttatgttaacagtatttaaacacaatcatggtgcctaccagttcttcagagaagcgttgcaatttgaaattgatgactcttcccccagcatgtccggttgctgtggggaggattgctcctatgagatcctgagccggaggaccaagtttggggacagccatcactcccacgcgggtgggcactgtggtggctgctgccactgaactctcagagccactttcaagtcacaatgctctctcctaaggcctttcctctttcctggtctcactgttcaccgggtgtcctcagagctgtggcctccccagccctgcacgtgccaggctgcgccctgagagcacagaaccctggggagaagtggtatcagctgctcctcctctcctaggagaccagagtgctagaagggaatgaaagggagagggaagagtaggtggggccgggcagtgaagctcatcctccacagtggctgcctcctcatttggctcctggggcctgcagtggaggttctcgcacctctgcagcccctagattcctggcaacctcccctcccctgacacatacacacttggacaaatggaatgtttatgtccacctttatgaaagttctggagtcctgggtctggggtttgctggtccccaaagaggaacacactgggtgtaagatctgggtgtagagggcggcttcagagagactcacgcttgcgcagttggaattgctgttaacggagactgggaagatcttttgtgccaagatgcagggaaatgaagaaagctctttccagctgtttttatggattcatggagtgggctcatgttgggaccagctgactctgggaggaagactgcctctccatcgctgtcagagagcctgaaaggaccaacaatgaggtgttcttgggacccgccatggggatgattgcttctctaggctcctggatgttgctgcattctaagcttaacctcctggtctcatggcagtgacttgagcttttgattcatagaagaaagccagaggttctgcttgttcttgtctgccagccctcgtcgttctttctcctctgcctctcacctctaccccaaatacctctgttcttagtctcaaggggagaataacatcagggagcccctcatcttccccagaaggacttctcgttcctcatgtagttaactccattgattttcctatcttggtgctgatagctctctaagggtagggcacacctccccacagccaccctccctcttcagagagcccccagccagcagcaggcccctctgcctgcactcctcaggcttgcccctcgctgcctcagtgaggcactagtgccactgccgtggcccagccgggccatagctcaggctgcagcagaaatgcctctcagtggccaacagttgcttttctctctggtgtcaccctgtggcaacaggctggagcaggggaaggagaaagccttcctcttctctcataggatagaaaggcaggctcagaactaatgctcatcctgatctctaggccttgttcctcttccagggaagaaaagccaaatccttatcaaggaaaaagcacctaacagctccctttggatatccctgagctctgctgtggggagtatcataaaggttctagccttcgtgaagttgttctcgtggaggtctgttggtccctctgacctcagcatctgctcacatcccaccctctgcccaactctggcagtctctcctggcagatctccccagagtggtccttgcttctcacctggattcctgcttgtgcaggagcctgtgtacacagggcctccctcacccagcctggcccctctgctgagcactttgcgctgctcttgatgggcagcagtgggactgggaactccttagagagggccttgcagctttacactggaataagtctgcctctgcctctgcctcaccctgctggctcctggtgggtttcatcccaggcagagttgacattgctggaggggtttggtggactcctaagaatcatgaaaccacaggagcatgtttaggaagagatttgtctctggtccctgtctctgaaaggacacagatgctaaatatttattgtcttagatcatggattcctgatacctctcactcaaggggaccaaaagggacccccccgtgttcatcccttgtaaggtgagttcagtctacgttgtctctttccagtcactggatgcgtggcaccaactggtcaatgggtgcttggtgccataccctgctcaccctagtctctgcaggccatgtcctgaagggttcctcaggaggtcgggactagggtgggagaggcactatctgagacctgcaatcactcttgttggtcttgagcccattcatttccaaaacatccatctttctccacttcccccaggtcttggttttgagaaacagcaggcatggctgagtgcggtggcttacacctgtaatcccagcactttgggaggctgaggcaggcgggtcacctgaggtcaggagttcaagaccagcctggtcaacatggcaaaagcccatctctactaaaaaatacaaaaattagccaggcgtggttgtggcctgtaatcccagctactcgggaggctgaggcaggagactcgcttgaacccaggaggtggaggttgtggtgagctgagatcacgccattgcactccagcctaggcgacagagtgagactccatctcaaaaaaaaaaaaagagaaacatagcaggccttttttaccaggctttttgtgttttgtttgtttgtttggagcatgttaagatttttttaagatttttaaaattttagttatatccaccctatttcaggttatttttgttggtgtcaagtatgtataggacatgtgaatggttctttttaatttttttttaagaggaaatttggaagataaactccttgatatatatatatatatatatttttttttctttagcagcttgttatcactggaatcaaagggaaaaagtgatctcttcttgcattggttgtatttgtatgtcacaaataaaagacactttggtcaaaaaaaga

SEQ ID NO: 27646 - DNA, 585 bp, Homo sapiens
  misc_feature (103)..(103): n is a, c, g, or t
  misc_feature (306)..(306): n is a, c, g, or t
atgggctgctgtggctgctctggaggctgtggctccggctgtgggggctgtggctccggctgtgggggctgcggctctggctgtgggggatgtggctctagcngctgtgtgcccatctgctgctgcaagcccgtgtgctgctgtgtgccagcctgttcctgctccagctgtggctcctgtgggggctccaaggggggccgtggctcctgtgggggctccaagggggactgtggctcctgtgggggctccaagggaggctgtggttcttgtggctgctcccagtgcagctgctataagccctgctgntgctcctcaggctgtgggtcatcctgctgccagtccagctgctgcaaaccctgctgttcccagtccagctgttgtaagccctgcagctgctcttcaggctgtgggtcatcctgctgccagtccagctgctgcaagccctgctgttcccagtccagctgctgtaagccctgctgctgctcttcaggctgtgggtcatcctgctgccagtccagctgctgcaagccctgctgttcccagtccagctgctgtgtcccaatttgctgccagtgcaagatctga

SEQ ID NO: 27647 - DNA, 126 bp, Homo sapiens
tttatattttcttgtgttttcatgacagtaaatattgctcttcacttcccggtataagactccttttagtattttctgtacggcccatctactggtgattaatttcctcagcttttgcttgtttgg

SEQ ID NO: 27648 - DNA, 582 bp, Homo sapiens
ggcaccactgggatgggacctctagggtatttactgtcattaatgttaatgtggcatccctgtgagtgtcaggattcacagcttgtggctattcacatccgagatgcctcagttcggtttgcctggttcttactgagtgcagaccagggtctccattgtggcttctgccttcctctgccccagatccagggatgctgatagccgtgcggctgtgttcctagtccccagaaagtggccctgaaggtaggtgctcccttttgcacttgtgggtgcttccagcgcttccacctgcccaaggcctgcccgtgagtgagagacagagatagagagagagagagagaccttttcctcccaagagaatttacccccgagtacccactctgagggtgacttgctctggttatgcaacccgcattttgtagagggcttgacagtttccagagactcacgcagcgtttgatcctctgtggcggccctgggaggtttgcttgtttagttataccctgctggaggcagctaacaggaaacactgtaaagtgtttaaatggtacactttaaaatggtaaaatgtacatttaaaaa

SEQ ID NO: 27649 - DNA, 562 bp, Homo sapiens
agtttcagagtgtaaatggggcaggttacagtattaaatagaagatagtgtaggctttattgagaagttgagatttgaggcaagacggaatggaggtgaggtgagtatacttgccaagcagattatctgtgggaatagcatatactaggcaggcgaatcagtgagcaaagtttctgatcaccaagtatgactggcaaggaggctagctgtggccatagcagagagagcaagtagaagaggttagggaggtaatggggggccagatcaagtagagcctgggaggccaccataagaaaactggcttctattgtgaatcaaatggggagccactgcagggttttgagtaaagctgctatgtagagattaaattttaagagagtaaggcaaaaacaggaagaccagttagaaggctgttggtataatctaggtaagagataacagtggtgtctgtctctacagcagggacttgacctttaaagtctttaaaaacctttaaagtctaatttttaaaaagctgttgacagcaaaaaaaaaaaaaaaagaaccaaaagaagtaaaaaaa

SEQ ID NO: 27650 - DNA, 900 bp, Homo sapiens
atgcttcggttattctatttctctgctattattgcctcagttattttaaattttgtaggaatcattatgaatctgtttattacagtggtcaattgcaaaacttgggtcaaaagccatagaatctcctcttctgataggattctgttcagcctgggcatcaccaggtttcttatgctgggactatttctggtgaacaccatctacttcgtctcttcaaatacggaaaggtcagtctacctgtctgctttttttgtgttgtgtttcatgtttttggactcgagcagtgtctggtttgtgaccttgctcaatatcttgtactgtgtgaagattactaacttccaacactcagtgtttctcctgctgaagcggaatatctccccaaagatccccaggctgctgctggcctgtgtgctgatttctgctttcaccacttgcctgtacatcacgcttagccaggcatcaccttttcctgaacttgtgactacgagaaataacacatcatttaatatcagtgagggcatcttgtctttagtggtttctttggtcttgagctcatctctccagttcatcattaatgtgacttctgcttccttgctaatacactccttgaggagacatatacagaagatgcagaaaaatgccactggtttctggaatccccagacggaagctcatgtaggtgctatgaagctgatggtctatttcctcatcctctacattccatattcagttgctaccctggtccagtatctccccttttatgcagggatggatatggggaccaaatccatttgtctgatttttgccaccctttactctccaggacattctgttctcattattatcacacatcctaaactgaaaacaacagcaaagaagattctttgtttcaaaaaatag

SEQ ID NO: 27651 - DNA, 571 bp, Homo sapiens
  misc_feature (487)..(487): n is a, c, g, or t
cacgttaagtgcttagaacatggcgtgtgacagagtaagttctgtatacctggaaatgttagctgtcctcatcatcatcagacccagggctgagcaggctgactcctcatactcttcattacccagagcatagttccatttcctctcactgtcccacttaggccttcaggatactttgagatccccggagaagctggccagatttcctgcagtggtagggggtgcccagggagtctgaggctgtgggggaattcttagggtgaaaaggcccaggtctccccctgctaccttcaccctggcagatgatggtgaatgtgccgctcttcgcggggaacccccaactgcaggagcagctccgcctgcagctcccagtcttcctgcagcagatgcagaacccagagtcactctccatccttaccaatccccgagccatgcaggcattgctgcagatccagcagggactacagacttgcagtgagccaagatngcgccactgcactccagcctgggtgacagagcgagactccgtctcaaaaaaaaaaaaaaaaaaaaaatgtgtggactgtgataa

SEQ ID NO: 27652 - DNA, 3763 bp, Homo sapiens
ccccaagagtagtagtagtagtagtaccatacgatcgtactgaccacctgtcgtttacccagccctagacatgctgctactgctattccatggatcctaggtcacaccaccttaagcgccggcgcagctgcggcccgcccgcccctcctcctcctcggcccgcccgaccgcccgccggcccaccgccgccgccgtaccgcctcggctcgccccggctctgctccggggggtaagcccagtggcagttctgggggttcctgttcctcctttgcggcggcatggcggagccgagagcggggccgagacgaggccccccattcgggtcaccgtcaagacccccaaggacaaggaggaaattgtgatctgcgatcgagcctcggtcaaggagttcaaagaggaaatctcccggaggtttaaggctcagcaggatcagctggtcctgatcttcgcaggcaagatcctcaaggatggggacacactgaaccagcacggaatcaaggacgggctcactgtccatctggtcatcaagacccctcagaaggctcaagatccagctgctgccactgcttcttccccctccacacctgaccctgcctcagcaccctccaccacgcctgcttcacccgccacccctgcccagccctccacctctggcagtgcctcttcagatgctggcagtggaagccggaggagcagtggtggggggccctctccgggggctggggagggatcccccagtgctactgcgtccatactctctggctttgggggcatcctggggctgggcagcctaggcctgggctctgccaacttcatggagctgcagcagcagatgcagcggcagctgatgtccaatcctgagatgctgtcacagatcatggagaaccccctggtccaggatatgatgtctaaccctgatctgatgcgtcacatgattatggccaacccccagatgcagcagttgatggagcggaaccctgagatcagccacatgctcaataaccctgaactcatgaggcagacaatggagcttgctcggaatccagccatgatgcaagagatgatgcggaaccaggaccgggccctgagcaaccttgagagcatccctggagggtataatgccctccgccgcatgtacacggacatccaggagcccatgttcagtgctgcccgggaacagtttggcaacaatcccttctcttccctggccgggaactccgacagctcatcctcccagcctctgcggactgagaatcgagagcccctccctaacccctggagcccctcgccccccacctcccaggcccccgggtccggtggggagggcaccggaggatcggggaccagccaggtgcacccgacagtctcgaacccctttgggatcaatgcggctagcctggggtcagggatgttcaatagcccagaaatgcaagccctcctccagcagatctctgagaacccccagctgatgcagaatgtgatctcagcaccctacatgcgcagcatgatgcagacgcttgcccagaaccccgactttgctgctcagatgatggtgaatgtgccgctcttcgcggggaacccccaactgcaggagcagctccgcctgcagctcccagtcttcctgcagcagatgcagaacccagagtcactctccatccttaccaatccccgagccatgcaggcattgctgcagatccagcagggactacagaccttgcagaccgaggcccctgggctggtacccagccttggctcctttgggatgtcccggaccccagcaccctcagcaggcagcaacgcagggtctacgcccgaggcccccacttcctcaccagccacgccagccacatcttctccaacaggggcttccagcgcccagcagcaactcatgcagcagatgatccagcttttggctggaagtggaaactcacaggtgcagacgccagaagtgagatttcagcagcagctggagcagctcaactccatgggcttcatcaatcgtgaggctaacctgcaggccctgattgccacaggaggggacatcaacgcagctatcgagagactgctgggctcccagctctcctaatccctcggcccatgcctcctgcctctcccctccctcgatgtcagcattcggttcttctgtcaatccttaccctctgcagcttgtcctcccttccgtcttctccctcatcctttccaaacagcagggtgactttagaggcatgggctccaaccccttagctctgtctgagaattatggttttactgctacgtctctaacagactcttctctcctggtctccttgagcagtgctacttaaacagttttcacagtttcattgattgactctacctccttgccccacaccacttttgcaatctttaaactttcagtggctgtgcagagtcgagggaggaaccagctctctggtttactggaacatagtcttccatctataccactagggttttgtcttatgtttacttttggtaactctcttccttctttttctccctaccccccaacccctagcccaaccaatgctagaatttcttgctctgaaggaggagcaggtgaaacaggtggtaattttccttctcggcccctattctggttcattcagcactttttggtgggaactgttggaaattccagggtaaggaggaagatgcctgttctccctgtctgaagagggagatgagacagctctctggacaggaattaacaaacgctggagcagcccagaggaaattcgtgtgaaagaggagggaatgagattattcggaggaagggaatgggggagacagcctgagtaaaaggcttggaagttggaattaacagtggggagcagaagcactcatagctcttttaggcagaagaatccaggcccgagctggcagaagagacttagagatgctaatggaatttaaactgaaaaaaggagcccaatgaagctaagcgccacgccccacaaggggtcatattggctttagttcctcaagcatatgtgcttatatgcacacacacacacatttccatggacccaggtcttgcttgtgtccccaggcaccagtagtttgagcccccctcaaaagacatgaagggggttggggtctgtgtgagtagtggggaggtgcatgtgtatccacatgtgtgcatacactcttaagttgggtgggaagtggattccttgttggtttctggttcagagtgctctcccaccaccagagacaagtgggtaaaaaggtcagtccattgcaggaatatatatccgggagagctaggtcccttggggctctggatgctgggtaacccagaggtaatgtgggtaccctttctgaagctgtcagggctgtgactagcacccttatcacccctcactgccttgtgggaatagtagagggtttttttcctccagaccccctggcctttcagttcttaactatttccctccaggccagaaagttttctttgaggaaggagaggagagggtggcaatgatgcctttgatctggaattggacatttctctgtcagagcacagaggaggctcatatcacctcttccctctcctacttggcccagctgcttggaggaccgaccccatggctgagaatatgacggcaagaggaacagagtttgctccaagtgggaaagggtcccaagcagtccagagaagatgtctgtgtggctttccctccctgcctcccccagctcccacactggcctttgtaaataaatggcgtggtctttgttgtga

SEQ ID NO: 27653 - DNA, 3535 bp, Homo sapiens
gaggaggaggagccgggcgggctggcgggcggccgggtggcggcggcggcatggcggagccgagagcggggccgagacgaggccccccattcgggtcaccgtcaagacccccaaggacaaggaggaaattgtgatctgcgatcgagcctcggtcaaggagttcaaagaggaaatctcccggaggtttaaggctcagcaggatcagctggtcctgatcttcgcaggcaagatcctcaaggatggggacacactgaaccagcacggaatcaaggacgggctcactgtccatctggtcatcaagacccctcagaaggctcaagatccagctgctgccactgcttcttccccctccacacctgaccctgcctcagcaccctccaccacgcctgcttcacccgccacccctgcccagccctccacctctggcagtgcctcttcagatgctggcagtggaagccggaggagcagtggtggggggccctctccgggggctggggagggatcccccagtgctactgcgtccatactctctggctttgggggcatcctggggctgggcagcctaggcctgggctctgccaacttcatggagctgcagcagcagatgcagcggcagctgatgtccaatcctgagatgctgtcacagatcatggagaaccccctggtccaggatatgatgtctaaccctgatctgatgcgtcacatgattatggccaacccccagatgcagcagttgatggagcggaaccctgagatcagccacatgctcaataaccctgaactcatgaggcagacaatggagcttgctcggaatccagccatgatgcaagagatgatgcggaaccaggaccgggccctgagcaaccttgagagcatccctggagggtataatgccctccgccgcatgtacacggacatccaggagcccatgttcagtgctgcccgggaacagtttggcaacaatcccttctcttccctggccgggaactccgacagctcatcctcccagcctctgcggactgagaatcgagagcccctccctaacccctggagcccctcgccccccacctcccaggcccccgggtccggtggggagggcaccggaggatcggggaccagccaggtgcacccgacagtctcgaacccctttgggatcaatgcggctagcctggggtcagggatgttcaatagcccagaaatgcaagccctcctccagcagatctctgagaacccccagctgatgcagaatgtgatctcagcaccctacatgcgcagcatgatgcagacgcttgcccagaaccccgactttgctgctcagatgatggtgaatgtgccgctcttcgcggggaacccccaactgcaggagcagctccgcctgcagctcccagtcttcctgcagcagatgcagaacccagagtcactctccatccttaccaatccccgagccatgcaggcattgctgcagatccagcagggactacagaccttgcagaccgaggcccctgggctggtacccagccttggctcctttgggatgtcccggaccccagcaccctcagcaggcagcaacgcagggtctacgcccgaggcccccacttcctcaccagccacgccagccacatcttctccaacaggggcttccagcgcccagcagcaactcatgcagcagatgatccagcttttggctggaagtggaaactcacaggtgcagacgccagaagtgagatttcagcagcagctggagcagctcaactccatgggcttcatcaatcgtgaggctaacctgcaggccctgattgccacaggaggggacatcaacgcagctatcgagagactgctgggctcccagctctcctaatccctcggcccatgcctcctgcctctcccctccctcgatgtcagcattcggttcttctgtcaatccttaccctctgcagcttgtcctcccttccgtcttctccctcatcctttccaaacagcagggtgactttagaggcatgggctccaaccccttagctctgtctgagaattatggttttactgctacgtctctaacagactcttctctcctggtctccttgagcagtgctacttaaacagttttcacagtttcattgattgactctacctccttgccccacaccacttttgcaatctttaaactttcagtggctgtgcagagtcgagggaggaaccagctctctggtttactggaacatagtcttccatctataccactagggttttgtcttatgtttacttttggtaactctcttccttctttttctccctaccccccaacccctagcccaaccaatgctagaatttcttgctctgaaggaggagcaggtgaaacaggtggtaattttccttctcggcccctattctggttcattcagcactttttggtgggaactgttggaaattccagggtaaggaggaagatgcctgttctccctgtctgaagagggagatgagacagctctctggacaggaattaacaaacgctggagcagcccagaggaaattcgtgtgaaagaggagggaatgagattattcggaggaagggaatgggggagacagcctgagtaaaaggcttggaagttggaattaacagtggggagcagaagcactcatagctcttttaggcagaagaatccaggcccgagctggcagaagagacttagagatgctaatggaatttaaactgaaaaaaggagcccaatgaagctaagcgccacgccccacaaggggtcatattggctttagttcctcaagcatatgtgcttatatgcacacacacacacatttccatggacccaggtcttgcttgtgtccccaggcaccagtagtttgagcccccctcaaaagacatgaagggggttggggtctgtgtgagtagtggggaggtgcatgtgtatccacatgtgtgcatacactcttaagttgggtgggaagtggattccttgttggtttctggttcagagtgctctcccaccaccagagacaagtgggtaaaaaggtcagtccattgcaggaatatatatccgggagagctaggtcccttggggctctggatgctgggtaacccagaggtaatgtgggtaccctttctgaagctgtcagggctgtgactagcacccttatcacccctcactgccttgtgggaatagtagagggtttttttcctccagaccccctggcctttcagttcttaactatttccctccaggccagaaagttttctttgaggaaggagaggagagggtggcaatgatgcctttgatctggaattggacatttctctgtcagagcacagaggaggctcatatcacctcttccctctcctacttggcccagctgcttggaggaccgaccccatggctgagaatatgacggcaagaggaacagagtttgctccaagtgggaaagggtcccaagcagtccagagaagatgtctgtgtggctttccctccctgcctcccccagctcccacactggcctttgtaaataaatggcgtggtctttgttgtga

SEQ ID NO: 27654 - DNA, 3735 bp, Homo sapiens
gaggaggaggagccgggcgggctggcgggcggccgggtggcggcggcggcatggcggagccgagagcggggccgagacgaggccccccattcgggtcaccgtcaagacccccaaggacaaggaggaaattgtgatctgcgatcgagcctcggtcaaggagttcaaagaggaaatctcccggaggtttaaggctcagcaggatcagctggtcctgatcttcgcaggcaagatcctcaaggatggggacacactgaaccagcacggaatcaaggacgggctcactgtccatctggtcatcaagacccctcagaaggctcaagatccagctgctgccactgcttcttccccctccacacctgaccctgcctcagcaccctccaccacgcctgcttcacccgccacccctgcccagccctccacctctggcagtgcctcttcagatgctggcagtggaagccggaggagcagtggtggggggccctctccgggggctggggagggatcccccagtgctactgcgtccatactctctggctttgggggcatcctggggctgggcagcctaggcctgggctctgccaacttcatggagctgcagcagcagatgcagcggcagctgatgtccaatcctgagatgctgtcacagatcatggagaaccccctggtccaggatatgatgtctaaccctgatctgatgcgtcacatgattatggccaacccccagatgcagcagttgatggagcggaaccctgagatcagccacatgctcaataaccctgaactcatgaggcagacaatggagcttgctcggaatccagccatgatgcaagagatgatgcggaaccaggaccgggccctgagcaaccttgagagcatccctggagggtataatgccctccgccgcatgtacacggacatccaggagcccatgttcagtgctgcccgggaacagtttggcaacaatcccttctcttccctggccgggaactccgacagctcatcctcccagcctctgcggactgagaatcgagagcccctccctaacccctggagcccctcgccccccacctcccaggcccccgggtccggtggggagggcaccggaggatcggggaccagccaggtgcacccgacagtctcgaacccctttgggatcaatgcggctagcctggggtcagggatgttcaatagcccagaaatgcaagccctcctccagcagatctctgagaacccccagctgatgcagaatgtgatctcagcaccctacatgcgcagcatgatgcagacgcttgcccagaaccccgactttgctgctcagatgatggtgaatgtgccgctcttcgcggggaacccccaactgcaggagcagctccgcctgcagctcccagtcttcctgcagcagatgcagaacccagagtcactctccatccttaccaatccccgagccatgcaggcattgctgcagatccagcagggactacagaccttgcagaccgaggcccctgggctggtacccaggtgagggtaggggggcaggagggcagcaaggttctagcaacttctccccttcaactcttctctctgccactctctcagcatcctttgtgtctctgagggtctgttttcctgtttcttccaactgcttttccttctggatctcacattctcatccctttcttggatgccatctcctacctcttggtctctcttgcctacagccttggctcctttgggatgtcccggaccccagcaccctcagcaggcagcaacgcagggtctacgcccgaggcccccacttcctcaccagccacgccagccacatcttctccaacaggggcttccagcgcccagcagcaactcatgcagcagatgatccagcttttggctggaagtggaaactcacaggtgcagacgccagaagtgagatttcagcagcagctggagcagctcaactccatgggcttcatcaatcgtgaggctaacctgcaggccctgattgccacaggaggggacatcaacgcagctatcgagagactgctgggctcccagctctcctaatccctcggcccatgcctcctgcctctcccctccctcgatgtcagcattcggttcttctgtcaatccttaccctctgcagcttgtcctcccttccgtcttctccctcatcctttccaaacagcagggtgactttagaggcatgggctccaaccccttagctctgtctgagaattatggttttactgctacgtctctaacagactcttctctcctggtctccttgagcagtgctacttaaacagttttcacagtttcattgattgactctacctccttgccccacaccacttttgcaatctttaaactttcagtggctgtgcagagtcgagggaggaaccagctctctggtttactggaacatagtcttccatctataccactagggttttgtcttatgtttacttttggtaactctcttccttctttttctccctaccccccaacccctagcccaaccaatgctagaatttcttgctctgaaggaggagcaggtgaaacaggtggtaattttccttctcggcccctattctggttcattcagcactttttggtgggaactgttggaaattccagggtaaggaggaagatgcctgttctccctgtctgaagagggagatgagacagctctctggacaggaattaacaaacgctggagcagcccagaggaaattcgtgtgaaagaggagggaatgagattattcggaggaagggaatgggggagacagcctgagtaaaaggcttggaagttggaattaacagtggggagcagaagcactcatagctcttttaggcagaagaatccaggcccgagctggcagaagagacttagagatgctaatggaatttaaactgaaaaaaggagcccaatgaagctaagcgccacgccccacaaggggtcatattggctttagttcctcaagcatatgtgcttatatgcacacacacacacatttccatggacccaggtcttgcttgtgtccccaggcaccagtagtttgagcccccctcaaaagacatgaagggggttggggtctgtgtgagtagtggggaggtgcatgtgtatccacatgtgtgcatacactcttaagttgggtgggaagtggattccttgttggtttctggttcagagtgctctcccaccaccagagacaagtgggtaaaaaggtcagtccattgcaggaatatatatccgggagagctaggtcccttggggctctggatgctgggtaacccagaggtaatgtgggtaccctttctgaagctgtcagggctgtgactagcacccttatcacccctcactgccttgtgggaatagtagagggtttttttcctccagaccccctggcctttcagttcttaactatttccctccaggccagaaagttttctttgaggaaggagaggagagggtggcaatgatgcctttgatctggaattggacatttctctgtcagagcacagaggaggctcatatcacctcttccctctcctacttggcccagctgcttggaggaccgaccccatggctgagaatatgacggcaagaggaacagagtttgctccaagtgggaaagggtcccaagcagtccagagaagatgtctgtgtggctttccctccctgcctcccccagctcccacactggcctttgtaaataaatggcgtggtctttgttgtga

SEQ ID NO: 27655 - DNA, 4497 bp, Homo sapiens
  misc_feature (3765)..(3765): n is a, c, g, or t
ccccaagagtagtagtagtagtagtaccatacgatcgtactgaccacctgtcgtttacccagccctagacatgctgctactgctattccatggatcctaggtcacaccaccttaagcgccggcgcagctgcggcccgcccgcccctcctcctcctcggcccgcccgaccgcccgccggcccaccgccgccgccgtaccgcctcggctcgccccggctctgctccggggggtaagcccagtggcagttctgggggttcctgttcctcctttgcggcggcatggcggagccgagagcggggccgagacgaggccccccattcgggtcaccgtcaagacccccaaggacaaggaggaaattgtgatctgcgatcgagcctcggtcaaggagttcaaagaggaaatctcccggaggtttaaggctcagcaggatcagctggtcctgatcttcgcaggcaagatcctcaaggatggggacacactgaaccagcacggaatcaaggacgggctcactgtccatctggtcatcaagacccctcagaaggctcaagatccagctgctgccactgcttcttccccctccacacctgaccctgcctcagcaccctccaccacgcctgcttcacccgccacccctgcccagccctccacctctggcagtgcctcttcagatgctggcagtggaagccggaggagcagtggtggggggccctctccgggggctggggagggatcccccagtgctactgcgtccatactctctggctttgggggcatcctggggctgggcagcctaggcctgggctctgccaacttcatggagctgcagcagcagatgcagcggcagctgatgtccaatcctgagatgctgtcacagatcatggagaaccccctggtccaggatatgatgtctaaccctgatctgatgcgtcacatgattatggccaacccccagatgcagcagttgatggagcggaaccctgagatcagccacatgctcaataaccctgaactcatgaggcagacaatggagcttgctcggaatccagccatgatgcaagagatgatgcggaaccaggaccgggccctgagcaaccttgagagcatccctggagggtataatgccctccgccgcatgtacacggacatccaggagcccatgttcagtgctgcccgggaacagtttggcaacaatcccttctcttccctggccgggaactccgacagctcatcctcccagcctctgcggactgagaatcgagagcccctccctaacccctggagcccctcgccccccacctcccaggcccccgggtccggtggggagggcaccggaggatcggggaccagccaggtgcacccgacagtctcgaacccctttgggatcaatgcggctagcctggggtcagggatgttcaatagcccagaaatgcaagccctcctccagcagatctctgagaacccccagctgatgcagaatgtgatctcagcaccctacatgcgcagcatgatgcagacgcttgcccagaaccccgactttgctgctcagatgatggtgaatgtgccgctcttcgcggggaacccccaactgcaggagcagctccgcctgcagctcccagtcttcctgcagcagatgcagaacccagagtcactctccatccttaccaatccccgagccatgcaggcattgctgcagatccagcagggactacagaccttgcagaccgaggcccctgggctggtacccagccttggctcctttgggatgtcccggaccccagcaccctcagcaggcagcaacgcagggtctacgcccgaggcccccacttcctcaccagccacgccagccacatcttctccaacaggggcttccagcgcccagcagcaactcatgcagcagatgatccagcttttggctggaagtggaaactcacaggtgcagacgccagaagtgagatttcagcagcagctggagcagctcaactccatgggcttcatcaatcgtgaggctaacctgcaggccctgattgccacaggaggggacatcaacgcagctatcgagagactgctgggctcccagctctcctaatccctcggcccatgcctcctgcctctcccctccctcgatgtcagcattcggttcttctgtcaatccttaccctctgcagcttgtcctcccttccgtcttctccctcatcctttccaaacagcagggtgactttagaggcatgggctccaaccccttagctctgtctgagaattatggttttactgctacgtctctaacagactcttctctcctggtctccttgagcagtgctacttaaacagttttcacagtttcattgattgactctacctccttgccccacaccacttttgcaatctttaaactttcagtggctgtgcagagtcgagggaggaaccagctctctggtttactggaacatagtcttccatctataccactagggttttgtcttatgtttacttttggtaactctcttccttctttttctccctaccccccaacccctagcccaaccaatgctagaatttcttgctctgaaggaggagcaggtgaaacaggtggtaattttccttctcggcccctattctggttcattcagcactttttggtgggaactgttggaaattccagggtaaggaggaagatgcctgttctccctgtctgaagagggagatgagacagctctctggacaggaattaacaaacgctggagcagcccagaggaaattcgtgtgaaagaggagggaatgagattattcggaggaagggaatgggggagacagcctgagtaaaaggcttggaagttggaattaacagtggggagcagaagcactcatagctcttttaggcagaagaatccaggcccgagctggcagaagagacttagagatgctaatggaatttaaactgaaaaaaggagcccaatgaagctaagcgccacgccccacaaggggtcatattggctttagttcctcaagcatatgtgcttatatgcacacacacacacatttccatggacccaggtcttgcttgtgtccccaggcaccagtagtttgagcccccctcaaaagacatgaagggggttggggtctgtgtgagtagtggggaggtgcatgtgtatccacatgtgtgcatacactcttaagttgggtgggaagtggattccttgttggtttctggttcagagtgctctcccaccaccagagacaagtgggtaaaaaggtcagtccattgcaggaatatatatccgggagagctaggtcccttggggctctggatgctgggtaacccagaggtaatgtgggtaccctttctgaagctgtcagggctgtgactagcacccttatcacccctcactgccttgtgggaatagtagagggtttttttcctccagaccccctggcctttcagttcttaactatttccctccaggccagaaagttttctttgaggaaggagaggagagggtggcaatgatgcctttgatctggaattggacatttctctgtcagagcacagaggaggctcatatcacctcttccctctcctacttggcccagctgcttggaggaccgaccccatggctgagaatatgacggcaagaggaacagagtttgctccaagtgggaaagggtcccaagcagtccagagaagatgtctgtgtggctttccctccctgcctcccccagctcccacactggcctttgtaaataaatggcgtggtctttgttgtgaanaaaaaaaaaaaagaaaaaaaaaaaaaaaaaaaaaaaaaaagcggagaagatttcccccagggggggacagggggagagggggggaaagggagaaaagggggccaccgaccacaattaaccggcggggaaaagggcgcgccaaaggaacacatattggggcgcagcctacagttggaacttggcgggaccacaaaaagagagtgggacaccatcacgcagtgggcgagagataaacgtggtcatggccctggtcggaaacccccaacggacgggggagaaacaacggcgtgaggcaacccaaatcacgcggcgcgacaaaataacagcgcacccgcacagagaatgaagacaacccgaccacacgggcgtaggaacccctgggacttaaaacagcgacgccaaagaggggcgtcaggccagtgaaccaagcaacacctgtggagctcataccacgcacagggctgtcgccagccaagggggtgcgcaaattatggggtcccaaaaagagaggcacagcgacaactcaacagaacaccactaccgcggggcgagcgcgcaccccccggggcggggaacccatctgggcaccacgatgaaaccaaagagtcccgccggtgttggcaacgggaattcctggcgccacgaaagacgcgcaggccagtgcacagagacaaccagtgggagagaacggccaccacataggggcagaacgccgggagggtggccaggggc

SEQ ID NO: 27656 - DNA, 3341 bp, Homo sapiens
gaggaggaggagccgggcgggctggcgggcggccgggtggcggcggcggcatggcggagccgagagcggggccgagacgaggccccccattcgggtcaccgtcaagacccccaaggacaaggaggaaattgtgatctgcgatcgagcctcggtcaaggagttcaaagaggaaatctcccggaggtttaaggctcagcaggatcagctggtcctgatcttcgcaggcaagatcctcaaggatggggacacactgaaccagcacggaatcaaggacgggctcactgtccatctggtcatcaagacccctcagaaggctcaagatccagctgctgccactgcttcttccccctccacacctgaccctgcctcagcaccctccaccacgcctgcttcacccgccacccctgcccagccctccacctctggcagtgcctcttcagatgctggcagtggaagccggaggagcagtggtggggggccctctccgggggctggggagggatcccccagtgctactgcgtccatactctatgcagcagttgatggagcggaaccctgagatcagccacatgctcaataaccctgaactcatgaggcagacaatggagcttgctcggaatccagccatgatgcaagagatgatgcggaaccaggaccgggccctgagcaaccttgagagcatccctggagggtataatgccctccgccgcatgtacacggacatccaggagcccatgttcagtgctgcccgggaacagtttggcaacaatcccttctcttccctggccgggaactccgacagctcatcctcccagcctctgcggactgagaatcgagagcccctccctaacccctggagcccctcgccccccacctcccaggcccccgggtccggtggggagggcaccggaggatcggggaccagccaggtgcacccgacagtctcgaacccctttgggatcaatgcggctagcctggggtcagggatgttcaatagcccagaaatgcaagccctcctccagcagatctctgagaacccccagctgatgcagaatgtgatctcagcaccctacatgcgcagcatgatgcagacgcttgcccagaaccccgactttgctgctcagatgatggtgaatgtgccgctcttcgcggggaacccccaactgcaggagcagctccgcctgcagctcccagtcttcctgcagcagatgcagaacccagagtcactctccatccttaccaatccccgagccatgcaggcattgctgcagatccagcagggactacagaccttgcagaccgaggcccctgggctggtacccagccttggctcctttgggatgtcccggaccccagcaccctcagcaggcagcaacgcagggtctacgcccgaggcccccacttcctcaccagccacgccagccacatcttctccaacaggggcttccagcgcccagcagcaactcatgcagcagatgatccagcttttggctggaagtggaaactcacaggtgcagacgccagaagtgagatttcagcagcagctggagcagctcaactccatgggcttcatcaatcgtgaggctaacctgcaggccctgattgccacaggaggggacatcaacgcagctatcgagagactgctgggctcccagctctcctaatccctcggcccatgcctcctgcctctcccctccctcgatgtcagcattcggttcttctgtcaatccttaccctctgcagcttgtcctcccttccgtcttctccctcatcctttccaaacagcagggtgactttagaggcatgggctccaaccccttagctctgtctgagaattatggttttactgctacgtctctaacagactcttctctcctggtctccttgagcagtgctacttaaacagttttcacagtttcattgattgactctacctccttgccccacaccacttttgcaatctttaaactttcagtggctgtgcagagtcgagggaggaaccagctctctggtttactggaacatagtcttccatctataccactagggttttgtcttatgtttacttttggtaactctcttccttctttttctccctaccccccaacccctagcccaaccaatgctagaatttcttgctctgaaggaggagcaggtgaaacaggtggtaattttccttctcggcccctattctggttcattcagcactttttggtgggaactgttggaaattccagggtaaggaggaagatgcctgttctccctgtctgaagagggagatgagacagctctctggacaggaattaacaaacgctggagcagcccagaggaaattcgtgtgaaagaggagggaatgagattattcggaggaagggaatgggggagacagcctgagtaaaaggcttggaagttggaattaacagtggggagcagaagcactcatagctcttttaggcagaagaatccaggcccgagctggcagaagagacttagagatgctaatggaatttaaactgaaaaaaggagcccaatgaagctaagcgccacgccccacaaggggtcatattggctttagttcctcaagcatatgtgcttatatgcacacacacacacatttccatggacccaggtcttgcttgtgtccccaggcaccagtagtttgagcccccctcaaaagacatgaagggggttggggtctgtgtgagtagtggggaggtgcatgtgtatccacatgtgtgcatacactcttaagttgggtgggaagtggattccttgttggtttctggttcagagtgctctcccaccaccagagacaagtgggtaaaaaggtcagtccattgcaggaatatatatccgggagagctaggtcccttggggctctggatgctgggtaacccagaggtaatgtgggtaccctttctgaagctgtcagggctgtgactagcacccttatcacccctcactgccttgtgggaatagtagagggtttttttcctccagaccccctggcctttcagttcttaactatttccctccaggccagaaagttttctttgaggaaggagaggagagggtggcaatgatgcctttgatctggaattggacatttctctgtcagagcacagaggaggctcatatcacctcttccctctcctacttggcccagctgcttggaggaccgaccccatggctgagaatatgacggcaagaggaacagagtttgctccaagtgggaaagggtcccaagcagtccagagaagatgtctgtgtggctttccctccctgcctcccccagctcccacactggcctttgtaaataaatggcgtggtctttgttgtga

SEQ ID NO: 27657 - DNA, 2519 bp, Homo sapiens
cacgttaagtgcttagaacatggcgtgtgacagagtaagttctgtatacctggaaatgttagctgtcctcatcatcatcagacccagggctgagcaggctgactcctcatactcttcattacccagagcatagttccatttcctctcactgtcccacttaggccttcaggatactttgagatccccggagaagctggccagatttcctgcagtggtagggggtgcccagggagtctgaggctgtgggggaattcttagggtgaaaaggcccaggtctccccctgctaccttcaccctggcagatgatggtgaatgtgccgctcttcgcggggaacccccaactgcaggagcagctccgcctgcagctcccagtcttcctgcagcagatgcagaacccagagtcactctccatccttaccaatccccgagccatgcaggcattgctgcagatccagcagggactacagaccttgcagaccgaggcccctgggctggtacccagccttggctcctttgggatgtcccggaccccagcaccctcagcaggcagcaacgcagggtctacgcccgaggcccccacttcctcaccagccacgccagccacatcttctccaacaggggcttccagcgcccagcagcaactcatgcagcagatgatccagcttttggctggaagtggaaactcacaggtgcagacgccagaagtgagatttcagcagcagctggagcagctcaactccatgggcttcatcaatcgtgaggctaacctgcaggccctgattgccacaggaggggacatcaacgcagctatcgagagactgctgggctcccagctctcctaatccctcggcccatgcctcctgcctctcccctccctcgatgtcagcattcggttcttctgtcaatccttaccctctgcagcttgtcctcccttccgtcttctccctcatcctttccaaacagcagggtgactttagaggcatgggctccaaccccttagctctgtctgagaattatggttttactgctacgtctctaacagactcttctctcctggtctccttgagcagtgctacttaaacagttttcacagtttcattgattgactctacctccttgccccacaccacttttgcaatctttaaactttcagtggctgtgcagagtcgagggaggaaccagctctctggtttactggaacatagtcttccatctataccactagggttttgtcttatgtttacttttggtaactctcttccttctttttctccctaccccccaacccctagcccaaccaatgctagaatttcttgctctgaaggaggagcaggtgaaacaggtggtaattttccttctcggcccctattctggttcattcagcactttttggtgggaactgttggaaattccagggtaaggaggaagatgcctgttctccctgtctgaagagggagatgagacagctctctggacaggaattaacaaacgctggagcagcccagaggaaattcgtgtgaaagaggagggaatgagattattcggaggaagggaatgggggagacagcctgagtaaaaggcttggaagttggaattaacagtggggagcagaagcactcatagctcttttaggcagaagaatccaggcccgagctggcagaagagacttagagatgctaatggaatttaaactgaaaaaaggagcccaatgaagctaagcgccacgccccacaaggggtcatattggctttagttcctcaagcatatgtgcttatatgcacacacacacacatttccatggacccaggtcttgcttgtgtccccaggcaccagtagtttgagcccccctcaaaagacatgaagggggttggggtctgtgtgagtagtggggaggtgcatgtgtatccacatgtgtgcatacactcttaagttgggtgggaagtggattccttgttggtttctggttcagagtgctctcccaccaccagagacaagtgggtaaaaaggtcagtccattgcaggaatatatatccgggagagctaggtcccttggggctctggatgctgggtaacccagaggtaatgtgggtaccctttctgaagctgtcagggctgtgactagcacccttatcacccctcactgccttgtgggaatagtagagggtttttttcctccagaccccctggcctttcagttcttaactatttccctccaggccagaaagttttctttgaggaaggagaggagagggtggcaatgatgcctttgatctggaattggacatttctctgtcagagcacagaggaggctcatatcacctcttccctctcctacttggcccagctgcttggaggaccgaccccatggctgagaatatgacggcaagaggaacagagtttgctccaagtgggaaagggtcccaagcagtccagagaagatgtctgtgtggctttccctccctgcctcccccagctcccacactggcctttgtaaataaatggcgtggtctttgttgtga

SEQ ID NO: 27658 - DNA, 2539 bp, Homo sapiens
gaggaggaggagccgggcgggctggcgggcggccgggtggcggcggcggcatggcggagccgagagcggggccgagacgaggccccccattcgggtcaccgtcaagacccccaaggacaaggaggaaattgtgatctgcgatcgagcctcggtcaaggagttcaaagaggaaatctcccggaggtttaaggctcagcaggatcagctggtcctgatcttcgcaggcaagatcctcaaggatggggacacactgaaccagcacggaatcaaggacgggctcactgtccatctggtcatcaagacccctcagaaggctcaagatccagctgctgccactgcttcttccccctccacacctgaccctgcctcagcaccctccaccacgcctgcttcacccgccacccctgcccagccctccacctctggcagtgcctcttcagatgctggcagtggaagccggaggagcagtggtggggggccctctccgggggctggggagggatcccccagtgctactgcgtccatactctctggctttgggggcatcctggggctgggcagcctaggcctgggctctgccaacttcatggagctgcagcagcagatgcagcggcagctgatgtccaatcctgagatgctgtcacagatcatggagaaccccctggtccaggatatgatgtctaaccctgatctgatgcgtcacatgattatggccaacccccagatgcagcagttgatggagcggaaccctgagatcagccacatgctcaataaccctgaactcatgaggcagacaatggagcttgctcggaatccagccatgatgcaagagatgatgcggaaccaggaccgggccctgagcaaccttgagagcatccctggagggtataatgccctccgccgcatgtacacggacatccaggagcccatgttcagtgctgcccgggaacagtttggcaacaatcccttctcttccctggccgggaactccgacagctcatcctcccagcctctgcggactgagaatcgagagcccctccctaacccctggagcccctcgccccccacctcccaggcccccgggtccggtggggagggcaccggaggatcggggaccagccaggtgcacccgacagtctcgaacccctttgggatcaatgcggctagcctggggtcagggatgttcaatagcccagaaatgcaagccctcctccagcagatctctgagaacccccagctgatgcagaatgtgatctcagcaccctacatgcgcagcatgatgcagacgcttgcccagaaccccgactttgctgctcagatgatggtgaatgtgccgctcttcgcggggaacccccaactgcaggagcagctccgcctgcagctcccagtcttcctgcagcagatgcagaacccagagtcactctccatccttaccaatccccgagccatgcaggcattgctgcagatccagcagggactacagaccttgcagaccgaggcccctgggctggtacccagccttggctcctttgggatgtcccggaccccagcaccctcagcaggcagcaacgcagggtctacgcccgaggcccccacttcctcaccagccacgccagccacatcttctccaacaggggcttccagcgcccagcagcaactcatgcagcagatgatccagcttttggctggaagtggaaactcacaggtgcagacgccagaagtgagatttcagcagcagctggagcagctcaactccatgggcttcatcaatcgtgaggctaacctgcaggccctgattgccacaggaggggacatcaacgcagctatcgagagactgctgggctcccagctctcctaatccctcggcccatgcctcctgcctctcccctccctcgatgtcagcattcggttcttctgtcaatccttaccctctgcagcttgtcctcccttccgtcttctccctcatcctttccaaacagcagggtgactttagaggcatgggctccaaccccttagctctgtctgagaattatggttttactgctacgtctctaacagactcttctctcctggtctccttgagcagtgctacttaaacagttttcacagtttcattgattgactctacctccttgccccacaccacttttgcaatctttaaactttcagtggctgtgcagagtcgagggaggaaccagctctctggtttactggaacatagtcttccatctataccactagggttttgtcttatgtttacttttggtaactctcttccttctttttctccctaccccccaacccctagcccaaccaatgctagaatttcttgctctgaaggaggagcaggtgaaacaggtggtaattttccttctcggcccctattctggttcattcagcactttttggtgggaactgtgtgcgcaatttcacgagctctggagagcaagataccactacgaccagggacacacgggcatatcgttttactctggaaccagctataacatgatacggattcactgcctcgtttacactg

SEQ ID NO: 27659 - DNA, 516 bp, Homo sapiens
gaggaggaggagccgggcgggctggcgggcggccgggtggcggcggcggcatggcggagccgagagcggggccgagacgaggccccccattcgggtcaccgtcaagacccccaaggacaaggaggaaattgtgatctgcgatcgagcctcggtcaaggagttcaaagaggaaatctcccggaggtttaaggctcagcaggatcagctggtcctgatcttcgcaggcaagatcctcaaggatggggacacactgaaccagcacggaatcaaggacgggctcactgtccatctggtcatcaagacccctcagaaggctcaagatccagctgctgccactgcttcttccccctccacacctgaccctgcctcagcaccctccaccacgcctgcttcacccgccacccctgcggcagctcccctgctctcaggtttttgaggaaacaaagatttgtggtaactgaaggtgttgggtcagtggccaggtgccgacactgagctgtgacccagaggggacgc

SEQ ID NO: 27660 - DNA, 1923 bp, Homo sapiens
  misc_feature (1651)..(1651): n is a, c, g, or t
  misc_feature (1656)..(1656): n is a, c, g, or t
  misc_feature (1660)..(1660): n is a, c, g, or t
  misc_feature (1668)..(1668): n is a, c, g, or t
  misc_feature (1676)..(1676): n is a, c, g, or t
  misc_feature (1681)..(1681): n is a, c, g, or t
  misc_feature (1701)..(1701): n is a, c, g, or t
  misc_feature (1713)..(1713): n is a, c, g, or t
  misc_feature (1751)..(1751): n is a, c, g, or t
  misc_feature (1753)..(1753): n is a, c, g, or t
  misc_feature (1762)..(1763): n is a, c, g, or t
  misc_feature (1777)..(1778): n is a, c, g, or t
  misc_feature (1788)..(1788): n is a, c, g, or t
  misc_feature (1801)..(1801): n is a, c, g, or t
  misc_feature (1808)..(1809): n is a, c, g, or t
  misc_feature (1812)..(1812): n is a, c, g, or t
  misc_feature (1816)..(1816): n is a, c, g, or t
  misc_feature (1821)..(1821): n is a, c, g, or t
  misc_feature (1839)..(1839): n is a, c, g, or t
gaggaggaggagccgggcgggctggcgggcggccgggtggcggcggcggcatggcggagccgagagcggggccgagacgaggccccccattcgggtcaccgtcaagacccccaaggacaaggaggaaattgtgatctgcgatcgagcctcggtcaaggagttcaaagaggaaatctcccggaggtttaaggctcagcaggatcagctggtcctgatcttcgcaggcaagatcctcaaggatggggacacactgaaccagcacggaatcaaggacgggctcactgtccatctggtcatcaagacccctcagaaggctcaagatccagctgctgccactgcttcttccccctccacacctgaccctgcctcagcaccctccaccacgcctgcttcacccgccacccctgcccagccctccacctctggcagtgcctcttcagatgctggcagtggaagccggaggagcagtggtggggggccctctccgggggctggggagggatcccccagtgctactgcgtccatactctctggctttgggggcatcctggggctgggcagcctaggcctgggctctgccaacttcatggagctgcagcagcagatgcagcggcagctgatgtccaatcctgagatgctgtcacagatcatggagaaccccctggtccaggatatgatgtctaaccctgatctgatgcgtcacatgattatggccaacccccagatgcagcagttgatggagcggaaccctgagatcagccacatgctcaataaccctgaactcatgaggcagacaatggagcttgctcggaatccagccatgatgcaagagatgatgcggaaccaggaccctgaatctctgctcagggctgactcgtgggcagagaaggaagaatgtggggaacaacctgccctccactccaaccctccacagccatactgtatgactgtaacctacttttatttatgttttaagacatacagggcatcacactgaaaaggagctgtgatctgagggtcaggagtgtgggcctgggtaccagcactgccactgacttgcctctctctcagccttagttgccccttcactgaagacctttccagctttggtgatctacgattctatcacagcaagcaacaggaagacagagcatcatgctaggcacataagaagcttttaaaatactggttaaattgagatcaccacaccaggggaatagtgtccaagtcatgctccagctcctttcccctcttagggatcttggactagaaaaggccaaactttgtttatttcttaaaacttgaatctgagttcacagaaagtaagtgctgtactttattgactacctcttccacaggagaacccagcacaggtcacagtggcttatcctgtaatcctagcactttgggaggctgaggtgggcagatcacctgaggtcaggagtttgagaccagcctggccaacatggcgaaaccccatctctactaaaaatacaaaaaaaggctgggcgtggtggctcacgcttctaatcccagcactttgggaggccaaagcagacggatcacctgaggtcaggagttcaagaccagcctggccaacatggcgaaaccttgtctctactaaaatataaaaaattagctgggggaagcngaggngggnggatcacnaggtcagnagatngagaccatcctggctaacanggtgaaaccccntctctactaaaaatacaaaaaattagccaggcgtggtngnaggtgcctnnagtcccagctactnnggaggctgangcaggagaatggngtgaacnnggnaggnggagnttgcagtgagccaagatngcgccactgcactccagcctgggtgacagagcgagactccgtctcaaaaaaaaaaaaaaaaaaaaaatgtgtggactgtgataa

SEQ ID NO: 27661 - DNA, 3471 bp, Homo sapiens
gaggaggaggagccgggcgggctggcgggcggccgggtggcggcggcggcatggcggagccgagagcggggccgagacgaggccccccattcgggtcaccgtcaagacccccaaggacaaggaggaaattgtgatctgcgatcgagcctcggtcaaggaggcaagatcctcaaggatggggacacactgaaccagcacggaatcaaggacgggctcactgtccatctggtcatcaagacccctcagaaggctcaagatccagctgctgccactgcttcttccccctccacacctgaccctgcctcagcaccctccaccacgcctgcttcacccgccacccctgcccagccctccacctctggcagtgcctcttcagatgctggcagtggaagccggaggagcagtggtggggggccctctccgggggctggggagggatcccccagtgctactgcgtccatactctctggctttgggggcatcctggggctgggcagcctaggcctgggctctgccaacttcatggagctgcagcagcagatgcagcggcagctgatgtccaatcctgagatgctgtcacagatcatggagaaccccctggtccaggatatgatgtctaaccctgatctgatgcgtcacatgattatggccaacccccagatgcagcagttgatggagcggaaccctgagatcagccacatgctcaataaccctgaactcatgaggcagacaatggagcttgctcggaatccagccatgatgcaagagatgatgcggaaccaggaccgggccctgagcaaccttgagagcatccctggagggtataatgccctccgccgcatgtacacggacatccaggagcccatgttcagtgctgcccgggaacagtttggcaacaatcccttctcttccctggccgggaactccgacagctcatcctcccagcctctgcggactgagaatcgagagcccctccctaacccctggagcccctcgccccccacctcccaggcccccgggtccggtggggagggcaccggaggatcggggaccagccaggtgcacccgacagtctcgaacccctttgggatcaatgcggctagcctggggtcagggatgttcaatagcccagaaatgcaagccctcctccagcagatctctgagaacccccagctgatgcagaatgtgatctcagcaccctacatgcgcagcatgatgcagacgcttgcccagaaccccgactttgctgctcagatgatggtgaatgtgccgctcttcgcggggaacccccaactgcaggagcagctccgcctgcagctcccagtcttcctgcagcagatgcagaacccagagtcactctccatccttaccaatccccgagccatgcaggcattgctgcagatccagcagggactacagaccttgcagaccgaggcccctgggctggtacccagccttggctcctttgggatgtcccggaccccagcaccctcagcaggcagcaacgcagggtctacgcccgaggcccccacttcctcaccagccacgccagccacatcttctccaacaggggcttccagcgcccagcagcaactcatgcagcagatgatccagcttttggctggaagtggaaactcacaggtgcagacgccagaagtgagatttcagcagcagctggagcagctcaactccatgggcttcatcaatcgtgaggctaacctgcaggccctgattgccacaggaggggacatcaacgcagctatcgagagactgctgggctcccagctctcctaatccctcggcccatgcctcctgcctctcccctccctcgatgtcagcattcggttcttctgtcaatccttaccctctgcagcttgtcctcccttccgtcttctccctcatcctttccaaacagcagggtgactttagaggcatgggctccaaccccttagctctgtctgagaattatggttttactgctacgtctctaacagactcttctctcctggtctccttgagcagtgctacttaaacagttttcacagtttcattgattgactctacctccttgccccacaccacttttgcaatctttaaactttcagtggctgtgcagagtcgagggaggaaccagctctctggtttactggaacatagtcttccatctataccactagggttttgtcttatgtttacttttggtaactctcttccttctttttctccctaccccccaacccctagcccaaccaatgctagaatttcttgctctgaaggaggagcaggtgaaacaggtggtaattttccttctcggcccctattctggttcattcagcactttttggtgggaactgttggaaattccagggtaaggaggaagatgcctgttctccctgtctgaagagggagatgagacagctctctggacaggaattaacaaacgctggagcagcccagaggaaattcgtgtgaaagaggagggaatgagattattcggaggaagggaatgggggagacagcctgagtaaaaggcttggaagttggaattaacagtggggagcagaagcactcatagctcttttaggcagaagaatccaggcccgagctggcagaagagacttagagatgctaatggaatttaaactgaaaaaaggagcccaatgaagctaagcgccacgccccacaaggggtcatattggctttagttcctcaagcatatgtgcttatatgcacacacacacacatttccatggacccaggtcttgcttgtgtccccaggcaccagtagtttgagcccccctcaaaagacatgaagggggttggggtctgtgtgagtagtggggaggtgcatgtgtatccacatgtgtgcatacactcttaagttgggtgggaagtggattccttgttggtttctggttcagagtgctctcccaccaccagagacaagtgggtaaaaaggtcagtccattgcaggaatatatatccgggagagctaggtcccttggggctctggatgctgggtaacccagaggtaatgtgggtaccctttctgaagctgtcagggctgtgactagcacccttatcacccctcactgccttgtgggaatagtagagggtttttttcctccagaccccctggcctttcagttcttaactatttccctccaggccagaaagttttctttgaggaaggagaggagagggtggcaatgatgcctttgatctggaattggacatttctctgtcagagcacagaggaggctcatatcacctcttccctctcctacttggcccagctgcttggaggaccgaccccatggctgagaatatgacggcaagaggaacagagtttgctccaagtgggaaagggtcccaagcagtccagagaagatgtctgtgtggctttccctccctgcctcccccagctcccacactggcctttgtaaataaatggcgtggtctttgttgtga

SEQ ID NO: 27662 - DNA, 3838 bp, Homo sapiens
ccccaagagtagtagtagtagtagtaccatacgatcgtactgaccacctgtcgtttacccagccctagacatgctgctactgctattccatggatcctaggtcacaccaccttaagcgccggcgcagctgcggcccgcccgcccctcctcctcctcggcccgcccgaccgcccgccggcccaccgccgccgccgtaccgcctcggctcgccccggctctgctccggggggtaagcccagtggcagttctgggggttcctgttcctcctttgcggcggcatggcggagccgagagcggggccgagacgaggccccccattcgggtcaccgtcaagacccccaaggacaaggaggaaattgtgatctgcgatcgagcctcggtcaaggagttcaaagaggaaatctcccggaggtttaaggctcagcaggatcagctggtcctgatcttcgcaggcaagatcctcaaggatggggacacactgaaccagcacggaatcaaggacgggctcactgtccatctggtcatcaagacccctcagaaggctcaagatccagctgctgccactgcttcttccccctccacacctgaccctgcctcagcaccctccaccacgcctgcttcacccgccacccctgcccagccctccacctctggcagtgcctcttcagatgctggcagtggaagccggaggagcagtggtggggggccctctccgggggctggggagggatcccccagtgctactgcgtccatactctctggctttgggggcatcctggggctgggcagcctaggcctgggctctgccaacttcatggagctgcagcagcagatgcagcggcagctgatgtccaatcctgagatgctgtcacagatcatggagaaccccctggtccaggatatgatgtctaaccctgatctgatgcgtcacatgattatggccaacccccagatgcagcagttgatggagcggaaccctgagatcagccacatgctcaataaccctgaactcatgaggcagacaatggagcttgctcggaatccagccatgatgcaagagatgatgcggaaccaggaccgggccctgagcaaccttgagagcatccctggagggtataatgccctccgccgcatgtacacggacatccaggagcccatgttcagtgctgcccgggaacagtttggcaacaatcccttctcttccctggccgggaactccgacagctcatcctcccagcctctgcggactgagaatcgagagcccctccctaacccctggagcccctcgccccccacctcccaggcccccgggtccggtggggagggcaccggaggatcggggaccagccaggtgcacccgacagtctcgaacccctttgggatcaatgcggctagcctggggtcagggatgttcaatagcccagaaatgcaagccctcctccagcagatctctgagaacccccagctgatgcagaatgtgatctcagcaccctacatgcgcagcatgatgcagacgcttgcccagaaccccgactttgctgctcagatgatggtgaatgtgccgctcttcgcggggaacccccaactgcaggagcagctccgcctgcagctcccagtcttcctgcagcagatgcagaacccagagtcactctccatccttaccaatccccgagccatgcaggcattgctgcagatccagcagggactacagaccttgcagaccgaggcccctgggctggtacccagccttggctcctttgggatgtcccggaccccagcaccctcagcaggcagcaacgcagggtctacgcccgaggcccccacttcctcaccagccacgccagccacatcttctccaacaggggcttccagcgcccagcagcaactcatgcagcagatgatccagcttttggctggaagtggaaactcacaggtgcagacgccagaagtgagatttcagcagcagctggagcagctcaactccatgggcttcatcaatcgtgaggctaacctgcaggccctgattgccacaggaggggacatcaacgcagctatcgagagactgctgggctcccagctctcctaatccctcggcccatgcctcctgcctctcccctccctcgatgtcagcattcggttcttctgtcaatccttaccctctgcagcttgtcctcccttccgtcttctccctcatcctttccaaacagcagggtgactttagaggcatgggctccaaccccttagctctgtctgagaattatggttttactgctacgtctctaacagactcttctctcctggtctccttgagcagtgctacttaaacagttttcacagtttcattgattgactctacctccttgccccacaccacttttgcaatctttaaactttcagtggctgtgcagagtcgagggaggaaccagctctctggtttactggaacatagtcttccatctataccactagggttttgtcttatgtttacttttggtaactctcttccttctttttctccctaccccccaacccctagcccaaccaatgctagaatttcttgctctgaaggaggagcaggtgaaacaggtggtaattttccttctcggcccctattctggttcattcagcactttttggtgggaactgttggaaattccagggtaaggaggaagatgcctgttctccctgtctgaagagggagatgagacagctctctggacaggaattaacaaacgctggagcagcccagaggaaattcgtgtgaaagaggagggaatgagattattcggaggaagggaatgggggagacagcctgagtaaaaggcttggaagttggaattaacagtggggagcagaagcactcatagctcttttaggcagaagaatccaggcccgagctggcagaagagacttagagatgctaatggaatttaaactgaaaaaaggagcccaatgaagctaagcgccacgccccacaaggggtcatattggctttagttcctcaagcatatgtgcttatatgcacacacacacacatttccatggacccaggtcttgcttgtgtccccaggcaccagtagtttgagcccccctcaaaagacatgaagggggttggggtctgtgtgagtagtggggaggtgcatgtgtatccacatgtgtgcatacactcttaagttgggtgggaagtggattccttgttggtttctggttcagagtgctctcccaccaccagagacaagtgggtaaaaaggtcagtccattgcaggaatatatatccgggagagctaggtcccttggggctctggatgctgggtaacccagaggtaatgtgggtaccctttctgaagctgtcagggctgtgactagcacccttatcacccctcactgccttgtgggaatagtagagggtttttttcctccagaccccctggcctttcagttcttaactatttccctccaggccagaaagttttctttgaggaaggagaggagagggtggcaatgatgcctttgatctggaattggacatttctctgtcagagcacagaggaggctcatatcacctcttccctctcctacttggcccagctgcttggaggaccgaccccatggctgagaatatgacggcaagaggaacagagtttgctccaagtgggaaagggtcccaagcagtccagagaagatgtctgtgtggctttccctccctgcctcccccagctcccacactggcctttgtaaataaatggcgtggtctttgttgtgaacacacacacaggacgcacaaaacacacgaaggacaaagaaagagagaaaaaaaagggtgttttcgtgggcaaaa

SEQ ID NO: 27663 - DNA, 3073 bp, Homo sapiens
gaggaggaggagccgggcgggctggcgggcggccgggtggcggcggcggcatggcggagccgagagcggggccgagacgaggccccccattcgggtcaccgtcaagacccccaaggacaaggaggaaattgtgatctgcgatcgagcctcggtcaaggagtccaatcctgagatgctgtcacagatcatggagaaccccctggtccaggatatgatgtctaaccctgatctgatgcgtcacatgattatggccaacccccagatgcagcagttgatggagcggaaccctgagatcagccacatgctcaataaccctgaactcatgaggcagacaatggagcttgctcggaatccagccatgatgcaagagatgatgcggaaccaggaccgggccctgagcaaccttgagagcatccctggagggtataatgccctccgccgcatgtacacggacatccaggagcccatgttcagtgctgcccgggaacagtttggcaacaatcccttctcttccctggccgggaactccgacagctcatcctcccagcctctgcggactgagaatcgagagcccctccctaacccctggagcccctcgccccccacctcccaggcccccgggtccggtggggagggcaccggaggatcggggaccagccaggtgcacccgacagtctcgaacccctttgggatcaatgcggctagcctggggtcagggatgttcaatagcccagaaatgcaagccctcctccagcagatctctgagaacccccagctgatgcagaatgtgatctcagcaccctacatgcgcagcatgatgcagacgcttgcccagaaccccgactttgctgctcagatgatggtgaatgtgccgctcttcgcggggaacccccaactgcaggagcagctccgcctgcagctcccagtcttcctgcagcagatgcagaacccagagtcactctccatccttaccaatccccgagccatgcaggcattgctgcagatccagcagggactacagaccttgcagaccgaggcccctgggctggtacccagccttggctcctttgggatgtcccggaccccagcaccctcagcaggcagcaacgcagggtctacgcccgaggcccccacttcctcaccagccacgccagccacatcttctccaacaggggcttccagcgcccagcagcaactcatgcagcagatgatccagcttttggctggaagtggaaactcacaggtgcagacgccagaagtgagatttcagcagcagctggagcagctcaactccatgggcttcatcaatcgtgaggctaacctgcaggccctgattgccacaggaggggacatcaacgcagctatcgagagactgctgggctcccagctctcctaatccctcggcccatgcctcctgcctctcccctccctcgatgtcagcattcggttcttctgtcaatccttaccctctgcagcttgtcctcccttccgtcttctccctcatcctttccaaacagcagggtgactttagaggcatgggctccaaccccttagctctgtctgagaattatggttttactgctacgtctctaacagactcttctctcctggtctccttgagcagtgctacttaaacagttttcacagtttcattgattgactctacctccttgccccacaccacttttgcaatctttaaactttcagtggctgtgcagagtcgagggaggaaccagctctctggtttactggaacatagtcttccatctataccactagggttttgtcttatgtttacttttggtaactctcttccttctttttctccctaccccccaacccctagcccaaccaatgctagaatttcttgctctgaaggaggagcaggtgaaacaggtggtaattttccttctcggcccctattctggttcattcagcactttttggtgggaactgttggaaattccagggtaaggaggaagatgcctgttctccctgtctgaagagggagatgagacagctctctggacaggaattaacaaacgctggagcagcccagaggaaattcgtgtgaaagaggagggaatgagattattcggaggaagggaatgggggagacagcctgagtaaaaggcttggaagttggaattaacagtggggagcagaagcactcatagctcttttaggcagaagaatccaggcccgagctggcagaagagacttagagatgctaatggaatttaaactgaaaaaaggagcccaatgaagctaagcgccacgccccacaaggggtcatattggctttagttcctcaagcatatgtgcttatatgcacacacacacacatttccatggacccaggtcttgcttgtgtccccaggcaccagtagtttgagcccccctcaaaagacatgaagggggttggggtctgtgtgagtagtggggaggtgcatgtgtatccacatgtgtgcatacactcttaagttgggtgggaagtggattccttgttggtttctggttcagagtgctctcccaccaccagagacaagtgggtaaaaaggtcagtccattgcaggaatatatatccgggagagctaggtcccttggggctctggatgctgggtaacccagaggtaatgtgggtaccctttctgaagctgtcagggctgtgactagcacccttatcacccctcactgccttgtgggaatagtagagggtttttttcctccagaccccctggcctttcagttcttaactatttccctccaggccagaaagttttctttgaggaaggagaggagagggtggcaatgatgcctttgatctggaattggacatttctctgtcagagcacagaggaggctcatatcacctcttccctctcctacttggcccagctgcttggaggaccgaccccatggctgagaatatgacggcaagaggaacagagtttgctccaagtgggaaagggtcccaagcagtccagagaagatgtctgtgtggctttccctccctgcctcccccagctcccacactggcctttgtaaataaatggcgtggtctttgttgtga

SEQ ID NO: 27664 - DNA, 3475 bp, Homo sapiens
gaggaggaggagccgggcgggctggcgggcggccgggtggcggcggcggcatggcggagccgagagcggggccgagacgaggccccccattcgggtcaccgtcaagacccccaaggacaaggaggaaattgtgatctgcgatcgagcctcggtcaaggagttcaaagaggaaatctcccggaggtttaaggctcagcaggatcagctggtcctgatcttcgcaggcaagatcctcaaggatggggacacactgaaccagcacggaatcaaggacgggctcactgtccatctggtcatcaagacccctcagaaggctcaagatccagctgctgccactgcttcttccccctccacacctgaccctgcctcagcaccctccaccacgcctgcttcacccgccacccctgcccagccctccacctctggcagtgcctcttcagatgctggcagtggaagccggaggagcagtggtggggggccctctccgggggctggggagggatcccccagtgctactgcgtccatactctctggctttgggggcatcctggggctgggcagcctaggcctgggctctgccaacttcatggagctgcagcagcagatgcagcggcagctgatgtccaatcctgagatgctgtcacagatcatggagaaccccctggtccaggatatgatgtctaaccctgatctgatgcgtcacatgattatggccaacccccagatgcagcagttgatggagcggaaccctgagatcagccacatgctcaataaccctgaactcatgaggcagacaatggagcttgctcggaatccagccatgatgcaagagatgatgcggaaccaggaccgggccctgagcaaccttgagagcatccctggagggtataatgccctccgccgcatgtacacggacatccaggagcccatgttcagtgctgcccgggaacagtttggcaacaatcccttctcttccctggccgggaactccgacagctcatcctcccagcctctgcggactgagaatcgagagcccctccctaacccctggagcccctcgccccccacctcccaggcccccgggtccggtggggagggcaccggaggatcggggaccagccaggtgcacccgacagtctcgaacccctttgggatcaatgcggctagcctggggtcagggatgttcaatagcccagaaatgcaagccctcctccagcagatctctgagaacccccagctgatgcagaatgtgatctcagcaccctacatgcgcagcatgatgcagacgcttgcccagaaccccgactttgctgctcagatgatggtgaatgtgccgctcttcgcggggaacccccaactgcaggagcagctccgcctgcagctcccagtcttcctgcagcagatgcagaacccagagtcactctccatccttaccaatccccgagccatgcaggcattgctgcagatccagcagggactacagaccttgcagaccgaggcccctgggctggtacccagccttggctcctttgggatgtcccggaccccagcaccctcagcaggcagcaacgcagggtctacgcccgaggcccccacttcctcaccagccacgccagccacatcttctccaacaggggcttccagcgcccagcagcaactcatgcagcagatgatccagcttttggctggaagtggaaactcacaggtgcagacgccagaagtgagatttcagcagcagctggagcagctcaactccatgggcttcatcaatcgtgaggctaacctgcaggccctgattgccacaggaggggacatcaacgcagctatcgagagactgctgggctcccagctctcctaatccctcggcccatgcctcctgcctctcccctccctcgatgtcagcattcggttcttctgtcaatccttaccctctgcagcttgtctccaaccccttagctctgtctgagaattatggttttactgctacgtctctaacagactcttctctcctggtctccttgagcagtgctacttaaacagttttcacagtttcattgattgactctacctccttgccccacaccacttttgcaatctttaaactttcagtggctgtgcagagtcgagggaggaaccagctctctggtttactggaacatagtcttccatctataccactagggttttgtcttatgtttacttttggtaactctcttccttctttttctccctaccccccaacccctagcccaaccaatgctagaatttcttgctctgaaggaggagcaggtgaaacaggtggtaattttccttctcggcccctattctggttcattcagcactttttggtgggaactgttggaaattccagggtaaggaggaagatgcctgttctccctgtctgaagagggagatgagacagctctctggacaggaattaacaaacgctggagcagcccagaggaaattcgtgtgaaagaggagggaatgagattattcggaggaagggaatgggggagacagcctgagtaaaaggcttggaagttggaattaacagtggggagcagaagcactcatagctcttttaggcagaagaatccaggcccgagctggcagaagagacttagagatgctaatggaatttaaactgaaaaaaggagcccaatgaagctaagcgccacgccccacaaggggtcatattggctttagttcctcaagcatatgtgcttatatgcacacacacacacatttccatggacccaggtcttgcttgtgtccccaggcaccagtagtttgagcccccctcaaaagacatgaagggggttggggtctgtgtgagtagtggggaggtgcatgtgtatccacatgtgtgcatacactcttaagttgggtgggaagtggattccttgttggtttctggttcagagtgctctcccaccaccagagacaagtgggtaaaaaggtcagtccattgcaggaatatatatccgggagagctaggtcccttggggctctggatgctgggtaacccagaggtaatgtgggtaccctttctgaagctgtcagggctgtgactagcacccttatcacccctcactgccttgtgggaatagtagagggtttttttcctccagaccccctggcctttcagttcttaactatttccctccaggccagaaagttttctttgaggaaggagaggagagggtggcaatgatgcctttgatctggaattggacatttctctgtcagagcacagaggaggctcatatcacctcttccctctcctacttggcccagctgcttggaggaccgaccccatggctgagaatatgacggcaagaggaacagagtttgctccaagtgggaaagggtcccaagcagtccagagaagatgtctgtgtggctttccctccctgcctcccccagctcccacactggcctttgtaaataaatggcgtggtctttgttgtga

SEQ ID NO: 27665 - DNA, 1727 bp, Homo sapiens
gaggaggaggagccgggcgggctggcgggcggccgggtggcggcggcggcatggcggagccgagagcggggccgagacgaggccccccattcgggtcaccgtcaagacccccaaggacaaggaggaaattgtgatctgcgatcgagcctcggtcaaggagttcaaagaggaaatctcccggaggtttaaggctcagcaggatcagctggtcctgatcttcgcaggcaagatcctcaaggatggggacacactgaaccagcacggaatcaaggacgggctcactgtccatctggtcatcaagacccctcagaaggctcaagatccagctgctgccactgcttcttccccctccacacctgaccctgcctcagcaccctccaccacgcctgcttcacccgccacccctgcccagccctccacctctggcagtgcctcttcagatgctggcagtggaagccggaggagcagtggtggggggccctctccgggggctggggagggatcccccagtgctactgcgtccatactctctggctttgggggcatcctggggctgggcagcctaggcctgggctctgccaacttcatggagctgcagcagcagatgcagcggcagctgatgtccaatcctgagatgctgtcacagatcatggagaaccccctggtccaggatatgatgtctaaccctgatctgatgcgtcacatgattatggccaacccccagatgcagcagttgatggagcggaaccctgagatcagccacatgctcaataaccctgaactcatgaggcagacaatggagcttgctcggaatccagccatgatgcaagagatgatgcggaaccaggaccgggccctgagcaaccttgagagcatccctggagggtataatgccctccgccgcatgtacacggacatccaggagcccatgttcagtgctgcccgggaacagtttggcaacaatcccttctcttccctggccgggaactccgacagctcatcctcccagcctctgcggactgagaatcgagagcccctccctaacgaacgagaggacaaaaggaaaacgaggagagaagaaaagagaacaaaaaaggaaaaacgagaaaaaacaagcaaagaaaacaacaagaacgaacaaaaaaacacaaaaaaaaagaaagagcagacaaagaagacaggacaaggagaagaagaacagtcggagaggcgaggccgacggacagagacgacacaagagaaaaggaacgaagcgaaaaaacagacggagcgaagaaagtaaaacaaaagaagaagcgagcagaagcaacgaccagggcaaagagaaacacacggcaacgaaacagaaaaacagaaaaaacgaaagcaagaacagaaaaaaacaaaacacaggaagacaggaaaagaacacacagacagaagaagagcaaagcacgaagaccagaacagagacaaccaaaacagagagacccgaagacacgagaaaaaaagaaaaaaaaaggaaaagaaggagaaaagcaaccacagaaagaaaagaaagacgaagacacgacgcgaaaagacaacgagaaaagaaaacagggcacgaaagaacagagaagaagaagaggagccgaaaacaagaaacatcgaaacacaagaaagagagcagaaaaaacaaaaaagcaaacaaagcaagccaacacagaagggcacaaagaggagaacaagacgaggaagaaaagaaa

SEQ ID NO: 27666 - DNA, 350 bp, Homo sapiens
ggaggcgggcttggagccaagattacagtagaggaaggaagtccagtttactctactccctgtcactgtggggcagttcctgggccctggtcctgatcctgatacagaccccccttcctcaaggcccacccttttcctaggttggtgctcccctggttccggggcccattttgtctctctcccttgatcagacaatggagcttgctcggaatccagccatgatgcaagagatgatgcggaaccaggaccgggccctgagcaaccttgagagcatccctggagggtataatgccctccgccgcatgtacacggacatccaggagcccatgttcagtgctgcccgggaacag

SEQ ID NO: 27667 - DNA, 387 bp, Homo sapiens
aaccagggaggcggaggttgcagtgagccgagatcacaccactgcattccagcctggtgacagagcaagactccatctcaaaaaaaaaaaacacaaaacaaaacaaaacaaaacaaaaaatttcggtttagccaagctgatacaatacaatcccacactccttcaactaactccaacatggcagcagtagggttcatttaaaaatacgaatcaggctgggcacgatgactcaagcctgtaatcccacagctctgggaggccaaggaggcaggatcacttgaggccaggagttcaagaccagcctgtgccacatagcgaaaccccatctctacaaaaaaatttaaaaactggccatgtgtggtgggtgacatgtgcctatagtcttag

SEQ ID NO: 27668 - DNA, 465 bp, Homo sapiens
caaaaatgctgtgctctcaaacttttccttcttgatttctttccctttggtgaaacattgatgttcttaaccaagactgaagaatacccattgtattagccctctttcactctgctatgaagacatacctgagactgagtaatttataaataaaagaggtttaattgactctcagttcctcatggcaagggaggcctcaggaaacttacaatcattgcggaaggtgaaacaggcacatcacatggcagcaggtgagagaagtgagtgctgagcagagggggaagccccttataaaaccatcagctctcatgaaaactcacttgttattatgagaacagcatgagggtaaccgccccacctggtccctcccatgacacatgggaattacggaaactacagttcatgatgagatttgggtggggacacagccaaaccatatcacccatgttgtttgagaggaggcta

SEQ ID NO: 27669 - DNA, 658 bp, Homo sapiens
agcttcccaagtagctgggattacaggcatgtatcatcacacccggctcattttgtaatagagacagggtttcaccacgttggccaggctgatcttgaactcctgacctcaaatatctatccgcctcagcctcccaaaatgttgggattaccaccaataccgtgccaggccagaatgttcgttctttttttttagacagagtcttgctctgttggccaggtcttatattaaaacttaaatatctttttgtagcttttgccctcaatttttttttaccatatagaatactagtgctttcatttaacaggggtttcagggtgcaattttgctgaataataaattttaatgacgatgctgttttgagatagtgtttttatagtaactgtaaatgtgtaaatatgataatgatttttcaaaatagtgtgtacctttataaacataatttatgtatttacagtcacatatatggcctagaatttcctatcagtttgcaaaagtaattttatgaaaatacatgataggcagcaaaagttgaggcaggatacttgtttgttcaggagaattgcttgaacctgggaggcggaagttgcagtgagccaagatcatgccactgcactaagcctgggcgacagaagaaggctctgtctcaaaaaaaaaa

SEQ ID NO: 27670 - DNA, 600 bp, Homo sapiens
ccatgcttgggaaggtgcatgcagaccaatgttagtaatagtcaaaattcctgtgtcggtttgtgtggtttgctaaacaggactcaatgtatcatgaaacagtgtattatatagtcaactatggtcaactatgtcccagtgatatttatgagagggatctgaagtatttattgataatgcatatatgaaaaacggagaagaattaatgaaacagatatatctgtgttagaatgattctgtataaagatagggaatatcaagtctgttcttagtgttttgtgaatcacagagtgtaaaattattcccagtgaattaatgaataaatttaaatacaacatagaaatgaatgcagaaaaagagggtcaaccctggatcgatgatgagcactggtggagtatgagtcacatacgatgaatacgtgtctggaactctgaggtccatcgcagaagtcagtttcctctgtttcaactaactctgtagatagatgacaagaatagagaatgaattttttttgtttatgagtttttattttataattggttcaatgaaagaataaaacatatatgaataaataaataagttatgcattgtccaattata

SEQ ID NO: 27671 - DNA, 405 bp, Homo sapiens
cgacgggctggtttttgccgcagtccctgaccaagtatgctgggaggaccagctcccgctccaccctgctccccctgggaggaaggctgacccctgcgtgggagtgtgactgctggaaaggcatccttgctgcagctgtgagtgtgatgggacagcagagtcactcctgcatgggattctagggctgggggtcccagaggggtggcctccgcccctcctgggggccgaggactgtcaccatgtcactacggcactctccagctgctgaccaaagccctcgctaaccgcagccctgccatactctgggtctttcctctggagcaaggtgaagagactgcagcgaggcgtggaattgggaagctcttctggttttattaaaaactcgttccaccccaaaaaaaaaac

SEQ ID NO: 27672 - DNA, 389 bp, Homo sapiens
ccgctttggtcttccaaagtggggggattaccagcataagccaccatgcccagctacattgtaaacatgtttgttttctaggtgctgcaggcagagtgatcctattaaaacctaatcatgttgtgtcactctgcttcccagaatcctctgtggtctcttatctcattcagaataaaagcccaagtccattcagcagcaggcagtgctcccagtctgtaaccctcgaggccattgtccctccctgctcttctcccttgctcagcacggtcctcctccctgctctcagacacacctggcccctgtgcctttgcacttgctcttctctctgagaaggaattttttgtttgttttgttgttgtattctaagcacctagaattgcctggcaaat

SEQ ID NO: 27673 - DNA, 428 bp, Homo sapiens
attacaaacactactgtgagaagtaatggctaaagtaaaaaagagggcagaaaaaaacatctgatgctataatgcgtctaaataaagaatgtgaaacataaagttttgttctacatcttcactggagattttaaagggcaaggagacctagctccttgagatgtataactatttgctgacaagttggagtgtcattagccagtgttctagaaagtgaataatataatcccccgccccccagctctacattgatacatttcttagctaggagacaaatgttagtttgtatttcgtagaccaaactattttaacatctccattttcatttgtctgtatagacaaaaatgtttggcctacaaagacacagccgtggaatattgaatgaccccagttcagtatccattacctgaatgttgttgtgtccccac

SEQ ID NO: 27674 - DNA, 487 bp, Homo sapiens
gttggatggagaaaacgagggtgagtgtcagcttcataggacgggccttccacgagaggcctcatggtgcttgggagagttggggtgaaagcaggttggaacaagatgcttgctgctgacatttgggcactgatgggcagcctgacctctgctttctttttagtgcttaacaacactgaagccctgttaagacaggattcttaggactgggcacagtggctcatccagcactttgggagccctgggtgggaggatcatttgagccccaggagtttgaggccagacagggcaacatagcaaggccccatctctggaaagaaatacaaaaattaaccaggcttggtggtgtgcacctctagtcccagctacttgagaggctgaggtgggaggatcacttgagcctgggagttcaaagctgtaatgagctataatcatgacattacactccagccgaggagacagagcaagactctgtctcaaaaaaaaa

SEQ ID NO: 27675 - DNA, 532 bp, Homo sapiens
aaaaacctaacgaagcaaaattccaaatgtaaaattacttccaattacttaagctacatatcctaatgtaactagaacaagaattcacctgttctatgtaaggtaggtattactatatccatttttctgaagaaaactccttggctcagagtgtgtgaatgatgtctaaaatcacatagctatagtcagcaacagaactcaggtttgaacttgggctcatctggttttaaagcccagaacttttattatacttcattgactcccaacacggtaaaattaagatatttagttaaagaggtgggggctgagaagctgaaaaattaacaaagagatcaactaaaaaccaaaagcagtattttcctagcctgggcaacaaagggagatcctgtctctataaaaaatttttagaaatcagctggatgtagttgcgcacacttgtagtcccagctattcaggaggctgaggtgggagaaagcttgtgcccaggagtttgagattgcagcgagctatgattgtgtcactgcactccaaa

SEQ ID NO: 27676 - DNA, 392 bp, Homo sapiens
atagtctaaaacttcacttaacaaagtagttctcaaacggggaagggagcatgtattttgagattttaggcttcagcactactcatctctctgcccttaagaaccagtgcttggccaggcacggtggctcatgcctgtaatcccagcactttgggaggccgaggtgggtggatcatgaggtcaggagttcgagaccagcctggccaatgtagtgaaacaccgtctttactagaaatacaaaaattagttgagcatggtggcacacgcccatagttccagctactcaggaggctgaggcaggaaaatcgcttgaacccaggaggcggaagctgcggtgagccaagatcaagccactacactgcagcctgggcaacagagccagactccatctc

SEQ ID NO: 27677 - DNA, 815 bp, Homo sapiens
  misc_feature (32)..(32): n is a, c, g, or t
  misc_feature (38)..(38): n is a, c, g, or t
atgctaggtttgtagaggcttacttaaccttnatgganacgctggaaatctgcaggaggaggaggaggactccatcctcctcctcctattgcttctcctgggcattgggatctgctgcctccagctcctgcaggcaatggccagtgtgaggcgttgaatgcattctactttatattatccaagttaggtgggaaatagcttttaatttacagattttcacttcgcaggtaactctgaaggcacacatctgttttatataacaagggatatataaccagcaggagctcatagtagcatttgtagactggttatttgcttttatgtttctttgggactggaagtaacaatttttaatgttaactgtcagtttaggagaggaaataaatacatgtagagaaggttctacctgagccaaaatttcccattcttccctcacaatgtaggattttagaggtgtctctcttgttttctcatctttttcttttgccttctctaaattgttgtaaaataactgaatggtcttgttttcctttgtttgggtcaagaaattttagcggaaaattgttactgtgtgaaagaagattattgactcaacaagccttcaattttccgtgaataacactcccaccccctagcttcaggaacatgccgtgcgtgcattctattttaaaatatagactgtaatttaaaacaggcattttgatgccccactgaactttgtttaagcctggaataaaagaggagaaaaaagctgtaagccacaaaaaagtgactaagctttctcaactacttttcttcataatgcattctttaaa

SEQ ID NO: 27678 - DNA, 586 bp, Homo sapiens
ctcttctcaccctagcctgcacttctggttttggcatggcagtgcctgccatgttgggctagatgccaccatcttcacccacccatcctcctcctcctattgcttctcctgggcattgggatctgctgcctccagctcctgcaggcaatggccagtgtgaggcgttgaatgcattctactttatattatccaagttaggtgggaaatagcttttaatttacagattttcacttcgcaggtaactctgaaggcacacatctgttttatataacaagggatatataaccagcaggagctcatagtagcatttgtagactggttatttgcttttatgtttctttgggactggaagtaacaatttttaatgttaactgtcagtttaggagaggaaataaatacatgtagagaaggttctacctgagccaaaatttcccattcttccctcacaatgtaggattttagaggtgtctctcttgttttctcatctttttcttttgccttctctaaattgttgtaaaataactgaatggtcttgttttcctttgtttgggtcaagaaattttagcggaaaattgttactgtgtga

SEQ ID NO: 27679 - DNA, 564 bp, Homo sapiens
tcagatgttaaagttatcaaaaagtggctttaaaatgacagatgttaatatagtcaacaaagtaaatgacaaaatgtgcaattttagcaaacaactggaaattgtagcaagatttaaatggaaattccagaactgaaatatataaaatacctaaaatttagacttcaataggtatgtttaaaagaggaataatttcttaaatgaaactcaagaagttaatctggctgcttcaggttaagttgaaagtgacaaattcattcctgcctctgcctctaggtgtctcttgacttttgctgctgaattctgttcctgcactgccttgctttattctggcgattctcatgctggtctagaactctgttgaccttgaaatggtgtgaaatattagactccatgttttctactctcttaacttgttattttgtgagctagcatcattagcccaaatgcatcacaccaggttcacagggtcatcagatagttctgctcttgaccacatgctgagcaagagtcattgataattgagttctttgtaccaagccccttcttctgaagatttctgtg

SEQ ID NO: 27680 - DNA, 2075 bp, Homo sapiens
cactgcaccaacaatcatttatcaatggttctaagttactcattgccagttcaagccaaaggtcatgttgttaagggggtgcttctagtagcacttgtgcatctgagttgaatgaagctgtgcaaacccaccctttaaaccattccacccggcagtattcagcttcttaaccagtcgctatttaggaaaaaaaacccactagttaggccatcaacaagcattctttttatatttcttccagtataataaattattgatatcattgctgacttttatattatgggagggaaaaaataacattaataaaaaggtgataaaaaagcactgtttctatttttttctttttttccaaaaaaagaaagtaataaaaacttaaattctttgtaccagttaaaaaaaatgtataaaatttacatctgtgcagtggagttgttaagttctagaaacagtctatgaagctttagttttagcctagtagaacaactgttagagacagacgtataatttttatggaattacatgataatcatattcggatttatagaagcattttacaagtattgcaatcattgagtagagataatcatggtattttcatcagcttggtactttttgaaacgtgactgcgttgtgtgaacaatctgcaatttttcagtccgtgagatcctgcccttccacctctttcccatacccccaaggattatctcaaaatgatctctttagttctgtctccaaggcccaggacacttgtcagaaggatgcaaaaaaagaaaaaagtagatccaccctcttaatcccaaaagaacaaagtctccccacctttctcggatgcagggccagagtgacacagccgaaaaattgcagtttgtctgtacttctgtttgaactttccacgttgtcctgtttacaagttaacttaagttggggtatccgtcacgggtcttcctgttttgtatttaaataaaaacaacagcagcaggctgtccctgagtagttttgctgccataggttaagtcctcatgtgtacagtgcaggccctgtggcccgcacttcagtaagttatcaactctcaccgctgtgaacctgccaatccgctgtaacaactctgctttaaaacaaaaccaaacaaaactttaaaaaaaaatgtgtgatccagctttctcttgccatcctatgtgcatgccgtaagatcagttggatattaaaccatcaataaagtttcacaagatttgaaaacaaagtttctgtagcttcgatacctaagacagacgatagtgatcttgaaaagagaaaagggggaggggggagctacttatcagccaaaagcatataaagtgttcttttcaccagacttctttgggtgggtgaggggaggggcaagagggtgttttatagcatcactaagacattctcattcccccacctggaaaacagtgttatggcaatgggtgcctggttgatgttcttaaaggaaacgaattattaaaacactatgacatcctccagagggaagaaagagtaggagcagggggctatggagaataaatttctcccaattgccgcctcagatttcaaaatccagaatttgtattgtgtttcgaatcacaaacatagaattcttactgtgttggttaaagtaaaattcatttgcagttttgattttcatcaatgagctgtactttcccccatgactgtatgtagttttaataaaatcatttagagtgagtgagtgccaaccgatgttgcagaatcttttgtctaggcactccaagatgccaataagtcattttaaaatgtatgtcagagatgtaaacaaacattttggattttttttaaacagtatttatttggaatgttttcatttatctaaataactattgctattatgaattatggaaaattaatattatgtgtggcatatagtgacttcttaacacacacatcacgcaatctgcaaacccagaaaatgtgtatatctgtctttagaaattagtgtttatatcacttacagtggtttgtgaataaagaaaactggtttgtaatatcaaaaaaataaaagcttagtctgaaaaggt

SEQ ID NO: 27681 - DNA, 483 bp, Homo sapiens
ccaaactttattcccaggcttcttcagctttatttgccgcaaagaatgaattaggtatagcgaaaactgaaaagagctgcagtgaaaaggggcttgggcttaaaaatattagagatctagattttatcagatccataataaacaaaaaaattttaaaaagcagtcatgatataaaatagcagctcctgtaatttctgcaagtatcacttcttcagaagtgttcattcagtttgcctcattcttagaagcctcatcaaaattctccaccagatctggaacttcatcatcatcatcctctccagtagcaaggggtgcttttccatccacagattgtttgggcagagcttcagccagtctccttaaactagtcaggctgtctgcaccaagctggttgaggatgctgggaagcatttctgtcagctgctttgtctcagcgtggcctgtaatggtgaaggtgtttgctgccagggatgcctgaaccgg

SEQ ID NO: 27682 - DNA, 244 bp, Homo sapiens
agtgggatttgctgatggttcagaatgttggatgagagaaggagagaggccaagagtaaccacagtggcactgtgcagtcaaaccctctgccatgttggaaatattctagatctgcaccgtccagtagcgcagcaccagccacgtgtggccgtgaagcatgtgaaaggtgacctgtgcgactgaggaactgaatccataatcttaggtagctcttcaggcaagaaagggtgtcaaaaaaaataa

SEQ ID NO: 27683 - DNA, 421 bp, Homo sapiens
cccctgaagggcagagcattctctggatacccagagaggtgaccgtggcatccaggagtggacccggggctgcaccaagcatcccggagcccagactggtctcgcttcctcacctttctggctctgcggcaagcggctcctaatgatacctggctgaaagagaccaattaacctgagctgctgaggactctgagaagcttcccttatgctgtggttatgtgggatttcccaggtcagtgtcagttgtgtaaaatacagaggtctccaatggatgatgggtagtttatgacacttccactttacaatgatgcaagagagatacgcattttgtagaagtggaaatagtgcttcgagttcccatacaaccattctgtttttcactttcagtacaatgttcaataaattacatgagatattcaac

SEQ ID NO: 27684 - DNA, 1612 bp, Homo sapiens
cctaatcatactgaaatattggtgcacacctctctgcattagatttcacttttttaaaaaacccagtggacattgctataaataagatttatttggctacaaataacctgggatgttgcttattatgattgatgcctgctggtttgttcccaagctgagtgaaattgaacctcgtcctccctactcattttgatgactgaggctggtttataagaaaaggaagtttggagaagaaaaccgagattagaaaatatcatgttttggttggagataagaaccagggatggcaagtaccagtgtgtacaaatgtatttcacggagtttgaaggaacgcataatacaagagggaaaacaatttgtccttcattggacgtattatttggatttgggtgagcaacaaaatggaatgtggtctgttaggagcattctgtttgttcttttgtccctgatgtgatgaatcattgccacatgctagatggactcttcatatccaggttttgtccctcagggctgagcactgtattaaagagtttttgttgagtcatttaaccttagtgtccacatccagatcagctgtaaaatggggaagacgtgtgctgatttggaatgaatgcaaaatatcactatcattttcctaattacagaggagcaaaggttatcttcagccctttcagttctatgctcacatattcaaatatcaaatgtaatttagctgaagttatttaataatcaagtctttcaatatctgttcaaagaaaaagaacacactttgaaaattctgcaaagctgtctcccagtctttaaaatgtctggaagcactctccttctttacaataccaacatcactggcccagaatcttccctgtgctagtttgtaaatataaataaattacttgttttgtaaacttttgtaaagaatattttggtagaaatacttcaaacatattctttgggttatatttatacatatgtgaaataaatatactatcaaaaggttatattttatacaaaaagtaaattgctaccttttgtatgctaatatgcaaagttttgtataatatgatggtttatttttagctctacacttaaaccataggtggttgagtgggaacttttgaaaactatcaagaggcttgttagacaaatttatattctgaaacctcaataagaaagcattccaggtttcaatccttgttttttgtcctgctcccaaattcttttttaaacccatagttcttgtgtcttatttgattcttctgctgtgcacattgtattggtccttgttgcatgtagtctactgtgtgttttccgattttataaggcagcatttctccatacaaaaagaaaaaaaatgatgtacatataaacgcttttgttgtatggctcctccatgttactgtatatatctgccagcacttcccagttacactcctgtgagtcagcttatttttaccctaacataaatagtatgttttgtagtagttatcaaatttaagagataaagcaatcagaatgtttggattttcttctatcttaatgtgaatttcataattaatgtctatttattcagctattcattaaaatacaggattctttgggaaaacatgaagtg

SEQ ID NO: 27685 - DNA, 364 bp, Homo sapiens
aattctcatgcctcagcctctcgagtagctgggattacaggagtgtaccactacacctgactattttttgtattattagtagagatgtaggtttctccatgttggcccggctggtcttgaactcctgacctcaagtgatccggccgcttcggcctcccaatgtgctaggattacaggtatgagccaccaggcccggcctcgttttaaaaggactcttaggttacataacttaaggcacctttagccatctctaatctgctgagttttataatacaggtaagtttccattaacaagtaataaaaacaatcaacacccactgtgataaaccaccatttaataaatgcctggtttatgtcagtcgcc

SEQ ID NO: 27686 - DNA, 348 bp, Homo sapiens
tagagacagggcctcgttttattgcctcagctgcagtacagtggcactatcatagctcactgcagccttgaatcccgggctcaggggatccttcctccttagcctgccaagtagctgggactacaggcatgtgccaccatgcccaactaattttttaaaaaatttgtagagaaaggatctcactatgttgccctgaatggtctcaaactcctgggctcaagtgaacctcctgcctcagtgtcccaaatgcactgagattacaggcctaaaccactacacccagcctctgtgtactctttaggtgaaaaggagttagtcctttgaagaggagagaaaacaccaactctc

SEQ ID NO: 27687 - DNA, 1975 bp, Homo sapiens
cagccctcctgagcctagtccctttgtgagatttgtccccatttcttggacaccatataagagacttcagaggctgaagtgggaggattgcttgagcctgggaggtcgaggatgcagtgagctgtggtcataccactgcactctagcctgggcaacagagcgagaccttgtctcaaaaacagccaccaccaaaaactatcttgggatttgaataggattaccttaaatttgtagattaatttgagaattgacatctgtacgacattctagaacatggtatttcatgtcatgtattcatttcttgttaatgtctttcagaagagttttagggtttccatcatatagatcttacacgtcttttgttagataacagatctttgtatttttgttcctaaatacttcagacatttgtattgccattgtaaatgggatctttcttccattttctagttagttattggtggtacatctgaaaagcatttgaggtttgtgtgctgctctcttgattttgtttctagccaccgtactgaattctcatattacttccagtaaaatcttagttgattctcttaggcttctttggctaacatttattattttatatgcaaataattatagttttgtctcttccttttcaatacttacactctttccttcctttcctttcttttttttttctttctcagggccttgttgtcacccagactggagagcaatggtgtgatctagctcactgtaacctcaaactcctgggcttaagggatcctcctgcctcagcttcctgagtggctgggactacaggcaggcagtgaattttaaaacttttggtgtagagacaagatcttgctatgttgcccaggctggttttcctgccactttagagcaggtttcctttttttcatacttttaagaggtttttattaggaattgtccattgaatgttagctaaaacagtcaataaaatgcgttaagtaccagctacatgcaagaccctaagttagatacagtcagccctcttcatcagcaggtccacatcttcagattcaactagataaggctgaatatttgaagaaaaaaacaataaaaatacaattagaaagtacagtataacaactgttgccatgatacaatatctatacattttattagtgatgacctaaagttcatgggaccaggcacggtgactcacacttgtaatcccaacactttgggaggccaacctgggcagcatagtgagaccttgtctttaataaaaataaaaataaaaaaattagctagtgtggtggtatgcacctgtagtcccagctactcaagaggctgaggtgggcagatcactggagcccaggaggttgcggctgctgtgagctgtgattgtgacactgctctccagcctgagtgacagagggtgatcctgtctctaagtaagtaaataaataaagtatatgggggggatgtgtgttggttatatgcaaacactgcaccattatacgtaagggattgagcatccacagattctggtatggtgtggaggcgatatcctagaaccagtcgtctgcaaggtagcaaggatgactgaactgtggaagaatcaaagcactgttaaacagcatacaattcctgtcttcaaaaaagttatctcatcgggtagatgagacttaaaatgaataaaaggaatgaatacacattggagatagtggttgttgtgatagataaccttaattgtgttttcttccaaaacgggtgaattcacataaaagggcatcagaaaaatacaaagacaacccatcaatatcaggagcctgagcatgagttaaagcatgtggatggcctagagccatgtttttaaaattgttattaaatattggttttttacttaaatcaatgaaaactttctttactttgtggttgtgttcctcaaaatgagaatttttaacaataataaaaataaagcttattagatcatttttaatggtaa

SEQ ID NO: 27688 - DNA, 1446 bp, Homo sapiens
cagccctcctgagcctagtccctttgtgagatttgtccccatttcttggacaccatataagagacttcagaggctgaagtgggaggattgcttgagcctgggaggtcgaggatgcagtgagctgtggtcataccactgcactctagcctgggcaacagagcgagaccttgtctcaaaaacagccaccaccaaaaactatcttgggatttgaataggattaccttaaatttgtagattaatttgagaattgacatctgtacgacattctagaacatggtatttcatgtcatgtattcatttcttgttaatgtctttcagaagagttttagggtttccatcatatagatcttacacgtcttttgttagataacagatctttgtatttttgttcctaaatacttcagacatttgtattgccattgtaaatgggatctttcttccattttctagttagttattggtggtacatctgaaaagcatttgaggtttgtgtgctgctctcttgattttgtttctagccaccgtactgaattctcatattacttccagtaaaatcttagttgattctcttaggcttctttggctaacatttattattttatatgcaaataattatagttttgtctcttccttttcaatacttacactctttccttcctttcctttcttttttttttctttctcagggccttgttgtcacccagactggagagcaatggtgtgatctagctcactgtaacctcaaactcctgggcttaagggatcctcctgcctcactactcaagaggctgaggtgggcagatcactggagcccaggaggttgcggctgctgtgagctgtgattgtgacactgctctccagcctgagtgacagagggtgatcctgtctctaagtaagtaaataaataaagtatatgggggggatgtgtgttggttatatgcaaacactgcaccattatacgtaagggattgagcatccacagattctggtatggtgtggaggcgatatcctagaaccagtcgtctgcaaggtagcaaggatgactgaactgtggaagaatcaaagcactgttaaacagcatacaattcctgtcttcaaaaaagttatctcatcgggtagatgagacttaaaatgaataaaaggaatgaatacacattggagatagtggttgttgtgatagataaccttaattgtgttttcttccaaaacgggtgaattcacataaaagggcatcagaaaaatacaaagacaacccatcaatatcaggagcctgagcatgagttaaagcatgtggatggcctagagccatgtttttaaaattgttattaaatattggttttttacttaaatcaatgaaaactttctttactttgtggttgtgttcctcaaaatgagaatttttaacaataataaaaataaagcttattagatcatttttaatggtaa

SEQ ID NO: 27689 - DNA, 623 bp, Homo sapiens
aactgaaactggctcctggctgacagccagcagagaatcaggatatcagtcccagaatcataaggaactgaattctgctaaaaacctaaatgagcttggaagtgggattcttccgagaagagcccagccgggtcaccatcttaattttggtctgcgaaaccgtaagcagagaatccactcaagcccacctggatctacagaactgtgagctaagctgatgtggtaatattttaaagccgctaaatttttgttcatttgttgtgcagcaataggaatctaacacaaaggtaaatagaatatattttttaaatcgaggcaatattcacataacataaaattaaccattaattaagtgtacaacccagtggcattactacattcataatattgtgaaaccatcacttctgtctaattccaagacattttcaccaccctacaggaaactgatacccattaagcagtcactccctgttccctcctccccttagtccctggcaaacactaatatgctttctgcctatggatttgtctattctggaggttacatacaatttgtgaccttttgtgtctagcttctttcacttagtttaatgttttaaagattcatccacattgtagcatgt

SEQ ID NO: 27690 - DNA, 438 bp, Homo sapiens
gcccatccactaaggcagcatttccccatcttgacaccattgacatttgagggtcttctcttgggaggaacagcgttgtagttctccagtcactagatgtcatcagcactcctggtcctggcagccaagaatgtctccagacatagccaagtgtcccctgggggcagcaacacccatggctgagcaccattggcccaagggatcagtcctaggctctactctctagacctgtgctgcccgacacagcgtccacaggtcacaggtgacgctggagcactggaactgtggacgctccacactgaggcagagagtgcaaaacatgccaggctgggaggacagcattaaaagaagaatgtgaaatatctcacctgtaatgttcatatgcagaaatgatattattttggatatgggggttaataaaatgtattattaaaatta

SEQ ID NO: 27691 - DNA, 425 bp, Homo sapiens
ctttcccgtctattcctactttagtgacagttattatcaagagtgggcattagattttgtcaaattatcttatgcatctattaatacaatcctgttatttttttctttagcctcttgatatgatggattaaattaattgattttcaaatgttgacccagccttgcatacatgggataaatcccactagttcatgctgtataattacttgtatatatagttgtattcaatttgctaatattttattgagaattttgcatttctgctcataagagatattggtctgtagtttcttgtaatgtttttgcattgttttggaattagggtattgttagcctcacataatgaattagggagtatttcctctgccttctgaaagagattgcagagaattggtataatttcttccttaggctgggttcagtgt

SEQ ID NO: 27692 - DNA, 653 bp, Homo sapiens
agagaacctagagcccaaggttcagagtcacccatctcagcaagcccagaagcatctgcaatatctatgatggcctcgccctttgctttactgatggccctggtggtgctcagctgcaagtcaagctgctctctgggctgtgatctccctgagacccacagcctggataacaggaggaccttgatgctcctggcacaaatgagcagaatctctccttcctcctgtctgatggacagacatgactttggatttccccaggaggagtttgatggcaaccagttccagaaggctccagccatctctgtcctccatgagctgatccagcagatcttcaacctctttaccacaaaagattcatctgctgcttgggatgaggacctcctagacaaattctgcaccgaactctaccagcagctgaatgacttggaagcctgtgtgatgcaggaggagagggtgggagaaactcccctgatgaatgcggactccatcttggctgtgaagaaatacttccgaagaatcactctctatctgacagagaagaaatacagcccttgtgcctgggaggttgtcagagcagaaatcatgagatccctctctttatcaacaaacttgcaagaaagattaaggaggaaggaataacacctggtccaaca

SEQ ID NO: 27693 - DNA, 428 bp, Homo sapiens
tggtgataatgagaccaaggttgcattttgatgccaggtaaggttattctgtttagtcacatactcctgaccctagccagctgactgcttgaaaagatatactgtagttgctttagtataagcaattactaaaaaattaattgatataatttaaaattttaggcaaccttaaagcccacaaatagtaatcatacatgaaaatgttgtcttgactatattttttggggaaattcatattctatataggttgattcagcttttactcagaatatttattttctgtactttaaatcattatagccaaactgcttctagattcttacccccagtataagcaggaaaaggattaaaggatacatgtaaagatcataaaggacactttaatactatacttttttactttgttcctaaaccaaataatttaaaaa

SEQ ID NO: 27694 - DNA, 433 bp, Homo sapiens
agctcggtagagaaatggaagaggaaggtatatgcagtgtttgactgtctctgtttcttgtctcacgtcacaaaacaagactgaatttggatttctgaacgcgactgtgttttcctcgggagtaatgaaattagggctccatttccttcgctgttcccaagggaaaggtcctgcttaaacaggtgctttgtgagtggaaacgtggccagagtgcggcgggtgctttgtgagtggaaatgtggccagagtgcggcggatgctttgtgagtggaaacgtggccttctctggaagccctggggaggggctttccgactgagaggaaggcctcgcatctgcccaccgcccagtcctgggcctcacagtgaggatgcaggtcacgctgcacagatgaggcccgtgtggcaggtggtcccaggaacgaactcgcctccc

SEQ ID NO: 27695 - DNA, 1017 bp, Homo sapiens
tttagatctaagttttatggcaaagtaacccttaagttactaaaatttgtgtatgtgttcatggagcagacatatattgagtgtttcttatataccaagccctcgtgctggatgtttagcatccagggatggataagacagctgtgccttcaaggagcaagaggccctggcgcagagaccactgcagcgcctcgttagcttcacaggcaggctcgtgctgtctgcacactcagcagtgacagcagggtgtggccagggcgacacaaccttcaggggattctggaagctcatactcctccaggaaagagggggctctaggcaaacatgaaggcctgagcccccagctcatctgaggaaaagcaggtggtctggaagcgccgctagggcagaggtggggagcatgtgtagacgcctcccggcgggaagggaccaccagggccagctcgggccccagcgctgccggtgtcattcggggttaaggtctgtccagcagcaacgcggggcagggctggtgccaaaaagaccagttaaagaattggaatttgtgtcatgtttaacttgttggagttgtgaataaagaacactgtgaggtctacctgggttaggtctacctggccaggtagacctaacccaaggtagaaggccagagctcccacaaaagctgtcaccagcacccgtggtatccacagccttgactttcttctgtgggaatgtgctttggctcaggttctgtctgtgacagcaccacacatccttcagcccctaaggtaatgatttaccacctggcagccccttttcaagagcactaatgcagcctccccagcatctgcagcgctgcccaccgtgaggccagttaaaatctcagcctcactctcattgcagcagaacacatctgagagggtgtagaactggggactcaggtcagcaatggaggggctggattgaacaggtttcactccactctgcgggcattgtaggtcactgggggacccagagcgcgagctatgaggggggaaa

SEQ ID NO: 27696 - DNA, 1996 bp, Homo sapiens
ccctcacttcctctcttctcctgtttctcaacatcctggcttagtattgtgtgcaaaatcagagaggggtgcaagatcctgatttttcaggagttcaagcgacaatggcagcccaatacggcagtatgagcttcaaccccagcacaccaggggccagttatgggcctggaaggcaagagcccagaaattcccaattgagaattgtgttagtgggtaaaaccggagcaggaaaaagtgcaacaggaaacagcatccttggccggaaagtgtttcattctggcactgcagcaaaatccattaccaagaagtgtgagaaacgcagcagctcatggaaggaaacagaacttgtcgtagttgacacaccaggcattttcgacacagaggtgcccaatgctgaaacgtccaaggagattattcgctgcattcttctgacctccccagggcctcatgctctgcttctggtggttccactgggccgttacactgaggaagagcacaaagccacagagaagatcctgaaaatgtttggagagagggctagaagtttcatgattctcatattcacccggaaagatgacttaggtgacaccaatttgcatgactacttaagggaagctccagaagacattcaagacttgatggacattttcggtgaccgctactgtgcgttaaacaacaaggcaacaggcgctgagcaggaggcccagagggcacagttgctgggcctgatccagcgcgtggtgagggagaacaaggaaggctgctacactaataggatgtaccaaagggcggaggaggagatccagaagcaaacacaagcaatgcaagaactccacagagtggagctggagagagagaaagcgcggataagagaggagtatgaagagaaaatcagaaagctggaagataaagtggagcaggaaaagagaaagaagcaaatggagaagaaactagcagaacaggaggctcactatgctgtaaggcagcaaagggcaagaacggaagtggagagtaaggatgggatacttgaattaatcatgacagcgttacagattgcttcctttattttgttacgtctgttcgcggaagattaaacttaatgaaaatctgtttgtattttctgcatattctctggcaaccttgccccatacttacttatttagcatagtcgagtgctctagtttctgtctctcaggcactcgtaactaaggaccaccattggccattggtagatgtttgattgacttaacaagagagggacaaattttcaatttgtgaaactccaaagcagaaagtattggtgcttgctaccttgtgaattcttccttagacatgcagagaaaatgtatgcaagagaccaaaaagatggctccaagctatgtcatgttacctgtaataaaatcttttcttctagattctttctatgttggcagataatctccccttgtagcttccactcacttattcttgcattcagagtcacaatgatcatcttacccatgtggtttttgagaaagaaagatcaattctttgtttgcagtaggtaatcttagagatggagatgattgtagaattattcctagatgagtgtcaatttatttaattccattgtcatataaggagtcaaattgtttcttatcatttgttcattgaagaacagagacctgtctggaaaatcgatctctacaaattcaattaaataatgatccccaaatgctgaaaaagtgaaatacagcaattcaacagataatagagcaatgtttagtatattcagctgtatctgtagaaactctttgacgaacctcaatttaaccaatttgatgaatacccagttctcttcttttctagagaaagatagttgcaacctcacctccctcactcaacactttgaatacttattgtttggcaggtcatccacacacttctgcccccactgcattgaattttttgcttatgttgtttataataaaacttttcaattatctcataaaaaaaa

SEQ ID NO: 27697 - DNA, 798 bp, Homo sapiens
ccctcacttcctctcttctcctgtttctcaacatcctggcttagtattgtgtgcaaaatcagagaggggtgcaagatcctgatttttcagggcctggaaggcaagagcccagaaattcccaattgagaattgtgttagtgggtaaaaccggagcaggaaaaagtgcaacaggaaacagcatccttggccggaaagtgtttcattctggcactgcagcaaaatccattaccaagaagtgtgagaaacgcagcagctcatggaaggaaacagaacttgtcgtagttgacacaccaggcattttcgacacagaggtgcccaatgctgaaacgtccaaggagattattcgctgcattcttctgacctccccagggcctcatgctctgcttctggtggttccactgggccgttacactgaggaagagcacaaagccacagagaagatcctgaaaatgtttggagagagggctagaagtttcatgattctcatattcacccggaaagatgacttaggtgacaccaatttgcatgactacttaagggaagctccagaagacattcaagacttgatggacattttcggtgaccgctactgtgcgttaaacaacaaggcaacaggcgctgagcaggaggcccagagggcacagttgctgggcctgatccagcgcgtggtgagggagaacaaggaaggctgctacactaataggatgtacacaggaatcagaatgaaactcgagtacgaaactacgaactcaggtacagtaccattagttaatatgtagagaatatacttttgattaa

SEQ ID NO: 27698 - DNA, 4023 bp, Homo sapiens
atcaaatgtggggtttgttacattccgctgccgccgcggacagttcttaaagggccagccgccggctgccgcgcagacccagctgcgtcctgcgccgcctcccgctccctgagggcctgggccgagagagactgatcgcgcgtgggcctcgcgaggcagacgccgtcgggcggacaacaaagagagaggccccggaaggagccgggctgcccccggacccgggggtggggaggggagcacattgttccgcagggcgggagctcttaaaggatccagacaggcaccccccccctcccccgccccctgcccagtttggccgtcctagatcgggaacaaaggagtcaacgtgtggccgggcggccaaagggttgtgagtcccggcccagcccctccacccccctgcccccccgatgcgaccatgggctctggcagtgactaggtggccaccctccgcccccgtgggccagcggcgattctctgcgggacctggcagcaccccgggccagctctggggaagccctggcctcgagggccccctggccagcccgcctgcccgggatgagcgcttaccctcccagcagccgccgtcccgacctccacacctccccgtagaggagcgccgagcctcggctcctgccggcgggagcccccgaatgctgcacccagccacccagcagagcccgttcatggttgatctccacgagcaggtgcaccagggacctgtccctctgtcctacacggtcaccacagtgacgacccaaggcttccccttgcctacaggccagcacatccctggctgcagtgcccagcagctcccagcatgctccgtgatgttcagtgggcagcattaccccctctgctgcctcccgcccccgcttatccaggcgtgcaccatgcagcagctgcctgtgccctatcaggcctacccccacctcatctccagtgaccactacatcctgcaccccccaccaccggccccacccccccagcccacccacatggcgcccctggggcagtttgtgtctctgcagacccagcaccctcggatgcccctccagcggctcgacaacgacgtggacctgcgtggggaccagccctccctgggcagcttcacctactccacctctgcgcctggcccagccctttccccgtcggtgcccctgcactacctgccccacgatccgctgcaccaggagctgtcctttggtgtgccatattctcacatgatgccacggagactgagcacccagagataccgcctgcagcagccactgcccccgccgcccccacccccacccccaccaccctactaccccagcttcctgccctacttcctctcgatgctgccaatgtcaccaacagcaatggggcccaccatcagcctggacctggacgtggatgatgtggagatggagaactatgaggccctcctgaacctggccgagcggctgggagatgccaagccccggggtctcaccaaagcagacatagagcagctcccgtcgtaccgctttaacccggacagccatcagtcggagcagacgctgtgtgtggtctgcttcagtgacttcgaggcgcggcagctgctccgagtcctcccctgcaaccatgagttccacaccaagtgtgttgacaagtggttgaaggccaaccggacgtgtcccatctgccgggccgacgcctccgaggtgcccagggaggctgagtgaggccacgcagccgcctgcccgggagaaccctgcctgaagctctggaaacttgtgggtggggcccagggaggatggggagggagtggcccaggcctgccccttcgctcctgcctgcatttccagagctggtgccagggtcagcccagcgaggagtccctgcaataagcccctgcatttgccaagctccaaagactccctccctagtctgcctgcccgcccgcccgccacggagctgcctgagtgtccctgatcgggtctccctcctgtgcaccctcaggtccctccttttcctgctggcactgagtgccaggggtccgctccctcagtggggccggtggagatccttggccccaggatgggcagacagagcaccatcctgggtcagaaggtctcatgctctgaaatggcgtgccctctgcccaggtggcactgccaggtgcgtagacagacggtgtcacgagccatttcctgagccccagggctgaatcccccctccttgaccccgaacagtgaactcaggcagctggctctgtgttggctgctgtgagggctgagtctggttccctaggggaccctcatcccaggaacaacattccagccccaccctcaggctggagggcgtcccagcctaatcccgagctggggcacacgtatcctgaggggcttgggccatacggggagagggagccctgtgttcccggtggttgtccctcccagggatgcagccagacccgtgcccaatctcctctccctctgttgttttgcatgaacgtgaggagcagcagtttttgttcattcatttggcccaaaatcacgtgtaggatttggggatgtggatatttaagacaatttcttttttcttttggtttaataggggcgggtatagggaccaactgggaccgagtgcccagggggccgagcacggtcatgctggccggcctgcatgcatgcgtgtgccgggctgggctgggcggccggcggtcgtggggcagggttgggggtctgtgctcagctgataactgccatgcactgtactgcacacgtccctagagcctaccgggacccgacgcttttcagggcatttctccctccagccagggcccaactcccacctgcctgggcgaatctcctccaaggaagtcccaggaggatggggaccaggaaggctgtggacccccatctccagggggccttcccagcctgatccctgtcctccaagttctggaggaggccgctgtagggtctggctgagcttcccacccactttccctggtcccaatcctttcttgtcctatacccagctggggttgctgccctgaacgaactgcgtgtggggccggcacatcctagcaggcagcccctggcgcctgctgcctcagggatgctccaaccaccctcgttctcctcgcagtggccctggctcccacctcccgccccagcctgccgtggggcccgtcagcctggtcccacccccatggagaacccaaagtcttactgtatataactccaggtgacgtttctatatttatagcagtgttgaaaacccacgtgttttacacagaaccaccctctccaacccctcccttcccgaccccaacaaaacgttttcaaaccccttacagttcctggggcaggcggaaacaggctcacagattgtgtgtcggctgcagcagtgattccaacaagcagctattgggggggaaacacagcatttaaaaagatcatcattaaaaaacaagatttatacaacaattacttaggatgtttgtgatccgccgaccttgctatagatgccatgttaccaatgatttcctgtggtgggggcttgccattgtttactctcttatttaccaacttctggcctaggcatgacagtgggcaccttcccccagccctggctgggcccagcgcctgtgttctgtgttagaaaggttttatatatatataaaattacatatatatgtagaaatatatgtaattttgggggccctgttccttgcacattttacagttacctcatttttcccatgtatgtatttgagaaaatgctaatatatagagaaaaaaatggttcttaaagcttaaatgtgtggttttttccattccatgggattcacattggtttgtagcatttaacataactagtatgttgtattatatatatgtgtatactgattgaaatttttaacagatttgtactttttttaaaatgaaagttgctagttctgcttgaccaagtagtgcaatcattattttttttaatattgttgctgatttcagagggatattcactaataaatgtatgatgtatacc

SEQ ID NO: 27699 - DNA, 2317 bp, Homo sapiens
  misc_feature (13)..(13): n is a, c, g, or t
  misc_feature (24)..(24): n is a, c, g, or t
actggcagtaacnccacggtgtantggtacgaggctgggtggctctggaaacttgtgggtggggcccagggaggatggggagggagtggcccaggcctgccccttcgctcctgcctgcatttccagagctggtgccagggtcagcccagcgaggagtccctgcaataagcccctgcatttgccaagctccaaagactccctccctagtctgcctgcccgcccgcccgccacggagctgcctgagtgtccctgatcgggtctccctcctgtgcaccctcaggtccctccttttcctgctggcactgagtgccaggggtccgctccctcagtggggccggtggagatccttggccccaggatgggcagacagagcaccatcctgggtcagaaggtctcatgctctgaaatggcgtgccctctgcccaggtggcactgccaggtgcgtagacagacggtgtcacgagccatttcctgagccccagggctgaatcccccctccttgaccccgaacagtgaactcaggcagctggctctgtgttggctgctgtgagggctgagtctggttccctaggggaccctcatcccaggaacaacattccagccccaccctcaggctggagggcgtcccagcctaatcccgagctggggcacacgtatcctgaggggcttgggccatacggggagagggagccctgtgttcccggtggttgtccctcccagggatgcagccagacccgtgcccaatctcctctccctctgttgttttgcatgaacgtgaggagcagcagtttttgttcattcatttggcccaaaatcacgtgtaggatttggggatgtggatatttaagacaatttcttttttcttttggtttaataggggcgggtatagggaccaactgggaccgagtgcccagggggccgagcacggtcatgctggccggcctgcatgcatgcgtgtgccgggctgggctgggcggccggcggtcgtggggcagggttgggggtctgtgctcagctgataactgccatgcactgtactgcacacgtccctagagcctaccgggacccgacgcttttcagggcatttctccctccagccagggcccaactcccacctgcctgggcgaatctcctccaaggaagtcccaggaggatggggaccaggaaggctgtggacccccatctccagggggccttcccagcctgatccctgtcctccaagttctggaggaggccgctgtagggtctggctgagcttcccacccactttccctggtcccaatcctttcttgtcctatacccagctggggttgctgccctgaacgaactgcgtgtggggccggcacatcctagcaggcagcccctggcgcctgctgcctcagggatgctccaaccaccctcgttctcctcgcagtggccctggctcccacctcccgccccagcctgccgtggggcccgtcagcctggtcccacccccatggagaacccaaagtcttactgtatataactccaggtgacgtttctatatttatagcagtgttgaaaacccacgtgttttacacagaaccaccctctccaacccctcccttcccgaccccaacaaaacgttttcaaaccccttacagttcctggggcaggcggaaacaggctcacagattgtgtgtcggctgcagcagtgattccaacaagcagctattgggggggaaacacagcatttaaaaagatcatcattaaaaaacaagatttatacaacaattacttaggatgtttgtgatccgccgaccttgctatagatgccatgttaccaatgatttcctgtggtgggggcttgccattgtttactctcttatttaccaacttctggcctaggcatgacagtgggcaccttcccccagccctggctgggcccagcgcctgtgttctgtgttagaaaggttttatatatatataaaattacatatatatgtagaaatatatgtaattttgggggccctgttccttgcacattttacagttacctcatttttcccatgtatgtatttgagaaaatgctaatatatagagaaaaaaatggttcttaaagcttaaatgtgtggttttttccattccatgggattcacattggtttgtagcatttaacataactagtatgttgtattatatatatgtgtatactgattgaaatttttaacagatttgtactttttttaaaatgaaagttgctagttctgcttgaccaagtagtgcaatcattattttttttaatattgttgctgatttcagagggatattcactaataaatgtatgatgtatacc

SEQ ID NO: 27700 - DNA, 984 bp, Homo sapiens
  misc_feature (65)..(65): n is a, c, g, or t
  misc_feature (70)..(70): n is a, c, g, or t
  misc_feature (79)..(79): n is a, c, g, or t
  misc_feature (190)..(190): n is a, c, g, or t
  misc_feature (216)..(216): n is a, c, g, or t
  misc_feature (318)..(318): n is a, c, g, or t
  misc_feature (373)..(373): n is a, c, g, or t
  misc_feature (401)..(401): n is a, c, g, or t
  misc_feature (409)..(409): n is a, c, g, or t
  misc_feature (507)..(507): n is a, c, g, or t
  misc_feature (517)..(517): n is a, c, g, or t
  misc_feature (520)..(520): n is a, c, g, or t
  misc_feature (717)..(717): n is a, c, g, or t
  misc_feature (748)..(748): n is a, c, g, or t
  misc_feature (752)..(752): n is a, c, g, or t
  misc_feature (765)..(765): n is a, c, g, or t
  misc_feature (768)..(768): n is a, c, g, or t
  misc_feature (789)..(789): n is a, c, g, or t
  misc_feature (810)..(810): n is a, c, g, or t
  misc_feature (926)..(926): n is a, c, g, or t
  misc_feature (928)..(928): n is a, c, g, or t
  misc_feature (968)..(968): n is a, c, g, or t
atggagtggcggaaccatagtgggagagtgagtgagtttgtgttgctgggcttccctgctcctgngccantacaggtantattgtttgcccttttgctgctggcctatgtgttggtgctgactgagaacacactcatcattatggcaattaggaaccattccaccctccacaaacccatgtacttttttntagctaatatgtcctttctggagatntggtatgtcactgtcactattcccaagatgcttgctggctttgttggatccaaacaggatcatggacagctaatctcctttgagggatgcatgacacagctntactttttccttggcttgggctgcactgagtgtgtccttctcgctgttatggccnatgatcgctatatggccatctgctatcntctccacnacccagtcattgtcagtggccggctgtgtgtgcagatggctgctggctcttgggctggaggttttggcatctccatggtcaaagtttttcttatttcnggcctctctnacngtggccccaacatcatcaaccactttttctgtgatgtctctccattgctcaacctctcatgcactgatatgtccacagcagagcttacagatttcatcctggccatttttattcttctagggccactctctgtcactggggcctcctatgtggccattactggtgctgtgatgcacattccttcggctgctggacgntataaggccttttccacctgtgcctctcatntcantgttgtgataatnttntatgcagccagtatcttcatntatgctcggccaaaggcactntcagcttttgacaccaacaagttggtctctgtactgtatgctgtcattgtaccattgctcaatcccatcatttactgcctgcgcaatcaagaggtcaagagagccctatgctgtantntgcacctgtaccagcaccaggatcctgaccccaagaaagntagcagaaatgtatag

SEQ ID NO: 27701 - DNA, 448 bp, Homo sapiens
ggaaaacatctaagaaataaaaaaatatggtcctgcgtatgtttctagaaattttccagattaatttgcaggtgcagttggtataccatttttcacatatttattcacccttcaaatcctagaatcaaatactttttaaccatgtcatcaactattaaatcactattgtggtctttctccttaacgacttgtagtattaataggaaaagttaaatgaatgaatgaagacaaaggtagagaaaaggtaattagtgaaaactgagattagatacatctatgagggtgatgagagactcactgatgaccgaaaagttagaaaaagaaactggaagaatgatctgatttagcattctataaaggtagatgtatgtaagtttgtgtgttatatgtgtaccatatcttattagtttctatgttcatttatttatgttcatttcaaagtaaaaaa

SEQ ID NO: 27702 - DNA, 126 bp, Homo sapiens
gaaaagatcatttttttattattgcaattgttattgttaccccatgagaatggggacccagtctgtcttagggactgctgtatgacccgtgcctagcatgcagtagatgatcaataaatacttgtt

SEQ ID NO: 27703 - DNA, 382 bp, Homo sapiens
attttgcaaaaagaggaactttagctccgcactttggagatgccagtgtctttgagatgttaaggactttttgttttgtttttgttttttaattctttaactatgttacaggtttagcaatgcctccgattcaggaatttgtttaaaaccccccagtggcttagagctgcacatagaataaaatctaaactgtttctcatggtctacatggtcagccattgtttacctgacttaactaacctctccgacttcccctgacacggctgcctccctgggcttgtacgctcctgtgcttattcttgtccccgtacaaagcacatccattctcgctgtgaggccttagcagcacctgctcctgctgcctcagaaggttcttccctga

SEQ ID NO: 27704 - DNA, 176 bp, Homo sapiens
gatgctaatataaccctgaataatccataaatatgatgtttagcatttggaaaatataattttatatggttatttaataagttgttccaagataatttatgaattatttgcataaaattatgttaaatccatgaatcacatcatttattgaaaataaattttatttaaatgtaata

SEQ ID NO: 27705 - DNA, 435 bp, Homo sapiens
ctttgtctttctgaaccgtggtgttttgagtacaggccaggtctttcatagaatgtgtctgatgtgggtttgcccagtgtttcccaggattgtgtgcaggtcgtggagcgacgcaggtgactgacaagtgtccttaggaattgaattgtggtggttttttgtccatcttcaagttactgctcaccagactgcaagcatgtcttgcagggagagaccctaaggtgctgcatgtacctcccatcacatcccaccagggtcttcagcatctgccatggcccacgcttagctagtactgcacggtgggtgccaaatggtggttttctaactccatcatttcctctcttgattatttcagtttctgctgtaaggaggtgcttcactttcctgtccgtccacacagttatctgtccatttactttacaaaaaaaaaaactt

SEQ ID NO: 27706 - DNA, 206 bp, Homo sapiens
tctttctgacacttccagatttatgtgatatacattgtccatctgagtattttactctgcacccttagatttcaatctgatctcgaagtggttaaagagatgaattctctgtcccctacctcagctctcctccccagtcttcaagaaacttgttgtaagtacacatgagtatgagcactgatggagtgggaaatgaatacttatga

SEQ ID NO: 27707 - DNA, 1158 bp, Homo sapiens
agcagtgtgaaaaagaggtgagatgtcccctgaactgacaagaggctgtgtgctgctacatcctgcaaccagcaccgacatcccactgccatcatcaccatgcccaagagaaaggttgaataggacatgaaagaagataaaaccaatgaaggacaaatcacagagatctgcaagcttgtctgctaaacctgctcctccaaagccagagcccaagcctaaaagggcccctacaaagaagagagagaaggtacacaaagggaaaaagggaaaagctgatattggcaaggaggagaataaccctgcacaacatggagatgccaaaacagaccgggcacagaaagctgaatgtgttggagatgccaagtgaagtgtgtgcatttttaataactgtgtacctctgatgactgtacagtttgaaatactatttttaatcaagttttataaaaatgcagaagctatattgttagcacacagaacacttcattgttgtcttttggggaaggagcctatgtcactaatagaatgtcttcaaaactagactgatgtggaaaaaacacctttctcttctagttttgagagacttcctcttggctcccacaaggagggatttcctggctttgacacacatagccactttagcatgaaagccttaaggaggggaaaacaaatttatttttatgtcctcttttctctttccaccttcagcatacacttaactcccttaaaccgagatacctgttgggacctgaccctcaataattgattatcagcgtgtcaggcaatctggactttccagtgaaaccactgagatggtgcccctcaaaagagcagcggttctctttctgggttgtggatctttagacaaattctcccattttcatttcacttcctgaaagtcatgcttgggtcatgaaaagttgttcaaccctcactctaaactttccctgttcagagcatcaaatgaaaacttcatagggtttgataggggctttctgatttttgatagtcggttgaagaagggagtttgaaagttgttaaatactgttaatgattgtctgcccatgtcctgctgaaataccgtgattggttatggaaagtatctttaataaagctgggtatagtttggcttgggaaaaaaatcaaaacctatcaaaaaag

SEQ ID NO: 27708 - DNA, 478 bp, Homo sapiens
ttcctttccttttccattatacataatattgtaataaccatccttatacaaatgaactcacaagctaaatcttatattgctattgagtatatctagttatctcaatgattctatgggtcatgggtataattaggctgacttaaaatggaattgctggatcaattggtatgcacattaaaaaatttgtatatttgggggccagacacggcggctcacacctgtaatccaagaactttgggaggccaagacgggtggattacgaggtcaggagatagagaccaccctggctaacacggtgaaaccctgtctctactaaaaatacaaaaaattagccggcatggtggcaggcacctgtagtcccaggtactcaggaggctgaggcagaagaatggcatgaacccgggcgggggagcttgcagtgagccaagatcgtgccactgcactccagcctgggcgacagagccagattccgtctcaa

SEQ ID NO: 27709 - DNA, 411 bp, Homo sapiens
  misc_feature (291)..(291): n is a, c, g, or t
atggctcgtacgaagcaaacagctcgcaagtctaccggcggcaaagctccgcgcaagcagcttgctactaaagcagcccgtaagagcgctccggccaccggtggcgtgaagaaacctcatcgctaccgcccgggcaccgtggccttgcgcgaaatccgtcgctaccagaagtccaccgagctgctgatccggaagctgccgttccagcgcctggtgcgagaaatcgcccaggacttcaaaaccgacctgcgtttccagagctctgcggtgatggcgctgcaggaggcttgngaggcctacctggtgggactcttcgaagacaccaatctgtgcgctattcacgctaaacgcgtcaccatcatgcccaaagatatccagctggcacgtcgcatccgtggggaaagggcataa

SEQ ID NO: 27710 - DNA, 477 bp, Homo sapiens
agaaggcaaaatgggagcttggtatcacctggtaaaagcaggagcaagagagagtgcggtggagggggaatgtgtgtgtgtgttgggggatacacccttttacacagatctcatgtgaactcagagcaagagctcactcatcaccaaggagatggctaaacccatttataaggggtccactgatgatccaaacaccttccaccaggccccacctccaaccccagggatcatgtctcaacatgagatttggaggagacaaacatccaaaccacatcaacctatggggccaaatcttcataggtggaatttacaaaaggaagccttctaaaagaagtttcaccgctcctaagcactcaaacagaaaatggaaaaaaaagatgtgaagagatttctttgaagataaagactgattgtcccccacccctgtcccaccccactgttctcctcccttaagctgggaagggaccactcaagcac

SEQ ID NO: 27711 - DNA, 1668 bp, Homo sapiens
gattgcttgagtccaggagttcgagaccagcctgggcaacatagggagaccttatttctacaaaaataataaaaataattagttgggcatggtggcttgagcatgggagttcgaggctacagtgagttgtgatcgtactgcactccagcctggatgacagagtgaaaccctatcaataaaaaataaaaaaggatgggggagcagggggatgatggtcctatgcaagtctaaaacttagcaaggcacgtttcatgagatcttaggctcatgaataatcctctttggtcctatactgtcctctccaggaccccctgggcggtggtcctgacccgatagatctgccaggcaggggtgactcccccgtggcttttgttggagaccatctggcctgtggaaactggggcagtatccctcatgatctctaaatagccaagagaagagtcattcttgtatggaacaatggacattcacagccttcctcattcctggctttaggacttcagatacaatcatgtcagagctcagggcttcaacatatgaattttgggggcacagttcagtccatagcaatacttccattcccctgacctgcaacatgtccagttacttcgaaaagtacttgtcatccactatattaataacatgctcattgccagcctatgaaacaagttgaccactccatacataaggtcatagataatatgacacatgcaggttgagttgtcagccctgataagatcccaagacttgcccaacaagtgcagtccctggagctacctggtccagtaattagaggagtattcctgataaagtcaaatattgtccttggcagcccccacctaaaagaagctcaatagctggtatgcctgtttgtctattggagataacatgtatcacatctgagtattattttgcctcctttagttaaaattacccacaacacagccacctctgaatggggccctcaacaacagcagactcgagaggcctactatgcattaacatgggcctgacattaatgtaggcccatgggaactacaggtctcttgacttttaccatacagattggatactgcgcaacaagagactgctatcaggatgcaccaggcccttgggttttggacatataaattacccaagatggttgccatatacattccctttgaatggcagctactagcctgctattggactctaatttaaacagaacacttgaccactgaagcactgtatgtgaccttaagacctgagctgcccatctcatgcaggtattattaacgaaaaataaaaatggaagccccagtttagaaataccctaaggctgactacccgcaaccgtgtaaccaaaactaatcattctgattttcctgaaatgctgtctctgatcataaatgaaatgcaaaatgtaagctttacatccttgccagcatgattcactgaaattaaaccaatcagctatagaccaacaagcttaaacagctcaacttgccctaaaaagaatgtataacagccaattataaaaaaggtcaaaatattccccccctttatgcattataaactgtgttgtaactgctgtaagattaatttcttaccacttgatttgagtcttctagattgtggtctgtacttcttgtttgaacaataaacttttaaatttttctttaaaaa

SEQ ID NO: 27712 - DNA, 766 bp, Homo sapiens
ctcaggtgtagctgggacttatcgggtgaccttttagaaactgtttattttcatttttgtaccccacattgggataagtatggtccactgacattgagaataaccaggcctgttgtagacagccagccatcctgaaactactaggtttatacttcttacctgttagaacagagtttcccaagttgtattcccttggaaacactagcagtcgtgcatcatttgggcagttaggttacacaaaatttaaatggtctatttattttcttttccagacagaactcagggcagtcccaccttcaagggaaatcttcattacatccttctgatggtggggtagctgggagtcagcatgaaatcccaaattctaaatcatcgggaaaaagcagaagggttggaacccaaattaaactgaagtcctaaataaagttcacttttcggtcaggcattcaggaagcagcacgtgaaaatttgcttggatacagtttcctcatagttcttcagcagcttgaaataacatcttgagctggctgtaaacaaaacatctcaagttatcgtttttctttccatttgattgagccagttattgtatagggaggtgacacaaaacaaaacttcgtgtttctgaagccgagattttgggattgtactttatgcaaagttacttataagttctgattactttgagagaaaaatattacagtatccttaggaagttttatgtatttgttttaaagctaagcaccaccctctttttagttaaaaaaaa

SEQ ID NO: 27713 - DNA, 347 bp, Homo sapiens
gaatgttggatattgatatcaattccagagattgatagaaaaataaatgtgcttattatatgtttaattatatgctaattatatgtacaaattaggataaataacacaaaaacatataagtataatacaacaaataaaaatttgatcgtcaatttctgcctttacaataaaaggcagaaaagaagggggaatttttcaataaaaagtaacaagcaaaatattaagtccaataagtcagcattcacaaaaaatgtatacaggctaaattatcttattagaataaaagctcttggattgcctagaaaaatacaaatctagctatatttgattacaaagaatatctataa

SEQ ID NO: 27714 - DNA, 371 bp, Homo sapiens
agcttcatgcttgtgttgacacagccacaatcacaactcaggtgtcagttctgagaccttcccatgcctgtcgccactcagcaagtgttcttcatgtgccctggcagttcgcattgtaaggagcagccaggttgttatggactgttgctagttaccacagagtagtgaattatattaaggattaattacagcagacaatgtgcacagtatcatcgagtgcagcgttctaaaaatgattctacacttttactttgaaaaattggatttgaccagattgtagaatctgggtgaaaatgataggatttggtttggcgaagagctttgttgtcggtgtttttggtgacatcatgactgatcatatcgatggtttt

SEQ ID NO: 27715 - DNA, 367 bp, Homo sapiens
gcaagctttgagtgttccagcagaggatacttttaaatacagtatctagttctcttggcgtatttaaatatgatttattcaacaaaggttaagtttgcacacagccttttggtctcatctctatgaacagcaaggtggactttctttgagtggacaccagacaatggcaaccatccattttctggcaaggaaaagagctagtaggtattttcattttttcagttcaactgtgagaacactgacctgcagaagccccaaaggcagggtatagattcttcagcctggtgtgtttccattgtttcttgggtttttgctttgttaagctcatgtgtagcatatttcaaaaaataggtcataaacattcagt

SEQ ID NO: 27716 - DNA, 432 bp, Homo sapiens
atcataattctttgtgcctctgctcaagcccttcttcctgcctggaataccctcttttcagtcccggctaattacatctaccatcccattccaagtggccgctggaaactcacttccttatgttctataaattaaaacaaaaaaaccaccaccccacacaccaaaaaaaaacaaaaaccacaccccagagggagatgtatattactagagagggagtcttgctctgttgcccaggctggagtgcagtggcgcgatctcagctcaccacaacctccgcctcatgggttcaaccgattctcctgcctcagcatcccgagtagctgggactacaggcgcgcgccgccacgcctggctaattttttgtgtttttggtagagacggggtttcactatgttggccgggctggtctcgaactcctgacctcgtgatccg

SEQ ID NO: 27717 - DNA, 421 bp, Homo sapiens
atcataattctttgtgcctctgctcaagcccttcttcctgcctggaataccctcttttcagtcccggctaattacatctaccatcccattccaagtggccgctggaaactcacttccttatgttctatgatttctttcacaatttacactttttttgttttgttttgttttgtttgggggggggggttgtttttctgagagggagtcttgctctgttgcccaggctggagtgcagtggcgcgatctcagctcaccacaacctccgcctcatgggttcaaccgattctcctgcctcagcatcccgagtagctgggactacaggcgcgcgccgccacgcctggctaattttttgtgtttttggtagagacggggtttcactatgttggccgggctggtctcgaactcctgacctcgtgatccg

SEQ ID NO: 27718 - DNA, 669 bp, Homo sapiens
ccctgagtctctgcagcaaaagccatgtcagaggggagattataactaggtaactataacaagcacttgagcacttaccatgttccaagcactatcaccaaggtactgttggggtttatggcagtctaacggtaagaaaaatgtggtaaaatgaggtaatcatgctgctatagctttttgctttttttcatatagtatcaagttggtcagaattagctttctctgactggtctgcttccgtgtttctctgtgatggtgttaagattatgaaagaaaaagaagattacctaagactgctacaagtgttaactatatgcccttaagaatgagcttgactttggaagtaaagcttttcagatcttagtctacccggggcctttgttgatgggtctgtggttctgtagacccctggctttcactgtgttctcagaggtacaccagattgagagcagagttcttctttggaagtcccagagcaaaataactgccatcaagtgagtttgcattcgtatttgtttccccttccatagagggttagttttagttacctctagcttggagttcctgagaaggctggttataggactgagcgtgggaaaggaaccctcttcaggattacctcagtcccatcagtctaccccattgtgacattgagcccaacacacacgc

SEQ ID NO: 27719 - DNA, 454 bp, Homo sapiens
tcccgacacctgctagcccctgcccaagtggtttttcctcaagcccattgggtggaaatgctggagatgctgctgaagtttctctaagaagggaacggaggcacctgccatagtgatgaacagaggtatggtagtgagtactgagtgctgagtgctgatactgagcacagagtactgagtattgagcaccaagtactgagcatgggccagctgggttttgggcccatttcaccctccccctggcctctggggtgcccctaactgggatccctgccatgcacatgacagattccccctgtggcctgactgtggctccaggtttccagagagggtccccagcccggcaggacccccgttcaggtcctaagtcatttgtcggccatgctctgtccccagaacctcagcaaggggggcgctgtgagcaagctgatggagagcatggcagccgaggagg

SEQ ID NO: 27720 - DNA, 651 bp, Homo sapiens
tgagaagcccagtcccactatacattggagaactcatacaaaagagaacatttatgagtgtagtaaatgtgggaaaagcttcagaggaaagtcacacctctctgttcatcagagaattcatacaggagagaaaccctatgaatgtagtatatgtgggaagactttcagtggaaagtcacacctctctgtccatcatagaactcatacaggagagaaaccttatgaatgcagaagatgtgggaaagcctttggggagaagtcaacccttattgtacatcagagaatgcatacaggagagaaaccctataaatgcaacgaatgtgggaaagcctttagtgagaagtcaccactgattaaacatcagagaattcatacaggagagagaccctatgaatgcactgactgtaaaaaagccttcagtaggaagtcaactctcatcaaacatcagagaattcatacaggagaaaaaccttacaaatgtagtgaatgtgggaaggccttcagtgtgaaatcaactctcattgtgcatcacagaactcatacaggagagaaaccttatgaatgcgtccgtcgaagcgacggaccattcacaaagagcacctcatcataatttattgaatgcgtccaggatcctgctagatcacatcagca

SEQ ID NO: 27721 - DNA, 262 bp, Homo sapiens
gaggcagaggttgcagtgaactgagatcgtgccactgcactccagcctgggcattatagccagaccttgtcaaataaataaataaacaaacccatggtataaatgagaggaatcatgctctatattcttttattaatagagacagggtcttgctatgttgccaggctggtctcgaactcctgacctcaggtaatccgcccgcctcagcctcccaaagtgctgggattataggcgagagccaccacgctcagtgagtatgaca

SEQ ID NO: 27722 - DNA, 1004 bp, Homo sapiens
tgagaagcccagtcccactatacattggagaactcatacaaaagagaacatttatgagtgtagtaaatgtgggaaaagcttcagaggaaagtcacacctctctgttcatcagagaattcatacaggagagaaaccctatgaatgtagtatatgtgggaagactttcagtggaaagtcacacctctctgtccatcatagaactcatacaggagagaaaccttatgaatgcagaagatgtgggaaagcctttggggagaagtcaacccttattgtacatcagagaatgcatacaggagagaaaccctataaatgcaacgaatgtgggaaagcctttagtgagaagtcaccactgattaaacatcagagaattcatacaggagagagaccctatgaatgcactgactgtaaaaaagccttcagtaggaagtcaactctcatcaaacatcagagaattcatacaggagaaaaaccttacaaatgtagtgaatgtgggaaggccttcagtgtgaaatcaactctcattgtgcatcacagaactcatacaggagagaaaccttatgaatgcagagactgtgggaaagcattcagtgggaagtcaactctcattaaacatcagagaagtcacacaggagataaaaacctatgattatacttgagagtgggataattatactagtagttatttgtcatttgactattactagtctcattatttgtcaaataatcatggcgagtaatcttataaatgtccagaatattggaaattcttcatatgttaatgttcatttaacttaatacaaagtacaaaagtataattccagcctgggcattatagccagaccttgtcaaataaataaataaacaaacccatggtataaatgagaggaatcatgctctatattcttttattaatagagacagggtcttgctatgttgccaggctggtcttgaactcgtagcgttaattgatcctcccacctttgcctcccaaagcacttgtatta

SEQ ID NO: 27723 - DNA, 404 bp, Homo sapiens
cttgtagaagtcattgcttcagtaagagttgattatgtgttcatttctcaaggacaatgggtctgagtggcaaataccttcagaattttttttttttagggataagctaaactaagtcagatttctttgtgaaataggggatgtggcaaaacaaagggtggttagattcaaagtttgaaaattttgggtatcatagctattggaggtagggaatggtaaagggttggaagagggtggaaatatccagggaccacatccatttgctcttcttgttttctgcttcaggggtagtgacttcttttgaaaaatgagaggtttattttcataacaggcagtgaggaatagttaggcagatgtgtgtgggttggttctggcccttgattagcagacaggaatgatactgc

SEQ ID NO: 27724 - DNA, 148 bp, Homo sapiens
gggaagtgtgggggctgttaccctccttgttttacagagacagatactgaagagtgggagatgtaaataacttgccttgtatcaaacaattgatgagcagaagccagtcccaggccattgcactctactttctgtttctaaaccaaca

SEQ ID NO: 27725 - DNA, 377 bp, Homo sapiens
tatacataaaaataaacagctaagagatgttatgctaaagtattgatggtttttctatgaaagtgtggtactagtacaaatagatcactaagaaacaagagagtccagctatagacccaaatctgatatgtgatgaaggcggcatttcaaatcatgggggaaagatggattgttcatgaaatggtattagggtgaccgactgaggacaagatgttcagctggatccctgtatcatttctttttcttttcgcttttcttttctttttttttttttttttttttgagacagagtctctctgtgtcgcccagtctggagtgcagtggcgtgatctcagctcattgcaatctccgcctcctggattcaagcaattctcctg

SEQ ID NO: 27726 - DNA, 398 bp, Homo sapiens
cattgcctgtagaacacctaatgtcacgtgtagctatacatatgaatacctacttttaatccctatgtgaatgattaacctatgtttcattcctcatctctggcacattaacatcattctggaataaccccttttaaatttaatttaaattttaatattttattattttacagacagagtctcgctctgccacccaggctggagtgcagtggtatgatcacggctcactgcagccttgacctcccgggctcaagcagtcctcccacctcagcctcccaagtagctaggactatagggacacaccactgccaggctaatttttgtatcttttgtagagatggggtttgagaccagcccgggtaacatagcgaggcctcgtttctccaaaacaaaaaaac

SEQ ID NO: 27727 - DNA, 1090 bp, Homo sapiens
atcctttgtcaagacagatattttgagaatgtttgcttctgtggcttgtcacttcatttcattaacaatgtcttctatgagccaacagtttcaactttgataaaatcgaatttatcattttttttcttttgtggtaatagttttctgtgtcctgcctacctccacaatgccaacatatacccatgttatgattgataattttagttttttggttttaggtctacaacctagcttgacttaatttctgtatatggtgtaaggaagatgtcaggcttcattttttcctctacagatatcctggtgaacataatgccatttgttgaaaacagttttgtcctatttcacttttgctgaaaattagatgattgtataggtgtgtgtctgtttcgggacacactgttttgtcccattgacgtacaaatggatcttaatccagttcacactgtcttcattactgcagattttcatgggttgggtaaggccagtcctctttgttcttttaaaaaattaagtatttttggtcctttgcatttttatataaagtttgcttttgccacttcctacaaaaaaaaaagcctgttgagattttgaatgagaatatgtggaattgtatgtcagtttccctcatactgacaatattagcaatattgagtcttcttacccgtgagcgtagtgtatttcttaatttatttagatattctttaatttatcctcacaaacattttgcagtttttggtatagggttttgctcatactttgtcaaatttgtttctgaatattttgtttttttctgacgttccttcaaatggcatagctttgttggtattttttgctactgatttgtagtaaatcaattttggattgatatgctaggggtatatacaaatacagttgatttttgcaagcggacagctttccagggactgctgtagcataacaaatgactcccaaaccctctgactggaggcagccatgcctttgtgctctcgggctctgtgggtcaggatctctgtcagggcatggtgtggacggctgatttgcgcaccatgatgtctggaatctcaggtggtggctggaagcatctagactc

SEQ ID NO: 27728 - DNA, 403 bp, Homo sapiens
gatcgcttgagcccaggagtccaagattggcctgggcaacagagaccctatctctacaaaaatatatatttttttaattaggcaggcttggtggcatgcacctgtggtcccagctactcatgaggctgaggtgagagcattgcttgagcccaggaggtcgaggctacagtgagccgtgatcgtgccactgcactccagcctgggagacagagggagactctgtctcaaacaaacaaaaaacaacaaacacaaaacaaaacaaaaaaaactaaaaaaacaaaaactcagaaataggcagcagcagctaaagataagcagaacaaccatgttcatgttcatattcatgtaagaatgtattttgttaattgactccctgaattcaaaatacagtgcatccatggca

SEQ ID NO: 27729 - DNA, 382 bp, Homo sapiens
cccaaaatacttgttagatttcatttttatagaatgcaaattaaaaaatatattattatagggcacctacatatgtgcataagctataaagaaaaacaagaggcctggcgtggtggctcacgcctgtaattccagcactttgggaggccaaggcaggcagaatgcttgaactcaggagctcaagaccagcatgggcaacatggtaaaaccccatctctaccaaaaatacaaaaattatctgggcatggtggcacgcacatgtggtcctgatacttggcaggttggggtgggaggatcgcttgaacctgggaggcagaagttgcagtgagccaagatggcaccactgaactccaacctgggtgacagagtgagacctgtctca

SEQ ID NO: 27730 - DNA, 1776 bp, Homo sapiens
cccccgagccgcacggagctgcgggcagcgggcggactgttaaaccgcggcggcggcggcggcggcggcggcggcggccggggcgggagcggggcgcgctctggagacgagtcagcggcgccccgggtgggggaggcgggcgggcagctagagatcacctcagcagcccccaccacggccggaccgaaggtgcggcggcggaggggagccagggcgccccagcaggtttccaatacttatctacaggaatcgccatgaccccagctctgagggaggcaacagcaaagggtatcagcttttcatctttgccaagtaccatggagtctgacaagatgctctacatggaaagtcccagaactgtagatgaaaagctaaagggagacaccttttctcagatgcttggatttccaactcctgaacctactcttaatactaattttgtgaatttaaaacattttggctcccctcagtcttcaaaacattaccagactgtttttttaatgagatctaattctacattaaataaacacaatgagaattataaacaaaagaaattaggggagcccagttgcaataagctgaaaaacatactgtataatggcagcaacattcagctcagtaaaatctgtctttctcattctgaagagttcatcaaaaaggagcctctatcagataccacgagccagtgcatgaaagatgtacaaattattctggattcaaatataaccaaagacactaatgtagataaagtacaactacaaaactgtaaatggtatcaagagaatgcacttttggataaagttactgatgctgagattaaaaagggtttattgcactgtactcaaaagaaaattgtacctggccactcaaatgtgcctgttagttcttcagctgctgaaaaagaggaggaagtacatgctcgtttacttcattgtgtaagcaaacagaaaattttacttagccaggctagaagaactcagaaacatttgcagatgctcctggcaaagcatgttgttaagcactatggtcagcagatgaaattgtctatgaaacatcaactccccaaaatgaagacatttcatgaacctaccacaattttgggtaatagtttacctaaatgcactgaaattaagccagaagttaacacattgactgcagagaataaattgtgggatgatgcaaaaaatggctttgcacggtgtacagctgcggaaatccaaagatttgcattttctgctacagggctgttgtctcatgttgaagagggtttggattccgatgcaactgatagcagctctgatgacgatttggatgaatatacccttagaaaaaatgtggcagttaactgtagtactgaatggaagtggcttgtagacagagcacgagttggcagccgatggacttggcttcaagctcagatttcagacctagaatgcaaaatccaacaactaacagacattcacaggcaaattcgtgcctccaaggggatagtggtcctagaagaatgtcagcttccaaaagatattttgaaaaaacaaatgcaatttgcagaccaagcagcttcactaaacattctagggaatcctcaggttccccaggagtgtcaagatcctgtaccggaacaagattttgaaatgtcaccaagcagccctactttacttcttcgaaacatcgaaaaacaggtaaagtcaaagtaaggatatcagtggtatgaaatgacttttcattgattttgtaaactattcaaataaacatcattatatgtgtaaattcctg

SEQ ID NO: 27731 - DNA, 2042 bp, Homo sapiens
cccccgagccgcacggagctgcgggcagcgggcggactgttaaaccgcggcggcggcggcggcggcggcggcggcggccggggcgggagcggggcgcgctctggagacgagtcagcggcgccccgggtgggggaggcgggcgggcagctagagatcacctcagcagcccccaccacggccggaccgaaggtgcggcggcggaggggagccagggcgccccagcaggtttccaatacttatctacaggaatcgccatgaccccagctctgagggaggcaacagcaaagggtatcagcttttcatctttgccaagtaccatggagtctgacaagatgctctacatggaaagtcccagaactgtagatgaaaagctaaagggagacaccttttctcagatgcttggatttccaactcctgaacctactcttaatactaattttgtgaatttaaaacattttggctcccctcagtcttcaaaacattaccagactgtttttttaatgagatctaattctacattaaataaacacaatgagaattataaacaaaagaaattaggggagcccagttgcaataagctgaaaaacatactgtataatggcagcaacattcagctcagtaaaatctgtctttctcattctgaagagttcatcaaaaaggagcctctatcagataccacgagccagtgcatgaaagatgtacaaattattctggattcaaatataaccaaagacactaatgtagataaagtacaactacaaaactgtaaatggtatcaagagaatgcacttttggataaagttactgatgctgagattaaaaagggtttattgcactgtactcaaaagaaaattgtacctggccactcaaatgtgcctgttagttcttcagctgctgaaaaagaggaggaagtacatgctcgtttacttcattgtgtaagcaaacagaaaattttacttagccaggctagaagaactcagaaacatttgcagatgctcctggcaaagcatgttgttaagcactatggtcagcagatgaaattgtctatgaaacatcaactccccaaaatgaagacatttcatgaacctaccacaattttgggtaatagtttacctaaatgcactgaaattaagccagaagttaacacattgactgcagagaataaattgtgggatgatgcaaaaaatggctttgcacggtgtacagctgcggaaatccaaagatttgcattttctgctacagggctgttgtctcatgttgaagagggtttggattccgatgcaactgatagcagctctgatgacgatttggatgaatatacccttagaaaaaatgtggcagttaactgtagtactgaatggaagtggcttgtagacagagcacgagttggcagccgatggacttggcttcaagctcagatttcagacctagaatgcaaaatccaacaactaacagacattcacaggcaaattcgtgcctccaaggggatagtggtcctagaagaatgtcagcttccaaaagatattttgaaaaaacaaatgcaatttgcagaccaagcagcttcactaaacattctagggaatcctcaggttccccaggagtgtcaagatcctgtaccggaacaagattttgaaatgtcaccaagcagccctactttacttcttcgaaacatcgaaaaacagagtgcacagttgactgagatcatcaacagtttgattgcccctctcaacttgtccccaacttcatcacccctctcttccaaatcctgtagccataaatgtctggctaatggcatttacaggaggtaggtatcaatggaatagcttagcttttaaattcaactttgcctattttatcttattttgattttgttttgatattttaagtattatagctactttttttgtacattaggggctactagagtacaatcaatataccatggatgcattttttgataatattaaatttacacaattaaggtaatgataaatctaggaatgagggagagagatttctgggaagtttcataatgtttctta

SEQ ID NO: 27732 - DNA, 666 bp, Homo sapiens
ggataaagttactgatgctgagattaaaaagggtttattgcactgtactcaaaagaaaattgtacctggccactcaaatgtgcctgttagttcttcagctgctgaaaaagaggaggaagtacatgctcgtttacttcattgtgtaagcaaacagaaaattttacttagccaggctagaagaactcagaaacatttgcagatgctcctggcaaagcatgttgttaagcactatggtcagcagatgaaattgtctatgaaacatcaactccccaaaatgaagacatttcatgaacctaccacaattttgggtaatagtttacctaaatgcactgaaattaagccagaagttaacacattgactgcagagaataaattgtgggatgatgcaaaaaatggctttgcacggtgtacagctgcggaaatccaaagatttgcattttctgctacagggctgttgtctcatgttgaagagggtttggattccgatgcaactgatagcagctctgatgacgatttggatgaatatacccttagaaaaaatgtggcagtgtaagtgcaaaattattattagactattttctgttccatatatagcagcaattatcttagtttccaggtatgttgacaagaaatagattttctaaaatcttaatgctataatctttt

SEQ ID NO: 27733 - DNA, 1962 bp, Homo sapiens
cccccgagccgcacggagctgcgggcagcgggcggactgttaaaccgcggcggcggcggcggcggcggcggcggcggccggggcgggagcggggcgcgctctggagacgagtcagcggcgccccgggtgggggaggcgggcgggcagctagagatcacctcagcagcccccaccacggccggaccgaaggtgcggcggcggaggggagccagggcgccccagcaggtttccaatacttatctacaggaatcgccatgaccccagctctgagggaggcaacagcaaagggtatcagcttttcatctttgccaagtaccatggagtctgacaagatgctctacatggaaagtcccagaactgtagatgaaaagctaaagggagacaccttttctcagatgcttggatttccaactcctgaacctactcttaatactaattttgtgaatttaaaacattttggctcccctcagtcttcaaaacattaccagactgtttttttaatgagatctaattctacattaaataaacacaatgagaattataaacaaaagaaattaggggagcccagttgcaataagctgaaaaacatactgtataatggcagcaacattcagctcagtaaaatctgtctttctcattctgaagagttcatcaaaaaggagcctctatcagataccacgagccagtgcatgaaagatgtacaaattattctggattcaaatataaccaaagacactaatgtagataaagtacaactacaaaactgtaaatggtatcaagagaatgcacttttggataaagttactgatgctgagattaaaaagggtttattgcactgtactcaaaagaaaattgtacctggccactcaaatgtgcctgttagttcttcagctgctgaaaaagaggaggaagtacatgctcgtttacttcattgtgtaagcaaacagaaaattttacttagccaggctagaagaactcagaaacatttgcagatgctcctggcaaagcatgttgttaagcactatggtcagcagatgaaattgtctatgaaacatcaactccccaaaatgaagacatttcatgaacctaccacaattttgggtaatagtttacctaaatgcactgaaattaagccagaagttaacacattgactgcagagaataaattgtgggatgatgcaaaaaatggctttgcacggtgtacagctgcggaaatccaaagatttgcattttctgctacagggctgttgtctcatgttgaagagggtttggattccgatgcaactgatagcagctctgatgacgatttggatgaatatacccttagaaaaaatgtggcagttaactgtagtactgaatggaagtggcttgtagacagagcacgagttggcagccgatggacttggcttcaagctcagatttcagacctagaatgcaaaatccaacaactaacagacattcacaggcaaattcgtgcctccaaggggatagtggtcctagaagaatgtcagcttccaaaagatattttgaaaaaacaaatgcaatttgcagaccaagcagcttcactaaacattctagggaatcctcaggttccccaggagtgtcaagatcctgtaccggaacaagattttgaaatgtcaccaagcagccctactttacttcttcgaaacatcgaaaaacagagtgcacagttgactgagatcatcaacagtttgattgcccctctcaacttgtccccaacttcatcacccctctcttccaaatcctgtagccataaatgtctggctaatggcatttacaggagaacacagagaacaagggaaagcatcatgcaagatgagacaagggaaagcatcatgcaagatgagaacaagttatgttatatgcctgcaacccaaaggatctaaactacatcatttggaagatttttattattctccagcttccagttagaaatctaaa

SEQ ID NO: 27734 - DNA, 379 bp, Homo sapiens
cacagcaaaattaagaaatagttaagtcactgaaacggaagttgtgggccctggattcaaacccaagcaggccaattagaaagtccatgcttttggccaggtgcggtggctcacgcctgtagtcccagcactttgggaggctgaggcgagcagatcatttgaggtcgggagttcgagaccagcctgaccaacatagagaaaccccatccgtactaaaaatacaaaattagctgggcatggtggcctttgcctgtaatcccagctactcaggagggtcaggcagaagaatcgcttgaacctgggaggcagaggttgcagtgagccgagatcaagccattgcacactccagcctgggcaacaagagctaaactccgtctca

SEQ ID NO: 27735 - DNA, 1018 bp, Homo sapiens
tgagactcctgctgttgcccaggctggagtgcagtggtgcaatctcggctcactgcaagctccacctcctgggttcatgccattctcctgcctcagcctcccgagtagctgggactacaggcgcccgccaccacacccagctaattttttgtatttttagtagagacagggtttcactgtgttagccaggatggtctcaatctcctgacctcgtgatctgcctgcctcggcctcccaaagtgctaagattactggcgtaagccactgcgcctggccgatgggctgcttttcatccttcagatcagagttccaatgtcccctcctctgtgattccttccctgaccaccctgaagcagctcatacccgtctttacctcctcgtcctgtttcattttcatccaagcacctactgccctctgagatgatcttattgctggttctattcccctatcagtgattctgttttgctcacagatgtatccacagtgcctacaaaagtgcttattgcaccgcagtggtagaagcctagacaatgaagcaggccaggaaggcctttcagactcagaggaggttccactttgatgtcacatgtagtaagatggttccttttcctagacctcatctgtgagatgaggggttgggctagataatctctaaagaacctttgggcactgacatcctttgattctgagagaccccacgactcatcccccaagttgaaggccacagacattaagtgggagtaggcagcagagggtattgggtgacagatcaagctctgggactcaggccctttctttagtcccactgaaggttactgaaggtcagagatgggaatggacatgattaactacctactgcgagctgaagatgtgtgtgggtgactttcagaaactgtgtcctgtcctcctcggttgtgacacagtcccattttacagaggagaaactgagtttcaagtgaaataaagaagttgttcctgatcagagacagagccaggaagagggaggcgggagttgga

SEQ ID NO: 27736 - DNA, 451 bp, Homo sapiens
atatgcctgtcacaacaaatctctggtcctaatttgctgtctggtactgatttcctgcttcctcccaccccgcaaggatatacaaggagtccacacaacacatgttatcgccaaggcatgattcgtgcagggctttggctctggtagaaatcaaaggttcagctgccatgagctcatcattgcttttgaatagtgctgttggactctttttgattccaaatttattccctgctcccagtagtttggtccctccctttttaacattgtagtggccatatgaagctctcagtgtccaacgtccaggtcactttagtgatattcggtgtgctacagtcaggtggtcctcaaaggcctttcgggacaaagcccttgggatgattaacagacctacagagaacaaaaagcatgtatggctcttgtttctcctcctgtggggaggctgcctgcatgg

SEQ ID NO: 27737 - DNA, 373 bp, Homo sapiens
aatggatgtattataaaatataattatattatgcttaaaaatttatacaaattaatgagaaaaacaggctattgtttgtcttttcatttaataactcagttggctcagtgccctggctcacacctgcaatcccagaactttggtaggctgaggctggtggatcactggagccaagtagttcaagaccagcctgggcaacatagcatgactctttctactaaaaaacaaaaaaaattaactgggtttggtgacatgtgcttgtagtcctagcaactcaggaggactgatgggacgaatccttgagcccagaaatttgaggttacagtgagctatgatcacaccactcaagcctgggtgactgagaccatgtcac

SEQ ID NO: 27738 - DNA, 477 bp, Homo sapiens
ttgccttgcacttttatattatggagatagtttctttaaacctcatgaatcaacttctgctagcttcacacttttcttttgcagcttcctcgcctctctcatcctgtgtagaattgaagagagctagggccttgctctggagtaggctttggcttaagtgaatgttgtggctggtttgattgtctatggagaccactaaaacttaggctgggcacagtggttcacacctataatcccagcactttgggaggccgagaggggcggatcacttgaggtcaggagttcgagaccagcctggccaacatggtgaaactccatctctactaaaaatacaaaaattgagctgcaacaatagaaagatggtggagcaagaacaaagaaacaatccctttgactgggcgcggtggttcatgcctgtaatctcagcactttgggaggctgaggcgggtggatcacctgaggtcgggagttcgagag

SEQ ID NO: 27739 - DNA, 4476 bp, Homo sapiens
  misc_feature (386)..(386): n is a, c, g, or t
  misc_feature (1160)..(1160): n is a, c, g, or t
  misc_feature (1420)..(1420): n is a, c, g, or t
  misc_feature (1898)..(1898): n is a, c, g, or t
aatagcttatccactcactatgagcagattatttaacatttctgattttcaaatatctccgtctgtaaaggagactaatattagagctttgtgagagctggagatggtgtcagtaaagtaagtagcacacactggacactcagaattgttactagtattgccaaacacagcagaaaccagaacaggctgggcagagaggcctctctctggaggcaaagcctcgagcatcccaaatgccttagagctgatatcctgcctattccatgcagcccctcagccccggcccctgctttgaccgaggctgattttcatgtgcaaagccttgagttcagtctcccatgaagcaccaagtcagaaacactgtcagcctttccaagcggtagatntgtggctccagccaaaaaaaaccaggaccccctcaatctccagaagacaaaggggagccaatactaataacaccttattttcttatagtactgggtacttttagaaatattctagctgtattaatccattctcacactgctataaagaactgcctgagactgggtaatttataaagaaaagaagttcaactgactcacagttccacatggctggggaggcctcaagaaacttacagtcatggcagagggggaagcaaacacatccttcttcacaaggcggcaggagagagaagtgctgagcaaagaggaaaaagccccttataaaaccatcagatctcatgagaactcactcactatcatgagaacagcagcatgggggtaactgcccccatgattccattacctcccaccaggtctctcctatgacacctggggattacggtaactacagttcaagataagatttgggtggggacgtagccaaccgtatcactagcaacgtgggataggaagtatagctatcactccattgtttagatggggaatagggctcaaagaggttaaatcagcactgtccaatataatacaagctgcatatgtgatattattttctaaggtaaagagaaacaggtaaaattcatcttaataatgtatcttatttaaaccagtatacctcaaatattatcgttttaacatgtaaccaacactttaaaattattaatgagttctttcatactcttttcatcctaagtcttggaaatctggtgtgtatcncacactcacagcacatgtcagttcataccagtcacattttaagtgcagagtcatcacctgtggccagtggcttccttcctgggtagcacagggttaatggttaaacgctgcatctcaggtcacacagcaggttaaggaaagcagaaatgagagtgagggttccgaatttctcacgccctgttctttgcatgcatcacctgcttctcgagtgttcctgcctgcctggaggcagtatattgtggtggcgaggggtgtgaacngtggcttagattagagattcacatcccagcagtgctgctttttagccatggggccttgagcaagttccctgtctgcactccagttttacatgtgtaaaatggtgatgataatgaggcctgccacatgaggtcgaggtgaagagtaaattcattttattaataaattagctccgtacagcacccggcatattcaagccctcagtaaatattcaggggctccccttttaaaggagtcctgcctgtgctgtaaaggctcatctgctactggaaggaggagctgcttgggcagcttttgggttgactaagagcttattcgatcagcctacttcccatgagcttgcacttccagggaccaggagggggaatggaggttgctgctggaatgtttggatttgagggtttggagttttccagtgcatccagacaaggatgcagccactctgatagcttttcacacagcaaacgctggttggccccnaccaggtgccagtcttgtgcgagataccctgggggacgctgacagtcagcagcatgacgtttcctcacttagcacggtgccaggcggacttcctgttcccgtgggtactgcatgatttgtcgtctctgtgtccttgctgacgttttatcctcccctcagtgcctttccctctcccaaatttcctcttgtccaaacccacttaaatgccacctcccctgagcctcattccttgacccttgccccagccatcctccttaccccaaaagctggaaacagacacactcctttcagattcctgtaatgctgtctctacctcccggagtcccttatgcaccctctgtcttgagggggctgccccactacaccaacatctcctgaaggactctcattgacctcgagattcttccagcacctccctcacaactggcatgggatgaacaaactcattagagaatgaatgaatggagttaatcttatctcccagtttaactgaaaagacagagacagtggcttcttctgtaaacaccacagcagaacaaacgtccatgctggcctactgagtaatagttgtcaaaggagcatgttcaaaaacacagagccctaggctgcctcccgcaaggattgtttcagcaggtctgaggtggggcccagcgagctgtatattttttcatctctctaagagattctacaacacagacaggcttggagagacccccaacttggaccatttaactagtgagaggactaacatgtacatatttatgatgcagctacagggcccatgtggacaaagtactgtgatttcatttcacaagtactcttaggtgttaattgtgtaaaggaacttcgggtcccatttggttaaaatgtagctcttatgaaaggaagttgtaggaaagaaagggggatgcctggaagggccttggattccctggaagacacttggactgtgttcagggagcagcatggaacaccgccgctgggggaatggcattatcgggccacatgagagcatgtggccaggacatctgcaccttcacaccatgttcttcttctctgacaggtctcccgtgatggccggtggactgttcgccgtggatcggaagtggttctgggaactcggcgggtatgacccaggcttggagatctggggaggggagcagtatgaaatctccttcaaggtgagccagctctccagacgccccgttcttggcacagcctcctgagtgcctgtcccagtaggtgtctcagcttctgcctgagcttggaaagactggaggcctcagggttctgtagcccttctgcccatcaggtgaagaagacaggggctcatgggccactctttgttgtggggtgggggggtgtgggagggaaggggagtactctccagctgccaaaggctggtcctcaccacagctctgactggcatttgccttgtgtcttcttaagatgttggaataaggtcttgcttctactcagatggcaggtctgagattgagatgtccagcaaataagcagtgggccagagaagctaggaaggccaaacaggatacgtaggcctagaggagtcctctcagtcaccccaagttttccctttgtacctgttgctctaggagtttgacaaagaccagtgagcataagctccagttgtaaagttacaaaggcctggattcagatcccagctccatcatcaggagctatctgactttgggcaagttagatcacccccccgagctttctttcctcatctgaaataagggaataataatactacctagcttacagagctatcgtgaagattaaatgagatcatgtctagaaagtgcttagcatacaacctgggaacatgaccagcaattaataattggtagaaattgttaaagtttcggtgagtaaatatttactgtaacctacttgaccagcctatggactctggaagctttctgacagtagtggtaaaggagttactagttaactaataactaattaagcacccaaacttccaaggctacattctccactttatttgtgggagtctgtcttgttctcaagtgaaagcttggaccttctgaggggagggttagcttgtcccatgcccttgtggcctgtcagagtcagcttctaacagcttagacccctggctaaggcatatccccagcccacaagggacagatagcaccattactgatctgacccctgtgaacacacaactctgatgccccctcatcgggcctcaactttcagtgcaaaggaccattgtcaggcacagtgaattaaggctttggtattggtgccagagtgccacgatcagatcctagctctgccgtgtcctgccagctgtgtgatcttgggcaaggaatcctcacctcactgagccttggtttctacttccataaagtgggtttaatgaaacgttaatcctcacagagttgttgagaggattaagtgagaccatgcttattaggtgcttcttaataaattatcctaaagattattatcaatacattaatattattatctgcaacagtggttgagtagttcagaactggagaacataaattcttgattagccaaaaaa

SEQ ID NO: 27740 - DNA, 743 bp, Homo sapiens
agcgggttggagcggggccggcgccgcagccgcttctgctggctgagctgctgccgccgccgggcggacgggcggacgcgcggagctgggggcggcgcggcggggccggcggggctgcggcggggctgaccggccccgatgaggcggaaggagaagcggctcctgcaggcggtggcgctggtgctggcggccctggtcctcctgcccaacgtggggctttgggcgctgtaccgcgagcggcagcccgacggcacccctgggggatcgggggcggcggtggcgccggcggcgggacagggctcacacagtcgacaaaagaaaacgtttttcttgggagatgggcagaagctgaaggactggcatgacaaggaggccatccggagggacgctcagcgcgtaggaaatggagaacaaggaagacctaaccccatgaccgatgctgagagagtggatcaggcataccgagaaaatggatttaacatctacgtcagtgataaaatctccttgaatcgctctctcccagatatccggcacccaaactgcaacagcaagcgctacctggagacacttcccaacacaagcatcatcatccccttccacaacgagggctggtcctccctcctccgcaccgtccacagtgtgctcaatcgctcgcctccagagctggtcgccgagattgtactggtcgacgacttcagtgatcgagatctgccgactgcatcaactccctctccctttgtgtg

SEQ ID NO: 27741 - DNA, 5776 bp, Homo sapiens
agcgggttggagcggggccggcgccgcagccgcttctgctggctgagctgctgccgccgccgggcggacgggcggacgcgcggagctgggggcggcgcggcggggccggcggggctgcggcggggctgaccggccccgatgaggcggaaggagaagcggctcctgcaggcggtggcgctggtgctggcggccctggtcctcctgcccaacgtggggctttgggcgctgtaccgcgagcggcagcccgacggcacccctgggggatcgggggcggcggtggcgccggcggcgggacagggctcacacagtcgacaaaagaaaacgtttttcttgggagatgggcagaagctgaaggactggcatgacaaggaggccatccggagggacgctcagcgcgtaggaaatggagaacaaggaagacctaaccccatgaccgatgctgagagagtggatcaggcataccgagaaaatggatttaacatctacgtcagtgataaaatctccttgaatcgctctctcccagatatccggcacccaaactgcaacagcaagcgctacctggagacacttcccaacacaagcatcatcatccccttccacaacgagggctggtcctccctcctccgcaccgtccacagtgtgctcaatcgctcgcctccagagctggtcgccgagattgtactggtcgacgacttcagtgatcgagaccgcattgctcggaaccgcaagaccattgtgtgcccgatgattgatgtaattgaccatgacgactttcggtacgagacacaggcaggggatgccatgcggggagcctttgactgggagatgtactacaagcggatcccgatccctccagaactgcagaaagctgaccccagcgacccatttgagtctcccgtgatggccggtggactgttcgccgtggatcggaagtggttctgggaactcggcgggtatgacccaggcttggagatctggggaggggagcagtatgaaatctccttcaaggtgtggatgtgtgggggccgcatggaggacatcccctgctccagggtgggccatatctacaggaagtatgtgccctacaaggtcccggccggagtcagcctggcccggaaccttaagcgggtggccgaagtgtggatggatgagtacgcagagtacatttaccagcgccggcctgaataccgccacctctccgctggggatgtcgcagtccagaaaaagctccgcagctcccttaactgcaagagtttcaagtggtttatgacgaagatagcctgggacctgcccaaattctacccacccgtggagcccccggctgcagcttggggggagatccgaaatgtgggcacagggctgtgtgcagacacaaagcacggggccttgggctccccactaaggctagagggctgcgtccgaggccgtggggaggctgcctggaacaacatgcaggtattcaccttcacctggagagaggacatccggcctggagacccccagcacaccaagaagttctgctttgatgccatttcccacaccagccctgtcacgctgtacgactgccacagcatgaagggcaaccagctgtggaaataccgcaaagacaagaccctgtaccaccctgtcagtggcagctgcatggactgcagtgaaagtgaccataggatcttcatgaacacctgcaacccatcctctctcacccagcagtggctgtttgaacacaccaactcaacagtcttggaaaaattcaataggaactgagccctcatgtccccttggcaggccccccagggtctggcactcactgcagacttcctctttcaagggaggcagggcccctgtgggcactaggtgtaaaaggtgctggccaaatggttcagggtgaagagggctcttgattcaggggctggggtctgcctggtccttgagcccctgagttgtgggggtagggtgaagagcatatcccacaagaggccccacagggagcagagactgctttaatccctgctgacatcacggaaaagcaacagagccttttcaactttgtcactatgtccccttgaacattatgtgggagaacaccaaggtagcctaggccacccaaaagtgagtcctgcgaggttgcccagccctcagatggctctcctacatgatggtgctttagaaacaaaggtaaaatttgcctgtttggggcagcttttagtatcgatgccactcatctgcagcagaagagaaagaagtcctcttggggctttttagtttctgccgtcctggggggaacattgcagttactgcacagcttctgttctctgtcacaaccccaggtgatttggtccggtcaaaggccatacttggggccctaagagtgttcagtattgaatgctgatcagctgccaggtgaggagtcagaagagggagcccccctagacatttctttgcagctatggacatgcgggatatctccccctgctctctgggtatttgaaatgtcaattttagcactctccaggcacaaggacagcccagcaccagctttacagggcagtgtttcagatggccctgagcccacggaaaaggccaggtagacctccaaactagaaatgctggctgatttgccctgatccatgcttccatttccctgtctctcttccccaggcaattactggcctcaaaagaggaacagaggtgctgcgaggtgctcacctcacagagtctggaggcctccaggatcaactgtgggcaaagtgcctgcctctgacctcatcatggttctagttctcatacagaactccagaatttttaaagaactctataattggattgcaaactaggatgctacataggattctggtattccacatccaatatggatttctagaatgctgtgattaaaggagccagccaggtgtaatacagtcaaggcagcccccagcctagagacaatctgtgaaatccaaagttggtggtgttgggaaagcagggggacatgtgtccctcagctcagcagaggctgtggtacaacatggtccttggtgaagacctgcacccctggaacctcccaccatcatcacaactgtagtctcatttgcagtggagaaaagaacccgacgtcccacagccagatatacacccagctccatgccagcccttcatgtttaccttttgctttgttaattacatgtcagactcctagagggcctccagactaataggaagcatttctgtaaccaacctgccacccactgattcagaaatggaaatcacattccacaatctatggcttccaccagctagcccaggaaatacttgaaatcagcattccaattagtgttgagtctcttgattgtgtcatttaccaattaaataactgagacctaagtctgggaacagagccacgaatctgcctttgagatgctggcagatctcaaggccatcaattattgggggagggagggacaaacactcccaatcatccaccagtcagactgaatgtgtagctggcgaggaattacttccacttctggcccagcacaagccctgctttggccacctgtctgcaagagaggcggcccctgtgcttgcaacgcttacgtgttgatcccagtgtccttttccaaatgagtgctgtagctttagaagtggccctctatagaaagaagtcaaaagatgaggccccttctagaatctaggataacaagagtgttgacagtttgaggagtcgaattgagattcatcatcaaagagcaatgcagcgtcgttaaaataaaaactgtgccttttaaaaagaaaaatgcaaatatagagcaaatccctaaacttgaaccatttcctagtgccttgctagacaaacataaaggggcagggttgtggggaggggaacgtttttggtggtgtgtgcagttcctactggatgagtgtgtgtttcttaatgtctcatttcaagcaggagatgttgggtctggagcaagatctgagactgagatgtcccccaagggtgacaggtcagatttatttcagtcagtgcaagtcacactccaaactaaaggctgggcagtgcgtttagtctgtggcctagaagacctcatcagcccccgagaggaggccttgcattacctcactgggacctgtttgggggccatccctgcggtccaccctctgaacccccagcatgtttgtcctgtttctcaccattgggttaaggggtgccgagcactagctagacttccacatagtcccaccccaagtgggcggcagtgttcctggcatgaccaggattcctgtgaaagcaggagcagcagcaagccgtcccgggcctgcctttcccatcctttggttctcctttccagtctgggttcacaccctgaaaagggatgggtgtgtcctctgagcactctggcatttgtcattgctgagcccatatcagtaggtcctgggacttgacaaagtatgtgggaggggaaggaaggacagaacttgactggctccatttcatggaccaactgatcaattgccagtactaagccactcattgttatggcttcctttttgaaaaccacctgtctcaaggattcaggtttctgctcacatccccagctgatgctcaataaaactcagccaggagcatatggagatgctgacagccaggtaatgggtgagactgtggggtcccttttcctctaaagcctttactctgaggataaggtcacaaagtagggtgtgacttgaaagtatcgtgaccatgtggcccaccagcagcctttccaaaggggaactccagagacatttcataatgcaaacagcactgttgctttaagaacaaggcctttggaggtggctaaacttgcacgcacgtgtgtgaaaagccatcccatcttctgcctccagttggagctttcagctgttaaaacagtcagaaactattgattcttccctttaggaaaaaatgctcaggcagaacggggtacatccacaggaggaatcggacgagaggatgtgacattcggtccaggagagaaagagcagtttctgttaaagatgtaacaaatggatttccaaagtctacatgacattcacttttcaaacttcccaccagttgaatttctttttttccttaagaaacaggtgatgtcttggaaaacagctccttatgtctctctgtgcatctccattttcctagtctctggagtctcaaaaagagtggcaaagcactttacagtagtaactgaggaatcagagtctctgcttcagcgatatctagtttgtacagttgggtgatcttttgtaattcctaggaggtaatgcatttttaatgttttctgaagctttgtaagtgtgagagagggacaagaagtgcagttctgttctggaattccttattgctttcaacggacactctttgtgaaaaatccaagtaatattttagttcaaacttgatcttgagccaaggcccactgccacctctgggatgggagtcggacctacataccaagtgacaagttcaccttaacatctgcttccagaatggctttgattcagccgtgccaggcaacagaacagggtcagactcctgctctgttattggcttgaagactaggatcccaaaggggttggaggcagggaatatttgaaaattcagactggaattccaggccaaaagctcaagaccaccagcctctcctcctgcctggaaaaataagcctttgtgaaagactgatttaccatgtacaattgtgattgtgaacgttgttgagtaaacctccagactttctctaaa

SEQ ID NO: 27742 - DNA, 5404 bp, Homo sapiens
gactgcatcaacgccgctgactgcatcacgccgcgtgtgactgcatccaacgccgcctccctcctccgcaccgtccacagtgtgctcaatcgctcgcctccagagctggtcgccgagattgtactggtcgacgacttcagtgatcgagagcacctgaagaagcctcttgaagactacatggcccttttccccagtgtgaggattcttcgaaccaagaaacgggaagggctgataaggacccgaatgctgggggcctcagtggcaactggggatgtcatcacattcttggattcacactgtgaagccaatgtcaactggcttccccccttgcttgaccgcattgctcggaaccgcaagaccattgtgtgcccgatgattgatgtaattgaccatgacgactttcggtacgagacacaggcaggggatgccatgcggggagcctttgactgggagatgtactacaagcggatcccgatccctccagaactgcagaaagctgaccccagcgacccatttgagtctcccgtgatggccggtggactgttcgccgtggatcggaagtggttctgggaactcggcgggtatgacccaggcttggagatctggggaggggagcagtatgaaatctccttcaaggtgtggatgtgtgggggccgcatggaggacatcccctgctccagggtgggccatatctacaggaagtatgtgccctacaaggtcccggccggagtcagcctggcccggaaccttaagcgggtggccgaagtgtggatggatgagtacgcagagtacatttaccagcgccggcctgaataccgccacctctccgctggggatgtcgcagtccagaaaaagctccgcagctcccttaactgcaagagtttcaagtggtttatgacgaagatagcctgggacctgcccaaattctacccacccgtggagcccccggctgcagcttggggggagatccgaaatgtgggcacagggctgtgtgcagacacaaagcacggggccttgggctccccactaaggctagagggctgcgtccgaggccgtggggaggctgcctggaacaacatgcaggtattcaccttcacctggagagaggacatccggcctggagacccccagcacaccaagaagttctgctttgatgccatttcccacaccagccctgtcacgctgtacgactgccacagcatgaagggcaaccagctgtggaaataccgcaaagacaagaccctgtaccaccctgtcagtggcagctgcatggactgcagtgaaagtgaccataggatcttcatgaacacctgcaacccatcctctctcacccagcagtggctgtttgaacacaccaactcaacagtcttggaaaaattcaataggaactgagccctcatgtccccttggcaggccccccagggtctggcactcactgcagacttcctctttcaagggaggcagggcccctgtgggcactaggtgtaaaaggtgctggccaaatggttcagggtgaagagggctcttgattcaggggctggggtctgcctggtccttgagcccctgagttgtgggggtagggtgaagagcatatcccacaagaggccccacagggagcagagactgctttaatccctgctgacatcacggaaaagcaacagagccttttcaactttgtcactatgtccccttgaacattatgtgggagaacaccaaggtagcctaggccacccaaaagtgagtcctgcgaggttgcccagccctcagatggctctcctacatgatggtgctttagaaacaaaggtaaaatttgcctgtttggggcagcttttagtatcgatgccactcatctgcagcagaagagaaagaagtcctcttggggctttttagtttctgccgtcctggggggaacattgcagttactgcacagcttctgttctctgtcacaaccccaggtgatttggtccggtcaaaggccatacttggggccctaagagtgttcagtattgaatgctgatcagctgccaggtgaggagtcagaagagggagcccccctagacatttctttgcagctatggacatgcgggatatctccccctgctctctgggtatttgaaatgtcaattttagcactctccaggcacaaggacagcccagcaccagctttacagggcagtgtttcagatggccctgagcccacggaaaaggccaggtagacctccaaactagaaatgctggctgatttgccctgatccatgcttccatttccctgtctctcttccccaggcaattactggcctcaaaagaggaacagaggtgctgcgaggtgctcacctcacagagtctggaggcctccaggatcaactgtgggcaaagtgcctgcctctgacctcatcatggttctagttctcatacagaactccagaatttttaaagaactctataattggattgcaaactaggatgctacataggattctggtattccacatccaatatggatttctagaatgctgtgattaaaggagccagccaggtgtaatacagtcaaggcagcccccagcctagagacaatctgtgaaatccaaagttggtggtgttgggaaagcagggggacatgtgtccctcagctcagcagaggctgtggtacaacatggtccttggtgaagacctgcacccctggaacctcccaccatcatcacaactgtagtctcatttgcagtggagaaaagaacccgacgtcccacagccagatatacacccagctccatgccagcccttcatgtttaccttttgctttgttaattacatgtcagactcctagagggcctccagactaataggaagcatttctgtaaccaacctgccacccactgattcagaaatggaaatcacattccacaatctatggcttccaccagctagcccaggaaatacttgaaatcagcattccaattagtgttgagtctcttgattgtgtcatttaccaattaaataactgagacctaagtctgggaacagagccacgaatctgcctttgagatgctggcagatctcaaggccatcaattattgggggagggagggacaaacactcccaatcatccaccagtcagactgaatgtgtagctggcgaggaattacttccacttctggcccagcacaagccctgctttggccacctgtctgcaagagaggcggcccctgtgcttgcaacgcttacgtgttgatcccagtgtccttttccaaatgagtgctgtagctttagaagtggccctctatagaaagaagtcaaaagatgaggccccttctagaatctaggataacaagagtgttgacagtttgaggagtcgaattgagattcatcatcaaagagcaatgcagcgtcgttaaaataaaaactgtgccttttaaaaagaaaaatgcaaatatagagcaaatccctaaacttgaaccatttcctagtgccttgctagacaaacataaaggggcagggttgtggggaggggaacgtttttggtggtgtgtgcagttcctactggatgagtgtgtgtttcttaatgtctcatttcaagcaggagatgttgggtctggagcaagatctgagactgagatgtcccccaagggtgacaggtcagatttatttcagtcagtgcaagtcacactccaaactaaaggctgggcagtgcgtttagtctgtggcctagaagacctcatcagcccccgagaggaggccttgcattacctcactgggacctgtttgggggccatccctgcggtccaccctctgaacccccagcatgtttgtcctgtttctcaccattgggttaaggggtgccgagcactagctagacttccacatagtcccaccccaagtgggcggcagtgttcctggcatgaccaggattcctgtgaaagcaggagcagcagcaagccgtcccgggcctgcctttcccatcctttggttctcctttccagtctgggttcacaccctgaaaagggatgggtgtgtcctctgagcactctggcatttgtcattgctgagcccatatcagtaggtcctgggacttgacaaagtatgtgggaggggaaggaaggacagaacttgactggctccatttcatggaccaactgatcaattgccagtactaagccactcattgttatggcttcctttttgaaaaccacctgtctcaaggattcaggtttctgctcacatccccagctgatgctcaataaaactcagccaggagcatatggagatgctgacagccaggtaatgggtgagactgtggggtcccttttcctctaaagcctttactctgaggataaggtcacaaagtagggtgtgacttgaaagtatcgtgaccatgtggcccaccagcagcctttccaaaggggaactccagagacatttcataatgcaaacagcactgttgctttaagaacaaggcctttggaggtggctaaacttgcacgcacgtgtgtgaaaagccatcccatcttctgcctccagttggagctttcagctgttaaaacagtcagaaactattgattcttccctttaggaaaaaatgctcaggcagaacggggtacatccacaggaggaatcggacgagaggatgtgacattcggtccaggagagaaagagcagtttctgttaaagatgtaacaaatggatttccaaagtctacatgacattcacttttcaaacttcccaccagttgaatttctttttttccttaagaaacaggtgatgtcttggaaaacagctccttatgtctctctgtgcatctccattttcctagtctctggagtctcaaaaagagtggcaaagcactttacagtagtaactgaggaatcagagtctctgcttcagcgatatctagtttgtacagttgggtgatcttttgtaattcctaggaggtaatgcatttttaatgttttctgaagctttgtaagtgtgagagagggacaagaagtgcagttctgttctggaattccttattgctttcaacggacactctttgtgaaaaatccaagtaatattttagttcaaacttgatcttgagccaaggcccactgccacctctgggatgggagtcggacctacataccaagtgacaagttcaccttaacatctgcttccagaatggctttgattcagccgtgccaggcaacagaacagggtcagactcctgctctgttattggcttgaagactaggatcccaaaggggttggaggcagggaatatttgaaaattcagactggaattccaggccaaaagctcaagaccaccagcctctcctcctgcctggaaaaataagcctttgtgaaagactgatttaccatgtacaattgtgattgtgaacgttgttgagtaaacctccagactttctctaaa

SEQ ID NO: 27743 - DNA, 4605 bp, Homo sapiens
ttgagaggctcaaggtacttccaacagcccagggcaagctttatcaagacgatttgaaggttaatccagctaatgtctcccacttggtttcccctttcacctggcagggacccggtgggcaccttaaggcacctcagtggtccacttcttccctctttccctttcagatccgaaatgtgggcacagggctgtgtgcagacacaaagcacggggccttgggctccccactaaggctagagggctgcgtccgaggccgtggggaggctgcctggaacaacatgcaggtattcaccttcacctggagagaggacatccggcctggagacccccagcacaccaagaagttctgctttgatgccatttcccacaccagccctgtcacgctgtacgactgccacagcatgaagggcaaccagctgtggaaataccgcaaagacaagaccctgtaccaccctgtcagtggcagctgcatggactgcagtgaaagtgaccataggatcttcatgaacacctgcaacccatcctctctcacccagcagtggctgtttgaacacaccaactcaacagtcttggaaaaattcaataggaactgagccctcatgtccccttggcaggccccccagggtctggcactcactgcagacttcctctttcaagggaggcagggcccctgtgggcactaggtgtaaaaggtgctggccaaatggttcagggtgaagagggctcttgattcaggggctggggtctgcctggtccttgagcccctgagttgtgggggtagggtgaagagcatatcccacaagaggccccacagggagcagagactgctttaatccctgctgacatcacggaaaagcaacagagccttttcaactttgtcactatgtccccttgaacattatgtgggagaacaccaaggtagcctaggccacccaaaagtgagtcctgcgaggttgcccagccctcagatggctctcctacatgatggtgctttagaaacaaaggtaaaatttgcctgtttggggcagcttttagtatcgatgccactcatctgcagcagaagagaaagaagtcctcttggggctttttagtttctgccgtcctggggggaacattgcagttactgcacagcttctgttctctgtcacaaccccaggtgatttggtccggtcaaaggccatacttggggccctaagagtgttcagtattgaatgctgatcagctgccaggtgaggagtcagaagagggagcccccctagacatttctttgcagctatggacatgcgggatatctccccctgctctctgggtatttgaaatgtcaattttagcactctccaggcacaaggacagcccagcaccagctttacagggcagtgtttcagatggccctgagcccacggaaaaggccaggtagacctccaaactagaaatgctggctgatttgccctgatccatgcttccatttccctgtctctcttccccaggcaattactggcctcaaaagaggaacagaggtgctgcgaggtgctcacctcacagagtctggaggcctccaggatcaactgtgggcaaagtgcctgcctctgacctcatcatggttctagttctcatacagaactccagaatttttaaagaactctataattggattgcaaactaggatgctacataggattctggtattccacatccaatatggatttctagaatgctgtgattaaaggagccagccaggtgtaatacagtcaaggcagcccccagcctagagacaatctgtgaaatccaaagttggtggtgttgggaaagcagggggacatgtgtccctcagctcagcagaggctgtggtacaacatggtccttggtgaagacctgcacccctggaacctcccaccatcatcacaactgtagtctcatttgcagtggagaaaagaacccgacgtcccacagccagatatacacccagctccatgccagcccttcatgtttaccttttgctttgttaattacatgtcagactcctagagggcctccagactaataggaagcatttctgtaaccaacctgccacccactgattcagaaatggaaatcacattccacaatctatggcttccaccagctagcccaggaaatacttgaaatcagcattccaattagtgttgagtctcttgattgtgtcatttaccaattaaataactgagacctaagtctgggaacagagccacgaatctgcctttgagatgctggcagatctcaaggccatcaattattgggggagggagggacaaacactcccaatcatccaccagtcagactgaatgtgtagctggcgaggaattacttccacttctggcccagcacaagccctgctttggccacctgtctgcaagagaggcggcccctgtgcttgcaacgcttacgtgttgatcccagtgtccttttccaaatgagtgctgtagctttagaagtggccctctatagaaagaagtcaaaagatgaggccccttctagaatctaggataacaagagtgttgacagtttgaggagtcgaattgagattcatcatcaaagagcaatgcagcgtcgttaaaataaaaactgtgccttttaaaaagaaaaatgcaaatatagagcaaatccctaaacttgaaccatttcctagtgccttgctagacaaacataaaggggcagggttgtggggaggggaacgtttttggtggtgtgtgcagttcctactggatgagtgtgtgtttcttaatgtctcatttcaagcaggagatgttgggtctggagcaagatctgagactgagatgtcccccaagggtgacaggtcagatttatttcagtcagtgcaagtcacactccaaactaaaggctgggcagtgcgtttagtctgtggcctagaagacctcatcagcccccgagaggaggccttgcattacctcactgggacctgtttgggggccatccctgcggtccaccctctgaacccccagcatgtttgtcctgtttctcaccattgggttaaggggtgccgagcactagctagacttccacatagtcccaccccaagtgggcggcagtgttcctggcatgaccaggattcctgtgaaagcaggagcagcagcaagccgtcccgggcctgcctttcccatcctttggttctcctttccagtctgggttcacaccctgaaaagggatgggtgtgtcctctgagcactctggcatttgtcattgctgagcccatatcagtaggtcctgggacttgacaaagtatgtgggaggggaaggaaggacagaacttgactggctccatttcatggaccaactgatcaattgccagtactaagccactcattgttatggcttcctttttgaaaaccacctgtctcaaggattcaggtttctgctcacatccccagctgatgctcaataaaactcagccaggagcatatggagatgctgacagccaggtaatgggtgagactgtggggtcccttttcctctaaagcctttactctgaggataaggtcacaaagtagggtgtgacttgaaagtatcgtgaccatgtggcccaccagcagcctttccaaaggggaactccagagacatttcataatgcaaacagcactgttgctttaagaacaaggcctttggaggtggctaaacttgcacgcacgtgtgtgaaaagccatcccatcttctgcctccagttggagctttcagctgttaaaacagtcagaaactattgattcttccctttaggaaaaaatgctcaggcagaacggggtacatccacaggaggaatcggacgagaggatgtgacattcggtccaggagagaaagagcagtttctgttaaagatgtaacaaatggatttccaaagtctacatgacattcacttttcaaacttcccaccagttgaatttctttttttccttaagaaacaggtgatgtcttggaaaacagctccttatgtctctctgtgcatctccattttcctagtctctggagtctcaaaaagagtggcaaagcactttacagtagtaactgaggaatcagagtctctgcttcagcgatatctagtttgtacagttgggtgatcttttgtaattcctaggaggtaatgcatttttaatgttttctgaagctttgtaagtgtgagagagggacaagaagtgcagttctgttctggaattccttattgctttcaacggacactctttgtgaaaaatccaagtaatattttagttcaaacttgatcttgagccaaggcccactgccacctctgggatgggagtcggacctacataccaagtgacaagttcaccttaacatctgcttccagaatggctttgattcagccgtgccaggcaacagaacagggtcagactcctgctctgttattggcttgaagactaggatcccaaaggggttggaggcagggaatatttgaaaattcagactggaattccaggccaaaagctcaagaccaccagcctctcctcctgcctggaaaaataagcctttgtgaaagactgatttaccatgtacaattgtgattgtgaacgttgttgagtaaacctccagactttctctaaa

SEQ ID NO: 27744 - DNA, 5514 bp, Homo sapiens
  misc_feature (24)..(24): n is a, c, g, or t
gcgccgacttagaggatcccccanacctaaccccatgaccgatgctgagagagtggatcaggcataccgagaaaatggatttaacatctacgtcagtgataaaatctccttgaatcgctctctcccagatatccggcacccaaactgcaacagcaagcgctacctggagacacttcccaacacaagcatcatcatccccttccacaacgagggctggtcctccctcctccgcaccgtccacagtgtgctcaatcgctcgcctccagagctggtcgccgagattgtactggtcgacgacttcagtgatcgagagcacctgaagaagcctcttgaagactacatggcccttttccccagtgtgaggattcttcgaaccaagaaacgggaagggctgataaggacccgaatgctgggggcctcagtggcaactggggatgtcatcacattcttggattcacactgtgaagccaatgtcaactggcttccccccttgcttgaccgcattgctcggaaccgcaagaccattgtgtgcccgatgattgatgtaattgaccatgacgactttcggtacgagacacaggcaggggatgccatgcggggagcctttgactgggagatgtactacaagcggatcccgatccctccagaactgcagaaagctgaccccagcgacccatttgagtctcccgtgatggccggtggactgttcgccgtggatcggaagtggttctgggaactcggcgggtatgacccaggcttggagatctggggaggggagcagtatgaaatctccttcaaggtgtggatgtgtgggggccgcatggaggacatcccctgctccagggtgggccatatctacaggaagtatgtgccctacaaggtcccggccggagtcagcctggcccggaaccttaagcgggtggccgaagtgtggatggatgagtacgcagagtacatttaccagcgccggcctgaataccgccacctctccgctggggatgtcgcagtccagaaaaagctccgcagctcccttaactgcaagagtttcaagtggtttatgacgaagatagcctgggacctgcccaaattctacccacccgtggagcccccggctgcagcttggggggagatccgaaatgtgggcacagggctgtgtgcagacacaaagcacggggccttgggctccccactaaggctagagggctgcgtccgaggccgtggggaggctgcctggaacaacatgcaggtattcaccttcacctggagagaggacatccggcctggagacccccagcacaccaagaagttctgctttgatgccatttcccacaccagccctgtcacgctgtacgactgccacagcatgaagggcaaccagctgtggaaataccgcaaagacaagaccctgtaccaccctgtcagtggcagctgcatggactgcagtgaaagtgaccataggatcttcatgaacacctgcaacccatcctctctcacccagcagtggctgtttgaacacaccaactcaacagtcttggaaaaattcaataggaactgagccctcatgtccccttggcaggccccccagggtctggcactcactgcagacttcctctttcaagggaggcagggcccctgtgggcactaggtgtaaaaggtgctggccaaatggttcagggtgaagagggctcttgattcaggggctggggtctgcctggtccttgagcccctgagttgtgggggtagggtgaagagcatatcccacaagaggccccacagggagcagagactgctttaatccctgctgacatcacggaaaagcaacagagccttttcaactttgtcactatgtccccttgaacattatgtgggagaacaccaaggtagcctaggccacccaaaagtgagtcctgcgaggttgcccagccctcagatggctctcctacatgatggtgctttagaaacaaaggtaaaatttgcctgtttggggcagcttttagtatcgatgccactcatctgcagcagaagagaaagaagtcctcttggggctttttagtttctgccgtcctggggggaacattgcagttactgcacagcttctgttctctgtcacaaccccaggtgatttggtccggtcaaaggccatacttggggccctaagagtgttcagtattgaatgctgatcagctgccaggtgaggagtcagaagagggagcccccctagacatttctttgcagctatggacatgcgggatatctccccctgctctctgggtatttgaaatgtcaattttagcactctccaggcacaaggacagcccagcaccagctttacagggcagtgtttcagatggccctgagcccacggaaaaggccaggtagacctccaaactagaaatgctggctgatttgccctgatccatgcttccatttccctgtctctcttccccaggcaattactggcctcaaaagaggaacagaggtgctgcgaggtgctcacctcacagagtctggaggcctccaggatcaactgtgggcaaagtgcctgcctctgacctcatcatggttctagttctcatacagaactccagaatttttaaagaactctataattggattgcaaactaggatgctacataggattctggtattccacatccaatatggatttctagaatgctgtgattaaaggagccagccaggtgtaatacagtcaaggcagcccccagcctagagacaatctgtgaaatccaaagttggtggtgttgggaaagcagggggacatgtgtccctcagctcagcagaggctgtggtacaacatggtccttggtgaagacctgcacccctggaacctcccaccatcatcacaactgtagtctcatttgcagtggagaaaagaacccgacgtcccacagccagatatacacccagctccatgccagcccttcatgtttaccttttgctttgttaattacatgtcagactcctagagggcctccagactaataggaagcatttctgtaaccaacctgccacccactgattcagaaatggaaatcacattccacaatctatggcttccaccagctagcccaggaaatacttgaaatcagcattccaattagtgttgagtctcttgattgtgtcatttaccaattaaataactgagacctaagtctgggaacagagccacgaatctgcctttgagatgctggcagatctcaaggccatcaattattgggggagggagggacaaacactcccaatcatccaccagtcagactgaatgtgtagctggcgaggaattacttccacttctggcccagcacaagccctgctttggccacctgtctgcaagagaggcggcccctgtgcttgcaacgcttacgtgttgatcccagtgtccttttccaaatgagtgctgtagctttagaagtggccctctatagaaagaagtcaaaagatgaggccccttctagaatctaggataacaagagtgttgacagtttgaggagtcgaattgagattcatcatcaaagagcaatgcagcgtcgttaaaataaaaactgtgccttttaaaaagaaaaatgcaaatatagagcaaatccctaaacttgaaccatttcctagtgccttgctagacaaacataaaggggcagggttgtggggaggggaacgtttttggtggtgtgtgcagttcctactggatgagtgtgtgtttcttaatgtctcatttcaagcaggagatgttgggtctggagcaagatctgagactgagatgtcccccaagggtgacaggtcagatttatttcagtcagtgcaagtcacactccaaactaaaggctgggcagtgcgtttagtctgtggcctagaagacctcatcagcccccgagaggaggccttgcattacctcactgggacctgtttctcaccattgggttaaggggtgccgagcactagctagacttccacatagtcccaccccaagtgggcggcagtgttcctggcatgaccaggattcctgtgaaagcaggagcagcagcaagccgtcccgggcctgcctttcccatcctttggttctcctttccagtctgggttcacaccctgaaaagggatgggtgtgtcctctgagcactctggcatttgtcattgctgagcccatatcagtaggtcctgggacttgacaaagtatgtgggaggggaaggaaggacagaacttgactggctccatttcatggaccaactgatcaattgccagtactaagccactcattgttatggcttcctttttgaaaaccacctgtctcaaggattcaggtttctgctcacatccccagctgatgctcaataaaactcagccaggagcatatggagatgctgacagccaggtaatgggtgagactgtggggtcccttttcctctaaagcctttactctgaggataaggtcacaaagtagggtgtgacttgaaagtatcgtgaccatgtggcccaccagcagcctttccaaaggggaactccagagacatttcataatgcaaacagcactgttgctttaagaacaaggcctttggaggtggctaaacttgcacgcacgtgtgtgaaaagccatcccatcttctgcctccagttggagctttcagctgttaaaacagtcagaaactattgattcttccctttaggaaaaaatgctcaggcagaacggggtacatccacaggaggaatcggacgagaggatgtgacattcggtccaggagagaaagagcagtttctgttaaagatgtaacaaatggatttccaaagtctacatgacattcacttttcaaacttcccaccagttgaatttctttttttccttaagaaacaggtgatgtcttggaaaacagctccttatgtctctctgtgcatctccattttcctagtctctggagtctcaaaaagagtggcaaagcactttacagtagtaactgaggaatcagagtctctgcttcagcgatatctagtttgtacagttgggtgatcttttgtaattcctaggaggtaatgcatttttaatgttttctgaagctttgtaagtgtgagagagggacaagaagtgcagttctgttctggaattccttattgctttcaacggacactctttgtgaaaaatccaagtaatattttagttcaaacttgatcttgagccaaggcccactgccacctctgggatgggagtcggacctacataccaagtgacaagttcaccttaacatctgcttccagaatggctttgattcagccgtgccaggcaacagaacagggtcagactcctgctctgttattggcttgaagactaggatcccaaaggggttggaggcagggaatatttgaaaattcagactggaattccaggccaaaagctcaagaccaccagcctctcctcctgcctggaaaaataagcctttgtgaaagactgatttaccatgtacaattgtgattgtgaacgttgttgagtaaacctccagactttctctaaa

SEQ ID NO: 27745 - DNA, 761 bp, Homo sapiens
ttggaggcaggaatatttgaaaattcagactggaattccaggccaaaagctcaagaccaccagcctctcctcctgcctggaaaaataagcctttgtgaaagactgatttaccatgtcttggaaaacagctccttatgtctctctgtgcatctccattttcctagtctctggagtctcaaaaagagtggcaaagcactttacagtagtaactgaggaatcagagtctctgcttcagcgatatctagtttgtacagttgggtgatcttttgtaattcctaggaggtaatgcatttttaatgttttctgaagctttgtaagtgtgagagagggacaagaagtgcagttctgttctggaattccttattgctttcaacggacactctttgtgaaaaatccaagtaatattttagttcaaacttgatcttgagccaaggcccactgccacctctgggatgggagtcggacctacataccaagtgacaagttcaccttaacatctgcttccagaatggctttgattcagccgtgccaggcaacagaacagggtcagactcctgctctgttattggcttgaagactaggatcccaaaggggttggaggcagggaatatttgaaaattcagactggaattccaggccaaaagctcaagaccaccagcctctcctcctgcctggaaaaataagcctttgtgaaagactgatttaccatgtacaattgtgattgtgaacgttgttgagtaaacctccagactttctctaaa

SEQ ID NO: 27746 - DNA, 3575 bp, Homo sapiens
  misc_feature (24)..(24): n is a, c, g, or t
gcgccgacttagaggatcccccanacctaaccccatgaccgatgctgagagagtggatcaggcataccgagaaaatggatttaacatctacgtcagtgataaaatctccttgaatcgctctctcccagatatccggcacccaaactgcaacagcaagcgctacctggagacacttcccaacacaagcatcatcatccccttccacaacgagggctggtcctccctcctccgcaccgtccacagtgtgctcaatcgctcgcctccagagctggtcgccgagattgtactggtcgacgacttcagtgatcgagagcacctgaagaagcctcttgaagactacatggcccttttccccagtgtgaggattcttcgaaccaagaaacgggaagggctgataaggacccgaatgctgggggcctcagtggcaactggggatgtcatcacattcttggattcacactgtgaagccaatgtcaactggcttccccccttgcttgaccgcattgctcggaaccgcaagaccattgtgtgcccgatgattgatgtaattgaccatgacgactttcggtacgagacacaggcaggggatgccatgcggggagcctttgactgggagatgtactacaagcggatcccgatccctccagaactgcagaaagctgaccccagcgacccatttgagtctcccgtgatggccggtggactgttcgccgtggatcggaagtggttctgggaactcggcgggtatgacccaggcttggagatctggggaggggagcagtatgaaatctccttcaaggtgtggatgtgtgggggccgcatggaggacatcccctgctccagggtgggccatatctacaggaagtatgtgccctacaaggtcccggccggagtcagcctggcccggaaccttaagcgggtggccgaagtgtggatggatgagtacgcagagtacatttaccagcgccggcctgaataccgccacctctccgctggggatgtcgcagtccagaaaaagctccgcagctcccttaactgcaagagtttcaagtggtttatgacgaagatagcctgggacctgcccaaattctacccacccgtggagcccccggctgcagcttggggggagatccgaaatgtgggcacagggctgtgtgcagacacaaagcacggggccttgggctccccactaaggctagagggctgcgtccgaggccgtggggaggctgcctggaacaacatgcaggtattcaccttcacctggagagaggacatccggcctggagacccccagcacaccaagaagttctgctttgatgccatttcccacaccagccctgtcacgctgtacgactgccacagcatgaagggcaaccagctgtggaaataccgcaaagacaagaccctgtaccaccctgtcagtggcagctgcatggactgcagtgaaagtgaccataggatcttcatgaacacctgcaacccatcctctctcacccagcagtggctgtttgaacacaccaactcaacagtcttggaaaaattcaataggaactgagccctcatgtccccttggcaggccccccagggtctggcactcactgcagacttcctctttcaagggaggcagggcccctgtgggcactaggtgtaaaaggtgctggccaaatggttcagggtgaagagggctcttgattcaggggctggggtctgcctggtccttgagcccctgagttgtgggggtagggtgaagagcatatcccacaagaggccccacagggagcagagactgctttaatccctgctgacatcacggaaaagcaacagagccttttcaactttgtcactatgtccccttgaacattatgtgggagaacaccaaggtagcctaggccacccaaaagtgagtcctgcgaggttgcccagccctcagatggctctcctacatgatggtgctttagaaacaaaggtaaaatttgcctgtttggggcagcttttagtatcgatgccactcatctgcagcagaagagaaagaagtcctcttggggctttttagtttctgccgtcctggggggaacattgcagttactgcacagcttctgttctctgtcacaaccccaggtgatttggtccggtcaaaggccatacttggggccctaagagtgttcagtattgaatgctgatcagctgccaggtgaggagtcagaagagggagcccccctagacatttctttgcagctatggacatgcgggatatctccccctgctctctgggtatttgaaatgtcaattttagcactctccaggcacaaggacagcccagcaccagctttacagggcagtgtttcagatggccctgagcccacggaaaaggccaggtagacctccaaactagaaatgctggctgatttgccctgatccatgcttccatttccctgtctctcttccccaggcaattactggcctcaaaagaggaacagaggtgctgcgaggtgctcacctcacagagtctggaggcctccaggatcaactgtgggcaaagtgcctgcctctgacctcatcatggttctagttctcatacagaactccagaatttttaaagaactctataattggattgcaaactaggatgctacataggattctggtattccacatccaatatggatttctagaatgctgtgattaaaggagccagccaggtgtaatacagtcaaggcagcccccagcctagagacaatctgtgaaatccaaagttggtggtgttgggaaagcagggggacatgtgtccctcagctcagcagaggctgtggtacaacatggtccttggtgaagacctgcacccctggaacctcccaccatcatcacaactgtagtctcatttgcagtggagaaaagaacccgacgtcccacagccagatatacacccagctccatgccagcccttcatgtttaccttttgctttgttaattacatgtcagactcctagagggcctccagactaataggaagcatttctgtaaccaacctgccacccactgattcagaaatggaaatcacattccacaatctatggcttccaccagctagcccaggaaatacttgaaatcagcattccaattagtgttgagtctcttgattgtgtcatttaccaattaaataactgagacctaagtctgggaacagagccacgaatctgcctttgagatgctggcagatctcaaggccatcaattattgggggagggagggacaaacactcccaatcatccaccagtcagactgaatgtgtagctggcgaggaattacttccacttctggcccagcacaagccctgctttggccacctgtctgcaagagaggcggcccctgtgcttgcaacgcttacgtgttgatcccagtgtccttttccaaatgagtgctgtagctttagaagtggccctctatagaaagaagtcaaaagatgaggccccttctagaatctaggataacaagagtgttgacagtttgaggagtcgaattgagattcatcatcaaagagcaatgcagcgtcgttaaaataaaaactgtgcctttta

SEQ ID NO: 27747 - DNA, 3247 bp, Homo sapiens
acctagacgtaacacagcactccatagtggattagagctcagattctgaagtcagctaaaacagggtttaaattttggctccaccacttactctgtgacctgagtcacatttcttagcttctctgagcctccatttcagcatctgtaaaatgttactacctactttataggttttctgatgaggcttaagtgtggttgtgcatgtgaccatcttagcatagtgtgtggcaatggtaagcactcagtgctgtcagctgtttttaccgctgttattatattactgtgttttcccatgtcattaggtctgtgatccaggcttcagcagacaatccaggctgatgcttttgctgagtgcactaagggatgctggcctggcgggatggtgaactggaagcagaaacgtcatcctctctcttccttcttgccatgcaggtgtggatgtgtgggggccgcatggaggacatcccctgctccagggtgggccatatctacaggaagtatgtgccctacaaggtcccggccggagtcagcctggcccggaaccttaagcgggtggccgaagtgtggatggatgagtacgcagagtacatttaccagcgccggcctgaataccgccacctctccgctggggatgtcgcagtccagaaaaagctccgcagctcccttaactgcaagagtttcaagtggtttatgacgaagatagcctgggacctgcccaaattctacccacccgtggagcccccggctgcagcttggggggagatccgaaatgtgggcacagggctgtgtgcagacacaaagcacggggccttgggctccccactaaggctagagggctgcgtccgaggccgtggggaggctgcctggaacaacatgcaggtattcaccttcacctggagagaggacatccggcctggagacccccagcacaccaagaagttctgctttgatgccatttcccacaccagccctgtcacgctgtacgactgccacagcatgaagggcaaccagctgtggaaataccgcaaagacaagaccctgtaccaccctgtcagtggcagctgcatggactgcagtgaaagtgaccataggatcttcatgaacacctgcaacccatcctctctcacccagcagtggctgtttgaacacaccaactcaacagtcttggaaaaattcaataggaactgagccctcatgtccccttggcaggccccccagggtctggcactcactgcagacttcctctttcaagggaggcagggcccctgtgggcactaggtgtaaaaggtgctggccaaatggttcagggtgaagagggctcttgattcaggggctggggtctgcctggtccttgagcccctgagttgtgggggtagggtgaagagcatatcccacaagaggccccacagggagcagagactgctttaatccctgctgacatcacggaaaagcaacagagccttttcaactttgtcactatgtccccttgaacattatgtgggagaacaccaaggtagcctaggccacccaaaagtgagtcctgcgaggttgcccagccctcagatggctctcctacatgatggtgctttagaaacaaaggtaaaatttgcctgtttggggcagcttttagtatcgatgccactcatctgcagcagaagagaaagaagtcctcttggggctttttagtttctgccgtcctggggggaacattgcagttactgcacagcttctgttctctgtcacaaccccaggtgatttggtccggtcaaaggccatacttggggccctaagagtgttcagtattgaatgctgatcagctgccaggtgaggagtcagaagagggagcccccctagacatttctttgcagctatggacatgcgggatatctccccctgctctctgggtatttgaaatgtcaattttagcactctccaggcacaaggacagcccagcaccagctttacagggcagtgtttcagatggccctgagcccacggaaaaggccaggtagacctccaaactagaaatgctggctgatttgccctgatccatgcttccatttccctgtctctcttccccaggcaattactggcctcaaaagaggaacagaggtgctgcgaggtgctcacctcacagagtctggaggcctccaggatcaactgtgggcaaagtgcctgcctctgacctcatcatggttctagttctcatacagaactccagaatttttaaagaactctataattggattgcaaactaggatgctacataggattctggtattccacatccaatatggatttctagaatgctgtgattaaaggagccagccaggtgtaatacagtcaaggcagcccccagcctagagacaatctgtgaaatccaaagttggtggtgttgggaaagcagggggacatgtgtccctcagctcagcagaggctgtggtacaacatggtccttggtgaagacctgcacccctggaacctcccaccatcatcacaactgtagtctcatttgcagtggagaaaagaacccgacgtcccacagccagatatacacccagctccatgccagcccttcatgtttaccttttgctttgttaattacatgtcagactcctagagggcctccagactaataggaagcatttctgtaaccaacctgccacccactgattcagaaatggaaatcacattccacaatctatggcttccaccagctagcccaggaaatacttgaaatcagcattccaattagtgttgagtctcttgattgtgtcatttaccaattaaataactgagacctaagtctgggaacagagccacgaatctgcctttgagatgctggcagatctcaaggccatcaattattgggggagggagggacaaacactcccaatcatccaccagtcagactgaatgtgtagctggcgaggaattacttccacttctggcccagcacaagccctgctttggccacctgtctgcaagagaggcggcccctgtgcttgcaacgcttacgtgttgatcccagtgtccttttccaaatgagtgctgtagctttagaagtggccctctatagaaagaagtcaaaagatgaggccccttctagaatctaggataacaagagtgttgacagtttgaggagtcgaattgagattcatcatcaaagagcaatgcagcgtcgttaaaataaaaactgtgccttttaaaaagaaaaatgcaaatatagagcaaatccctaaacttg

SEQ ID NO: 27748 - DNA, 5567 bp, Homo sapiens
  misc_feature (24)..(24): n is a, c, g, or t
gcgccgacttagaggatcccccanacctaaccccatgaccgatgctgagagagtggatcaggcataccgagaaaatggatttaacatctacgtcagtgataaaatctccttgaatcgctctctcccagatatccggcacccaaactgcaacagcaagcgctacctggagacacttcccaacacaagcatcatcatccccttccacaacgagggctggtcctccctcctccgcaccgtccacagtgtgctcaatcgctcgcctccagagctggtcgccgagattgtactggtcgacgacttcagtgatcgagagcacctgaagaagcctcttgaagactacatggcccttttccccagtgtgaggattcttcgaaccaagaaacgggaagggctgataaggacccgaatgctgggggcctcagtggcaactggggatgtcatcacattcttggattcacactgtgaagccaatgtcaactggcttccccccttgcttgaccgcattgctcggaaccgcaagaccattgtgtgcccgatgattgatgtaattgaccatgacgactttcggtacgagacacaggcaggggatgccatgcggggagcctttgactgggagatgtactacaagcggatcccgatccctccagaactgcagaaagctgaccccagcgacccatttgagtctcccgtgatggccggtggactgttcgccgtggatcggaagtggttctgggaactcggcgggtatgacccaggcttggagatctggggaggggagcagtatgaaatctccttcaaggtgtggatgtgtgggggccgcatggaggacatcccctgctccagggtgggccatatctacaggaagtatgtgccctacaaggtcccggccggagtcagcctggcccggaaccttaagcgggtggccgaagtgtggatggatgagtacgcagagtacatttaccagcgccggcctgaataccgccacctctccgctggggatgtcgcagtccagaaaaagctccgcagctcccttaactgcaagagtttcaagtggtttatgacgaagatagcctgggacctgcccaaattctacccacccgtggagcccccggctgcagcttggggggagatccgaaatgtgggcacagggctgtgtgcagacacaaagcacggggccttgggctccccactaaggctagagggctgcgtccgaggccgtggggaggctgcctggaacaacatgcaggtattcaccttcacctggagagaggacatccggcctggagacccccagcacaccaagaagttctgctttgatgccatttcccacaccagccctgtcacgctgtacgactgccacagcatgaagggcaaccagctgtggaaataccgcaaagacaagaccctgtaccaccctgtcagtggcagctgcatggactgcagtgaaagtgaccataggatcttcatgaacacctgcaacccatcctctctcacccagcagtggctgtttgaacacaccaactcaacagtcttggaaaaattcaataggaactgagccctcatgtccccttggcaggccccccagggtctggcactcactgcagacttcctctttcaagggaggcagggcccctgtgggcactaggtgtaaaaggtgctggccaaatggttcagggtgaagagggctcttgattcaggggctggggtctgcctggtccttgagcccctgagttgtgggggtagggtgaagagcatatcccacaagaggccccacagggagcagagactgctttaatccctgctgacatcacggaaaagcaacagagccttttcaactttgtcactatgtccccttgaacattatgtgggagaacaccaaggtagcctaggccacccaaaagtgagtcctgcgaggttgcccagccctcagatggctctcctacatgatggtgctttagaaacaaaggtaaaatttgcctgtttggggcagcttttagtatcgatgccactcatctgcagcagaagagaaagaagtcctcttggggctttttagtttctgccgtcctggggggaacattgcagttactgcacagcttctgttctctgtcacaaccccaggtgatttggtccggtcaaaggccatacttggggccctaagagtgttcagtattgaatgctgatcagctgccaggtgaggagtcagaagagggagcccccctagacatttctttgcagctatggacatgcgggatatctccccctgctctctgggtatttgaaatgtcaattttagcactctccaggcacaaggacagcccagcaccagctttacagggcagtgtttcagatggccctgagcccacggaaaaggccaggtagacctccaaactagaaatgctggctgatttgccctgatccatgcttccatttccctgtctctcttccccaggcaattactggcctcaaaagaggaacagaggtgctgcgaggtgctcacctcacagagtctggaggcctccaggatcaactgtgggcaaagtgcctgcctctgacctcatcatggttctagttctcatacagaactccagaatttttaaagaactctataattggattgcaaactaggatgctacataggattctggtattccacatccaatatggatttctagaatgctgtgattaaaggagccagccaggtgtaatacagtcaaggcagcccccagcctagagacaatctgtgaaatccaaagttggtggtgttgggaaagcagggggacatgtgtccctcagctcagcagaggctgtggtacaacatggtccttggtgaagacctgcacccctggaacctcccaccatcatcacaactgtagtctcatttgcagtggagaaaagaacccgacgtcccacagccagatatacacccagctccatgccagcccttcatgtttaccttttgctttgttaattacatgtcagactcctagagggcctccagactaataggaagcatttctgtaaccaacctgccacccactgattcagaaatggaaatcacattccacaatctatggcttccaccagctagcccaggaaatacttgaaatcagcattccaattagtgttgagtctcttgattgtgtcatttaccaattaaataactgagacctaagtctgggaacagagccacgaatctgcctttgagatgctggcagatctcaaggccatcaattattgggggagggagggacaaacactcccaatcatccaccagtcagactgaatgtgtagctggcgaggaattacttccacttctggcccagcacaagccctgctttggccacctgtctgcaagagaggcggcccctgtgcttgcaacgcttacgtgttgatcccagtgtccttttccaaatgagtgctgtagctttagaagtggccctctatagaaagaagtcaaaagatgaggccccttctagaatctaggataacaagagtgttgacagtttgaggagtcgaattgagattcatcatcaaagagcaatgcagcgtcgttaaaataaaaactgtgccttttaaaaagaaaaatgcaaatatagagcaaatccctaaacttgaaccatttcctagtgccttgctagacaaacataaaggggcagggttgtggggaggggaacgtttttggtggtgtgtgcagttcctactggatgagtgtgtgtttcttaatgtctcatttcaagcaggagatgttgggtctggagcaagatctgagactgagatgtcccccaagggtgacaggtcagatttatttcagtcagtgcaagtcacactccaaactaaaggctgggcagtgcgtttagtctgtggcctagaagacctcatcagcccccgagaggaggccttgcattacctcactgggacctgtttgggggccatccctgcggtccaccctctgaacccccagcatgtttgtcctgtttctcaccattgggttaaggggtgccgagcactagctagacttccacatagtcccaccccaagtgggcggcagtgttcctggcatgaccaggattcctgtgaaagcaggagcagcagcaagccgtcccgggcctgcctttcccatcctttggttctcctttccagtctgggttcacaccctgaaaagggatgggtgtgtcctctgagcactctggcatttgtcattgctgagcccatatcagtaggtcctgggacttgacaaagtatgtgggaggggaaggaaggacagaacttgactggctccatttcatggaccaactgatcaattgccagtactaagccactcattgttatggcttcctttttgaaaaccacctgtctcaaggattcaggtttctgctcacatccccagctgatgctcaataaaactcagccaggagcatatggagatgctgacagccaggtaatgggtgagactgtggggtcccttttcctctaaagcctttactctgaggataaggtcacaaagtagggtgtgacttgaaagtatcgtgaccatgtggcccaccagcagcctttccaaaggggaactccagagacatttcataatgcaaacagcactgttgctttaagaacaaggcctttggaggtggctaaacttgcacgcacgtgtgtgaaaagccatcccatcttctgcctccagttggagctttcagctgttaaaacagtcagaaactattgattcttccctttaggaaaaaatgctcaggcagaacggggtacatccacaggaggaatcggacgagaggatgtgacattcggtccaggagagaaagagcagtttctgttaaagatgtaacaaatggatttccaaagtctacatgacattcacttttcaaacttcccaccagttgaatttctttttttccttaagaaacaggtgatgtcttggaaaacagctccttatgtctctctgtgcatctccattttcctagtctctggagtctcaaaaagagtggcaaagcactttacagtagtaactgaggaatcagagtctctgcttcagcgatatctagtttgtacagttgggtgatcttttgtaattcctaggaggtaatgcatttttaatgttttctgaagctttgtaagtgtgagagagggacaagaagtgcagttctgttctggaattccttattgctttcaacggacactctttgtgaaaaatccaagtaatattttagttcaaacttgatcttgagccaaggcccactgccacctctgggatgggagtcggacctacataccaagtgacaagttcaccttaacatctgcttccagaatggctttgattcagccgtgccaggcaacagaacagggtcagactcctgctctgttattggcttgaagactaggatcccaaaggggttggaggcagggaatatttgaaaattcagactggaattccaggccaaaagctcaagaccaccagcctctcctcctgcctggaaaaataagcctttgtgaaagactgatttaccatgtacaattgtgattgtgaacgttgttgagtaaacctccagactttctctaaa

SEQ ID NO: 27749 - DNA, 5962 bp, Homo sapiens
agcgggttggagcggggccggcgccgcagccgcttctgctggctgagctgctgccgccgccgggcggacgggcggacgcgcggagctgggggcggcgcggcggggccggcggggctgcggcggggctgaccggccccgatgaggcggaaggagaagcggctcctgcaggcggtggcgctggtgctggcggccctggtcctcctgcccaacgtggggctttgggcgctgtaccgcgagcggcagcccgacggcacccctgggggatcgggggcggcggtggcgccggcggcgggacagggctcacacagtcgacaaaagaaaacgtttttcttgggagatgggcagaagctgaaggactggcatgacaaggaggccatccggagggacgctcagcgcgtaggaaatggagaacaaggaagacctaaccccatgaccgatgctgagagagtggatcaggcataccgagaaaatggatttaacatctacgtcagtgataaaatctccttgaatcgctctctcccagatatccggcacccaaactgcaacagcaagcgctacctggagacacttcccaacacaagcatcatcatccccttccacaacgagggctggtcctccctcctccgcaccgtccacagtgtgctcaatcgctcgcctccagagctggtcgccgagattgtactggtcgacgacttcagtgatcgagagcacctgaagaagcctcttgaagactacatggcccttttccccagtgtgaggattcttcgaaccaagaaacgggaagggctgataaggacccgaatgctgggggcctcagtggcaactggggatgtcatcacattcttggattcacactgtgaagccaatgtcaactggcttccccccttgcttgaccgcattgctcggaaccgcaagaccattgtgtgcccgatgattgatgtaattgaccatgacgactttcggtacgagacacaggcaggggatgccatgcggggagcctttgactgggagatgtactacaagcggatcccgatccctccagaactgcagaaagctgaccccagcgacccatttgagtctcccgtgatggccggtggactgttcgccgtggatcggaagtggttctgggaactcggcgggtatgacccaggcttggagatctggggaggggagcagtatgaaatctccttcaaggtgtggatgtgtgggggccgcatggaggacatcccctgctccagggtgggccatatctacaggaagtatgtgccctacaaggtcccggccggagtcagcctggcccggaaccttaagcgggtggccgaagtgtggatggatgagtacgcagagtacatttaccagcgccggcctgaataccgccacctctccgctggggatgtcgcagtccagaaaaagctccgcagctcccttaactgcaagagtttcaagtggtttatgacgaagatagcctgggacctgcccaaattctacccacccgtggagcccccggctgcagcttggggggagatccgaaatgtgggcacagggctgtgtgcagacacaaagcacggggccttgggctccccactaaggctagagggctgcgtccgaggccgtggggaggctgcctggaacaacatgcaggtattcaccttcacctggagagaggacatccggcctggagacccccagcacaccaagaagttctgctttgatgccatttcccacaccagccctgtcacgctgtacgactgccacagcatgaagggcaaccagctgtggaaataccgcaaagacaagaccctgtaccaccctgtcagtggcagctgcatggactgcagtgaaagtgaccataggatcttcatgaacacctgcaacccatcctctctcacccagcagtggctgtttgaacacaccaactcaacagtcttggaaaaattcaataggaactgagccctcatgtccccttggcaggccccccagggtctggcactcactgcagacttcctctttcaagggaggcagggcccctgtgggcactaggtgtaaaaggtgctggccaaatggttcagggtgaagagggctcttgattcaggggctggggtctgcctggtccttgagcccctgagttgtgggggtagggtgaagagcatatcccacaagaggccccacagggagcagagactgctttaatccctgctgacatcacggaaaagcaacagagccttttcaactttgtcactatgtccccttgaacattatgtgggagaacaccaaggtagcctaggccacccaaaagtgagtcctgcgaggttgcccagccctcagatggctctcctacatgatggtgctttagaaacaaaggtaaaatttgcctgtttggggcagcttttagtatcgatgccactcatctgcagcagaagagaaagaagtcctcttggggctttttagtttctgccgtcctggggggaacattgcagttactgcacagcttctgttctctgtcacaaccccaggtgatttggtccggtcaaaggccatacttggggccctaagagtgttcagtattgaatgctgatcagctgccaggtgaggagtcagaagagggagcccccctagacatttctttgcagctatggacatgcgggatatctccccctgctctctgggtatttgaaatgtcaattttagcactctccaggcacaaggacagcccagcaccagctttacagggcagtgtttcagatggccctgagcccacggaaaaggccaggtagacctccaaactagaaatgctggctgatttgccctgatccatgcttccatttccctgtctctcttccccaggcaattactggcctcaaaagaggaacagaggtgctgcgaggtgctcacctcacagagtctggaggcctccaggatcaactgtgggcaaagtgcctgcctctgacctcatcatggttctagttctcatacagaactccagaatttttaaagaactctataattggattgcaaactaggatgctacataggattctggtattccacatccaatatggatttctagaatgctgtgattaaaggagccagccaggtgtaatacagtcaaggcagcccccagcctagagacaatctgtgaaatccaaagttggtggtgttgggaaagcagggggacatgtgtccctcagctcagcagaggctgtggtacaacatggtccttggtgaagacctgcacccctggaacctcccaccatcatcacaactgtagtctcatttgcagtggagaaaagaacccgacgtcccacagccagatatacacccagctccatgccagcccttcatgtttaccttttgctttgttaattacatgtcagactcctagagggcctccagactaataggaagcatttctgtaaccaacctgccacccactgattcagaaatggaaatcacattccacaatctatggcttccaccagctagcccaggaaatacttgaaatcagcattccaattagtgttgagtctcttgattgtgtcatttaccaattaaataactgagacctaagtctgggaacagagccacgaatctgcctttgagatgctggcagatctcaaggccatcaattattgggggagggagggacaaacactcccaatcatccaccagtcagactgaatgtgtagctggcgaggaattacttccacttctggcccagcacaagccctgctttggccacctgtctgcaagagaggcggcccctgtgcttgcaacgcttacgtgttgatcccagtgtccttttccaaatgagtgctgtagctttagaagtggccctctatagaaagaagtcaaaagatgaggccccttctagaatctaggataacaagagtgttgacagtttgaggagtcgaattgagattcatcatcaaagagcaatgcagcgtcgttaaaataaaaactgtgccttttaaaaagaaaaatgcaaatatagagcaaatccctaaacttgaaccatttcctagtgccttgctagacaaacataaaggggcagggttgtggggaggggaacgtttttggtggtgtgtgcagttcctactggatgagtgtgtgtttcttaatgtctcatttcaagcaggagatgttgggtctggagcaagatctgagactgagatgtcccccaagggtgacaggtcagatttatttcagtcagtgcaagtcacactccaaactaaaggctgggcagtgcgtttagtctgtggcctagaagacctcatcagcccccgagaggaggccttgcattacctcactgggacctgtttgggggccatccctgcggtccaccctctgaacccccagcatgtttgtcctgtttctcaccattgggttaaggggtgccgagcactagctagacttccacatagtcccaccccaagtgggcggcagtgttcctggcatgaccaggattcctgtgaaagcaggagcagcagcaagccgtcccgggcctgcctttcccatcctttggttctcctttccagtctgggttcacaccctgaaaagggatgggtgtgtcctctgagcactctggcatttgtcattgctgagcccatatcagtaggtcctgggacttgacaaagtatgtgggaggggaaggaaggacagaacttgactggctccatttcatggaccaactgatcaattgccagtactaagccactcattgttatggcttcctttttgaaaaccacctgtctcaaggattcaggtttctgctcacatccccagctgatgctcaataaaactcagccaggagcatatggagatgctgacagccaggtaatgggtgagactgtggggtcccttttcctctaaagcctttactctgaggataaggtcacaaagtagggtgtgacttgaaagtatcgtgaccatgtggcccaccagcagcctttccaaaggggaactccagagacatttcataatgcaaacagcactgttgctttaagaacaaggcctttggaggtggctaaacttgcacgcacgtgtgtgaaaagccatcccatcttctgcctccagttggagctttcagctgttaaaacagtcagaaactattgattcttccctttaggaaaaaatgctcaggcagaacggggtacatccacaggaggaatcggacgagaggatgtgacattcggtccaggagagaaagagcagtttctgttaaagatgtaacaaatggatttccaaagtctacatgacattcacttttcaaacttcccaccagttgaatttctttttttccttaagaaacaggtgatgtcttggaaaacagctccttatgtctctctgtgcatctccattttcctagtctctggagtctcaaaaagagtggcaaagcactttacagtagtaactgaggaatcagagtctctgcttcagcgatatctagtttgtacagttgggtgatcttttgtaattcctaggaggtaatgcatttttaatgttttctgaagctttgtaagtgtgagagagggacaagaagtgcagttctgttctggaattccttattgctttcaacggacactctttgtgaaaaatccaagtaatattttagttcaaacttgatcttgagccaaggcccactgccacctctgggatgggagtcggacctacataccaagtgacaagttcaccttaacatctgcttccagaatggctttgattcagccgtgccaggcaacagaacagggtcagactcctgctctgttattggcttgaagactaggatcccaaaggggttggaggcagggaatatttgaaaattcagactggaattccaggccaaaagctcaagaccaccagcctctcctcctgcctggaaaaataagcctttgtgaaagactgatttaccatgtacaattgtgattgtgaacgttgttgagtaaacctccagactttctctaaa

SEQ ID NO: 27750 - DNA, 5200 bp, Homo sapiens
acctagacgtaacacagcactccatagtggattagagctcagattctgaagtcagctaaaacagggtttaaattttggctccaccacttactctgtgacctgagtcacatttcttagcttctctgagcctccatttcagcatctgtaaaatgttactacctactttataggttttctgatgaggcttaagtgtggttgtgcatgtgaccatcttagcatagtgtgtggcaatggtaagcactcagtgctgtcagctgtttttaccgctgttattatattactgtgttttcccatgtcattaggtctgtgatccaggcttcagcagacaatccaggctgatgcttttgctgagtgcactaagggatgctggcctggcgggatggtgaactggaagcagaaacgtcatcctctctcttccttcttgccatgcaggtgtggatgtgtgggggccgcatggaggacatcccctgctccagggtgggccatatctacaggaagtatgtgccctacaaggtcccggccggagtcagcctggcccggaaccttaagcgggtggccgaagtgtggatggatgagtacgcagagtacatttaccagcgccggcctgaataccgccacctctccgctggggatgtcgcagtccagaaaaagctccgcagctcccttaactgcaagagtttcaagtggtttatgacgaagatagcctgggacctgcccaaattctacccacccgtggagcccccggctgcagcttggggggagatccgaaatgtgggcacagggctgtgtgcagacacaaagcacggggccttgggctccccactaaggctagagggctgcgtccgaggccgtggggaggctgcctggaacaacatgcaggtattcaccttcacctggagagaggacatccggcctggagacccccagcacaccaagaagttctgctttgatgccatttcccacaccagccctgtcacgctgtacgactgccacagcatgaagggcaaccagctgtggaaataccgcaaagacaagaccctgtaccaccctgtcagtggcagctgcatggactgcagtgaaagtgaccataggatcttcatgaacacctgcaacccatcctctctcacccagcagtggctgtttgaacacaccaactcaacagtcttggaaaaattcaataggaactgagccctcatgtccccttggcaggccccccagggtctggcactcactgcagacttcctctttcaagggaggcagggcccctgtgggcactaggtgtaaaaggtgctggccaaatggttcagggtgaagagggctcttgattcaggggctggggtctgcctggtccttgagcccctgagttgtgggggtagggtgaagagcatatcccacaagaggccccacagggagcagagactgctttaatccctgctgacatcacggaaaagcaacagagccttttcaactttgtcactatgtccccttgaacattatgtgggagaacaccaaggtagcctaggccacccaaaagtgagtcctgcgaggttgcccagccctcagatggctctcctacatgatggtgctttagaaacaaaggtaaaatttgcctgtttggggcagcttttagtatcgatgccactcatctgcagcagaagagaaagaagtcctcttggggctttttagtttctgccgtcctggggggaacattgcagttactgcacagcttctgttctctgtcacaaccccaggtgatttggtccggtcaaaggccatacttggggccctaagagtgttcagtattgaatgctgatcagctgccaggtgaggagtcagaagagggagcccccctagacatttctttgcagctatggacatgcgggatatctccccctgctctctgggtatttgaaatgtcaattttagcactctccaggcacaaggacagcccagcaccagctttacagggcagtgtttcagatggccctgagcccacggaaaaggccaggtagacctccaaactagaaatgctggctgatttgccctgatccatgcttccatttccctgtctctcttccccaggcaattactggcctcaaaagaggaacagaggtgctgcgaggtgctcacctcacagagtctggaggcctccaggatcaactgtgggcaaagtgcctgcctctgacctcatcatggttctagttctcatacagaactccagaatttttaaagaactctataattggattgcaaactaggatgctacataggattctggtattccacatccaatatggatttctagaatgctgtgattaaaggagccagccaggtgtaatacagtcaaggcagcccccagcctagagacaatctgtgaaatccaaagttggtggtgttgggaaagcagggggacatgtgtccctcagctcagcagaggctgtggtacaacatggtccttggtgaagacctgcacccctggaacctcccaccatcatcacaactgtagtctcatttgcagtggagaaaagaacccgacgtcccacagccagatatacacccagctccatgccagcccttcatgtttaccttttgctttgttaattacatgtcagactcctagagggcctccagactaataggaagcatttctgtaaccaacctgccacccactgattcagaaatggaaatcacattccacaatctatggcttccaccagctagcccaggaaatacttgaaatcagcattccaattagtgttgagtctcttgattgtgtcatttaccaattaaataactgagacctaagtctgggaacagagccacgaatctgcctttgagatgctggcagatctcaaggccatcaattattgggggagggagggacaaacactcccaatcatccaccagtcagactgaatgtgtagctggcgaggaattacttccacttctggcccagcacaagccctgctttggccacctgtctgcaagagaggcggcccctgtgcttgcaacgcttacgtgttgatcccagtgtccttttccaaatgagtgctgtagctttagaagtggccctctatagaaagaagtcaaaagatgaggccccttctagaatctaggataacaagagtgttgacagtttgaggagtcgaattgagattcatcatcaaagagcaatgcagcgtcgttaaaataaaaactgtgccttttaaaaagaaaaatgcaaatatagagcaaatccctaaacttgaaccatttcctagtgccttgctagacaaacataaaggggcagggttgtggggaggggaacgtttttggtggtgtgtgcagttcctactggatgagtgtgtgtttcttaatgtctcatttcaagcaggagatgttgggtctggagcaagatctgagactgagatgtcccccaagggtgacaggtcagatttatttcagtcagtgcaagtcacactccaaactaaaggctgggcagtgcgtttagtctgtggcctagaagacctcatcagcccccgagaggaggccttgcattacctcactgggacctgtttgggggccatccctgcggtccaccctctgaacccccagcatgtttgtcctgtttctcaccattgggttaaggggtgccgagcactagctagacttccacatagtcccaccccaagtgggcggcagtgttcctggcatgaccaggattcctgtgaaagcaggagcagcagcaagccgtcccgggcctgcctttcccatcctttggttctcctttccagtctgggttcacaccctgaaaagggatgggtgtgtcctctgagcactctggcatttgtcattgctgagcccatatcagtaggtcctgggacttgacaaagtatgtgggaggggaaggaaggacagaacttgactggctccatttcatggaccaactgatcaattgccagtactaagccactcattgttatggcttcctttttgaaaaccacctgtctcaaggattcaggtttctgctcacatccccagctgatgctcaataaaactcagccaggagcatatggagatgctgacagccaggtaatgggtgagactgtggggtcccttttcctctaaagcctttactctgaggataaggtcacaaagtagggtgtgacttgaaagtatcgtgaccatgtggcccaccagcagcctttccaaaggggaactccagagacatttcataatgcaaacagcactgttgctttaagaacaaggcctttggaggtggctaaacttgcacgcacgtgtgtgaaaagccatcccatcttctgcctccagttggagctttcagctgttaaaacagtcagaaactattgattcttccctttaggaaaaaatgctcaggcagaacggggtacatccacaggaggaatcggacgagaggatgtgacattcggtccaggagagaaagagcagtttctgttaaagatgtaacaaatggatttccaaagtctacatgacattcacttttcaaacttcccaccagttgaatttctttttttccttaagaaacaggtgatgtcttggaaaacagctccttatgtctctctgtgcatctccattttcctagtctctggagtctcaaaaagagtggcaaagcactttacagtagtaactgaggaatcagagtctctgcttcagcgatatctagtttgtacagttgggtgatcttttgtaattcctaggaggtaatgcatttttaatgttttctgaagctttgtaagtgtgagagagggacaagaagtgcagttctgttctggaattccttattgctttcaacggacactctttgtgaaaaatccaagtaatattttagttcaaacttgatcttgagccaaggcccactgccacctctgggatgggagtcggacctacataccaagtgacaagttcaccttaacatctgcttccagaatggctttgattcagccgtgccaggcaacagaacagggtcagactcctgctctgttattggcttgaagactaggatcccaaaggggttggaggcagggaatatttgaaaattcagactggaattccaggccaaaagctcaagaccaccagcctctcctcctgcctggaaaaataagcctttgtgaaagactgatttaccatgtacaattgtgattgtgaacgttgttgagtaaacctccagactttctctaaa

SEQ ID NO: 27751 - DNA, 3823 bp, Homo sapiens
agcgggttggagcggggccggcgccgcagccgcttctgctggctgagctgctgccgccgccgggcggacgggcggacgcgcggagctgggggcggcgcggcggggccggcggggctgcggcggggctgaccggccccgatgaggcggaaggagaagcggctcctgcaggcggtggcgctggtgctggcggccctggtcctcctgcccaacgtggggctttgggcgctgtaccgcgagcggcagcccgacggcacccctgggggatcgggggcggcggtggcgccggcggcgggacagggctcacacagtcgacaaaagaaaacgtttttcttgggagatgggcagaagctgaaggactggcatgacaaggaggccatccggagggacgctcagcgcgtaggaaatggagaacaaggaagacctaaccccatgaccgatgctgagagagtggatcaggcataccgagaaaatggatttaacatctacgtcagtgataaaatctccttgaatcgctctctcccagatatccggcacccaaactgcaacagcaagcgctacctggagacacttcccaacacaagcatcatcatccccttccacaacgagggctggtcctccctcctccgcaccgtccacagtgtgctcaatcgctcgcctccagagctggtcgccgagattgtactggtcgacgacttcagtgatcgagaccgcattgctcggaaccgcaagaccattgtgtgcccgatgattgatgtaattgaccatgacgactttcggtacgagacacaggcaggggatgccatgcggggagcctttgactgggagatgtactacaagcggatcccgatccctccagaactgcagaaagctgaccccagcgacccatttgagtctcccgtgatggccggtggactgttcgccgtggatcggaagtggttctgggaactcggcgggtatgacccaggcttggagatctggggaggggagcagtatgaaatctccttcaaggtgtggatgtgtgggggccgcatggaggacatcccctgctccagggtgggccatatctacaggaagtatgtgccctacaaggtcccggccggagtcagcctggcccggaaccttaagcgggtggccgaagtgtggatggatgagtacgcagagtacatttaccagcgccggcctgaataccgccacctctccgctggggatgtcgcagtccagaaaaagctccgcagctcccttaactgcaagagtttcaagtggtttatgacgaagatagcctgggacctgcccaaattctacccacccgtggagcccccggctgcagcttggggggagatccgaaatgtgggcacagggctgtgtgcagacacaaagcacggggccttgggctccccactaaggctagagggctgcgtccgaggccgtggggaggctgcctggaacaacatgcaggtattcaccttcacctggagagaggacatccggcctggagacccccagcacaccaagaagttctgctttgatgccatttcccacaccagccctgtcacgctgtacgactgccacagcatgaagggcaaccagctgtggaaataccgcaaagacaagaccctgtaccaccctgtcagtggcagctgcatggactgcagtgaaagtgaccataggatcttcatgaacacctgcaacccatcctctctcacccagcagtggctgtttgaacacaccaactcaacagtcttggaaaaattcaataggaactgagccctcatgtccccttggcaggccccccagggtctggcactcactgcagacttcctctttcaagggaggcagggcccctgtgggcactaggtgtaaaaggtgctggccaaatggttcagggtgaagagggctcttgattcaggggctggggtctgcctggtccttgagcccctgagttgtgggggtagggtgaagagcatatcccacaagaggccccacagggagcagagactgctttaatccctgctgacatcacggaaaagcaacagagccttttcaactttgtcactatgtccccttgaacattatgtgggagaacaccaaggtagcctaggccacccaaaagtgagtcctgcgaggttgcccagccctcagatggctctcctacatgatggtgctttagaaacaaaggtaaaatttgcctgtttggggcagcttttagtatcgatgccactcatctgcagcagaagagaaagaagtcctcttggggctttttagtttctgccgtcctggggggaacattgcagttactgcacagcttctgttctctgtcacaaccccaggtgatttggtccggtcaaaggccatacttggggccctaagagtgttcagtattgaatgctgatcagctgccaggtgaggagtcagaagagggagcccccctagacatttctttgcagctatggacatgcgggatatctccccctgctctctgggtatttgaaatgtcaattttagcactctccaggcacaaggacagcccagcaccagctttacagggcagtgtttcagatggccctgagcccacggaaaaggccaggtagacctccaaactagaaatgctggctgatttgccctgatccatgcttccatttccctgtctctcttccccaggcaattactggcctcaaaagaggaacagaggtgctgcgaggtgctcacctcacagagtctggaggcctccaggatcaactgtgggcaaagtgcctgcctctgacctcatcatggttctagttctcatacagaactccagaatttttaaagaactctataattggattgcaaactaggatgctacataggattctggtattccacatccaatatggatttctagaatgctgtgattaaaggagccagccaggtgtaatacagtcaaggcagcccccagcctagagacaatctgtgaaatccaaagttggtggtgttgggaaagcagggggacatgtgtccctcagctcagcagaggctgtggtacaacatggtccttggtgaagacctgcacccctggaacctcccaccatcatcacaactgtagtctcatttgcagtggagaaaagaacccgacgtcccacagccagatatacacccagctccatgccagcccttcatgtttaccttttgctttgttaattacatgtcagactcctagagggcctccagactaataggaagcatttctgtaaccaacctgccacccactgattcagaaatggaaatcacattccacaatctatggcttccaccagctagcccaggaaatacttgaaatcagcattccaattagtgttgagtctcttgattgtgtcatttaccaattaaataactgagacctaagtctgggaacagagccacgaatctgcctttgagatgctggcagatctcaaggccatcaattattgggggagggagggacaaacactcccaatcatccaccagtcagactgaatgtgtagctggcgaggaattacttccacttctggcccagcacaagccctgctttggccacctgtctgcaagagaggcggcccctgtgcttgcaacgcttacgtgttgatcccagtgtccttttccaaatgagtgctgtagctttagaagtggccctctatagaaagaagtcaaaagatgaggccccttctagaatctaggataacaagagtgttgacagtttgaggagtcgaattgagattcatcatcaaagagcaatgcagcgtcgttaaaataaaaactgtgccttttaaaaagaaaaatgcaaatatagagcaaatccctaaacttg

SEQ ID NO: 27752 - DNA, 822 bp, Homo sapiens
gtttaaattttggctccaccacttactctgtgacctgagtcacatttcttagcttctctgagcctccatttcagcatctgtaaaatgttactacctactttataggttttctgatgaggcttaagtgtggttgtgcatgtgaccatcttagcatagtgtgtggcaatggtaagcactcagtgctgtcagctgtttttaccgctgttattatattactgtgttttcccatgtcattaggtctgtgatccaggcttcagcagacaatccaggctgatgcttttgctgagtgcactaagggatgctggcctggcgggatggtgaactggaagcagaaacgtcatcctctctcttccttcttgccatgcaggtgtggatgtgtgggggccgcatggaggacatcccctgctccagggtgggccatatctacaggaagtatgtgccctacaaggtcccggccggagtcagcctggcccgggtaaggtggtggctttccttggcgggtagaaggggttggcctaggaccatcagctgcactgaggcaccctggggccctagactgtgttatgtgatctctgggtttgaggatgtgcctcccattctccaggtgaaatctgatttaaaagaactcccttaaatccctacttaaccattcattgctatgtgacctggggagggttgcttaagtcctctgaacctgtgtttcctcctttgtttaaagagagctaattctttccaactcccagcattgccaggagaattaaggaggtgatactgtttcccagagtgtgacagaggagacgatcttaggcagcaaacacagga

SEQ ID NO: 27753 - DNA, 370 bp, Homo sapiens
ggaggatcccagctgcgttgacatcgacgagaaaaggtgtggaggagcagctggcccagctacgctgtgagatggagcagcagagccaggagtaccagatcttgctggatgtgaagacgcggctggagcaggagattgccacctaccgccgcctgctggagggcgaggatgcccacctttcctcccagcaagcatctggccaatcctattcttcccgcgaggtcttcacctcctcctcgtcctcttcgagccgtcagacccggccagacgttatgaacaacgtcctccacctacattccaggccagcaggcttcgtctcttgaggatcccctatatcgacagccaggcccacaactcccctctcctccag

SEQ ID NO: 27754 - DNA, 1653 bp, Homo sapiens
gcatccctttccaatttacccgagcaccttctcttcactcagccaactgctcgctcgctcacctccctcctctgcaccatgaccacctgcagccgccagttcacctcctccagctccatgaagggctcctgcggcatcgggggcggcatcgggggcggctccagccgcatctcctccgtcctggccggagggtcctgccgcgcccccagcacctacgggggcggcctgtctgtctcatcctcccgcttctcctctgggggagcctacgggctggggggcggctatggcggtggcttcagcagcagcagcagcagctttggtagtggctttgggggaggatatggtggtggccttggtgctggcttgggtggtggctttggtggtggctttgctggtggtgatgggcttctggtgggcagtgagaaggtgaccatgcagaacctcaacgaccgcctggcctcctacctggacaaggtgcgtgctctggaggaggccaacgccgacctggaagtgaagatccgtgactggtaccagaggcagcggcctgctgagatcaaagactacagtccctacttcaagaccattgaggacctgaggaacaagattctcacagccacagtggacaatgccaatgtccttctgcagattgacaatgcccgtctggccgcggatgacttccgcaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctctcctcctcccagttctcctctggatcgcagtcatccagagatgtgacctcctccagccgccaaatccgcaccaaggtcatggatgtgcacgatggcaaggtggtgtccacccacgagcaggtccttcgcaccaagaactgaggctgcccagccccgctcaggcctaggaggccccccgtgtggacacagatcccactggaagatcccctctcctgcccaagcacttcacagctggaccctgcttcaccctcaccccctcctggcaatcaatacagcttcattatctgagttgcataa

SEQ ID NO: 27755 - DNA, 669 bp, Homo sapiens
caggtccttcgcaccaagaactgaggctgctcgtgggtggacaccaccttgccatcgtgcacatcatcaggtccttcgcaccaagaactgaggctgcccagccccgctcaggcctaggaggccccccgtgtggacacagatcccactggaagatcccctctcctgcccaagcacttcacagctggaccctgcttcaccctcaccccctcctggcaatcaatacagcttcattatctgagttgcataaaaaaaaaaaaaaaaaaaaaaaaaaaaaaaaaaaaaaaaaaaaaaaaaaaaaaaaaaaaagaaacaaagaatagaaggtggcggcgggtggtgctaatattaattgtctccagcatggtggcaacgcaatgagtcaaacctgcactcgaccaggtcttattgtaagactgagggggtcgcctcacatactgccagcggaggtgttatcttaccacccgatagcgcgagggacgactatttgacacaccgctgctatcggacccggaaccaacgcgcgagtcatcgccgtggaccctctttgcgacaaggagccctccactgccctctctggcgggtgcgcccacctgacgtggcgcgacgcatgcaaccagcgctcttgatccccccccctccgggtcatcatgcaaccgttctcgaggttga

SEQ ID NO: 27756 - DNA, 278 bp, Homo sapiens
tagaggattttacgtaatatgtactgacctcctccagccgccaaatccgcaccaaggtcatggatgtgcacgatggcaaggtggtgtccacccacgagcaggtccttcgcaccaagaactgaggctgcccagccccgctcaggcctaggaggccccccgtgtggacacagatcccactggaagatcccctctcctgcccaagcacttcacagctggaccctgcttcaccctcaccccctcctggcaatcaatacagcttcattatctgagttgcataa

SEQ ID NO: 27757 - DNA, 476 bp, Homo sapiens
tcggtaccccgcctgctgccttccttggatgtggcagcgttccacaacagctggcccagctccgctgcgagatggagcagcagaaccaggagtacaagatcctgctggacgtgaagacgcggctggagcaggagatcgccacctaccgccgcctgctggagggcgaggacgcccacctctcctcctcccagttctcctctggatcgcagtcatccagagatgtgacctcctccagccgccaaatccgcaccaaggtcatggatgtgcacgatggcaaggtggtgtccacccacgagcaggtccttcgcaccaagaactgaggctgcccagccccgctcaggcctaggaggccccccgtgtggacacagatcccactggaagatcccctctcctgcccaagcacttcacagctggaccctgcttcaccctcaccccctcctggcaatcaatacagcttcattatctgagttgcataa

SEQ ID NO: 27758 - DNA, 274 bp, Homo sapiens
gtgatctagaggatcccggatgacctcctccagccgccaaatccgcaccaaggtcatggatgtgcacgatggcaaggtggtgtccacccacgagcaggtccttcgcaccaagaactgaggctgcccagccccgctcaggcctaggaggccccccgtgtggacacagatcccactggaagatcccctctcctgcccaagcacttcacagctggaccctgcttcaccctcaccccctcctggcaatcaatacagcttcattatctgagttgcataa

SEQ ID NO: 27759 - DNA, 1060 bp, Homo sapiens
tgatgctagtgattggtggcttgatggggatggcattgaatctataaattaccttgggcagtatagccattttcacgatattgattcttcctatccatgagcgtggaatgttctccatttgtttgtgtcctcttttagttcgttgagatcaggcaagtccggacatgcagaacctcaacgaccgcctggcctcctacctggacaaggtgcgtgctctggaggaggccaacgccgacctggaagtgaagatccgtgactggtaccagaggcagcggcctgctgagatcaaagactacagtccctacttcaagaccattgaggacctgaggaacaagggtgggtgaatgggcagcagaaggcaccattccagctagctccttctgggaacaattcatgccccaggccgctgagaccttaagatttctctataggacagagtccaccccagatcccttctttcgaggtcttggatgccctaagactgatcagtgagaagatgctttcccttccccagcctcctcatccccttctgatctcaaatcctcagaccgttgagatcagtgattcctatccttacattttttagaggaagcagttgaagcttcgagaggtgctgtgaccagctgcaggtcacatagcaaattaatggcagagccaaggctggggcccttgtgccctaccttccagcacaggaggcagctacttgttctccagcacaggggaggagtgaggctctaacgggaccaggcaagacatccaaaccactcattagctcactagtctgggctgtggctgccgccgcccataagccttggtacaggctggtccctccccacagccaggcgggcatggagagcctgcagagacaattagtgtggtcccttgatgtgccctgcacagagagagcctggcaggcttgtgccctgactctagccccctcctccctgctcccacattacttgggagccctccctgctggagtctgttgggctctaatgacttgcatggattagggaaattcaatgatgaggtggggaaatccaaccagactcaggggcca

SEQ ID NO: 27760 - DNA, 303 bp, Homo sapiens
taggtccattggtcattgaggtccattgatgtcggcttccacactgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatggacctaaatggacaatggacctaaatggacaatggacctaaatggacatatggacctaaatggacgatggacctaaatggacaatggacctaaatgga

SEQ ID NO: 27761 - DNA, 396 bp, Homo sapiens
agatggctatagtggcccttgggatacctctttttagcaattacactttacaaacagggagactgggcacctttggggagtggccaggatcacccagggaagtggtagcagagggtcccttttcagtatctctgtgcccggactggggctgttaccctaaatctcttatttccttcaagggttcagctgcaagttcagcttccctgccttgggcccaggaagggggtgatcgggatggagtgcatccctacgtagcctgagctggtggagaaggcatgccagccctgccagccagaagacttccagatttggggcggttccttttgcccctttctgcctttcatgctcaagtagtaaggtccttggctgaccagggctcctgtcctcatccccact

SEQ ID NO: 27762 - DNA, 1658 bp, Homo sapiens
agggactcccacgcgcaaacactttcccttctttggggagaaaaatctgctcactcgctcactccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctctcctcctcccagttctcctctggatcgcagtcatccagagatgtgacctcctccagccgccaaatccgcaccaaggtcatggatgtgcacgatggcaaggtggtgtccacccacgagcaggtccttcgcaccaagaactgaggctgcccagccccgctcaggcctaggaggccccccgtgtggacacagatcccactggaagatcccctctcctgcccaagcacttcacagctggaccctgcttcaccctcaccccctcctggcaatcaatacagcttcattatctgagttgcataa

SEQ ID NO: 27763 - DNA, 1830 bp, Homo sapiens
  misc_feature (1825)..(1825): n is a, c, g, or t
agggactcccacgcgcaaacactttcccttctttggggagaaaaatctgctcactcgctcactccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctctcctcctcccagttctcctctggatcgcagtcatccagagatgtgacctcctccagccgccaaatccgcaccaaggtcatggatgtgcacgatggcaaggtggtgtccacccacgagcaggtccttcgcaccaagaactgaggctgcccagccccgctcaggcctaggaggccccccgtgtggacacagatcccactggaagatcccctctcctgcccaagcacttcacagctggaccctgcttcaccctcaccccctcctggcaatcaatacagcttcattatctgagttgcataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgccaaaaatttcccccggggggccccaattttccgcttccccttttttttgaaaagggggcccccttnagggg

SEQ ID NO: 27764 - DNA, 2707 bp, Homo sapiens
agggactcccacgcgcaaacactttcccttctttggggagaaaaatctgctcactcgctcactccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctctcctcctcccagttctcctctggatcgcagtcatccagagatgtgacctcctccagccgccaaatccgcaccaaggtcatggatgtgcacgatggcaaggtggtgtccacccacgagcaggtccttcgcaccaagaactgaggctgcccagccccgctcaggcctaggaggccccccgtgtggacacagatcccactggaagatcccctctcctgcccaagcacttcacagctggaccctgcttcaccctcaccccctcctggcaatcaatacagcttcattatctgagttgcataatatgtaacaaagaaaaataaaaaagaaaaaaaaaaaaaaaaaaaaaaaaaaaaaaaaaaaaaaaaaaaacaaaaagaaaaaaacaacaaaaaaacaagaagaggagggcggcggcgcgcgcaagaaagagatacactctcccgagaggagggcgccagcagaacgagccccgcgccacccgaagttatcttgtttataaaaagagagcgggcgcacccccaagaagagagggcgagggcgatattatataatagagaaagagaacgagagacgagagcgcggcttatatatataaacacacaaggagcagatgaaggagaggagaaaaaaaacgaagcgctagtagcagtgaggagagaataactatgtgagaggaagaaggagacacacacattatttctctgtgtggggggggagaagcgagaacaaaatatagggaggagagaacaacaaaataactatacccataggaggaagatatattaatatagaccacccactgcgacagagggagagaaaaataaaacataaaacaatatctataagcgcacaagagataataataaaggtgaggagaacaaaaccaaccaaaacgacagatataatataatctctggctgacgcattacgaaaaaaaaacaaaacttgcgccgctaacaaggaacgaagaaagagatcattacgaacaacaaaaacactatatatacaccaggcgggggcagacatgcgctccaccaccacaaacacacccagaaggacaaaaagagcagaagagagagcagagacgacaacggaagcagagcaccaaggggcaagccgacgcacaagaagcagagaagaagagacacagagaagatagaaagggggaagagcagaggagaagcggagagagccagaacaagggcgacaagccacattaaagggagcgagagaagaagcgagacggaggaggacaagcgaaaggcgcacagccagcgcaacaagggcgaggccacgacaaacgcaaacagcagacagacaacacaaccgaaaaacagcagccagagcgg

SEQ ID NO: 27765 - DNA, 2172 bp, Homo sapiens
agggactcccacgcgcaaacactttcccttctttggggagaaaaatctgctcactcgctcactccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctctcctcctcccagttctcctctggatcgcagtcatccagagatgtgacctcctccagccgccaaatccgcaccaaggtcatggatgtgcacgatggcaaggtggtgtccacccacgagcaggtccttcgcaccaagaactgaggctgcccagccccgctcaggcctaggaggccccccgtgtggacacagatcccactggaagatcccctctcctgcccaagcacttcacagctggaccctgcttcaccctcaccccctcctggcaatcaatacagcttcattatctgagttgcataaaaaaaaaaaaaaaaaaaaaaaaaaaaaaaaaaaaaaaaaaaaaaaaaaaaaaaaaaaaaaaaaaaaaaaaaagagggggcggcggcgcaaagaaagtacccccgagaggggcgcgcaacacaaacccggcccccacggttgagaaaaaagggggcgcccccaagaaggggcgagataatataaaacagaaggcgagagcgggccgcgagaaaaaaaaaaggacagaggggacaaaaaaggaaaaagagaagaacaacaatgaggcgacgaacagccccaaacgaggggggggggggacacaaataagagggggcacaaccaaccctcgctaaaaacgagaataataacgaacccgctccgatcgggaggataataatacaagacaaatagtaacgaggggtggattataaggggggggtagcaacaaagcaggagacaaggcgcctgggcagggaacaaacaaacttgtaggcaccacagaggaagtattatatgagagaaatttattacccgc

SEQ ID NO: 27766 - DNA, 1835 bp, Homo sapiens
agggactcccacgcgcaaacactttcccttctttggggagaaaaatctgctcactcgctcactccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctctcctcctcccagttctcctctggatcgcagtcatccagagatgtgacctcctccagccgccaaatccgcaccaaggtcatggatgtgcacgatggcaaggtggtgtccacccacgagcaggtccttcgcaccaagaactgaggctgcccagccccgctcaggcctaggaggccccccgtgtggacacagatcccactggaagatcccctctcctgcccaagcacttcacagctggaccctgcttcaccctcacatccgtactggcccggggccagtacggatgtgcaggcactggccaagctgggccatgccagtgaccgcatcatcgccctggatggggacaccttcaattccaccttctcgcagatcttcaaaaaggatgtcacccggacctgcttcatcgactgctacattgctgactgaacatgtgagcatccgatggctgtagccacccgcatcagacgagtgcctttc

SEQ ID NO: 27767 - DNA, 1654 bp, Homo sapiens
agggactcccacgcgcaaacactttcccttctttggggagaaaaatctgctcactcgctcactccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctctcctcctcccagttctcctctggatcgcagtcatccagagatgtgacctcctccagccgccaaatccgcaccaaggtcatggatgtgcacgatggcaaggtggtgtccacccacgagcaggtccttcgcaccaagaactgaggctgcccagccccgctcaggcctaggaggccccccgtgtggacacagatcccactggaagatcccctctcctgcccaagcacttcacagctggaccctgcttcaccctcactgttaccctattatcgtgcatacagttagtcccttctcct

SEQ ID NO: 27768 - DNA, 1646 bp, Homo sapiens
  misc_feature (1617)..(1617): n is a, c, g, or t
agggactcccacgcgcaaacactttcccttctttggggagaaaaatctgctcactcgctcactccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctctcctcctcccagttctcctctggatcgcagtcatccagagatgtgacctcctccagccgccaaatccgcaccaaggtcatggatgtgcacgatggcaaggtggtgtccacccacgagcaggtccttcgcaccaagaactgaggctgcccagccccgctcaggcctaggaggccccccgtgtggacacagatcccactggaagatcccctctcctgcccaagcacttcacagctggaccctgcttcaccctcactgntgcctctggcggtaccgacgctcgaatcg

SEQ ID NO: 27769 - DNA, 1658 bp, Homo sapiens
agggactcccacgcgcaaacactttcccttctttggggagaaaaatctgctcactcgctcactccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctctcctcctcccagttctcctctggatcgcagtcatccagagatgtgacctcctccagccgccaaatccgcaccaaggtcatggatgtgcacgatggcaaggtggtgtccacccacgagcaggtccttcgcaccaagaactgaggctgcccagccccgctcaggcctaggaggccccccgtgtggacacagatcccactggaagatcccctctcctgcccaagcacttcacagctggaccctgcttcaccctcaccttggtgcctctggcctccttgtgcctctggagagtcctatagg

SEQ ID NO: 27770 - DNA, 1640 bp, Homo sapiens
agggactcccacgcgcaaacactttcccttctttggggagaaaaatctgctcactcgctcactccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctctcctcctcccagttctcctctggatcgcagtcatccagagatgtgacctcctccagccgccaaatccgcaccaaggtcatggatgtgcacgatggcaaggtggtgtccacccacgagcaggtccttcgcaccaagaactgaggctgcccagccccgctcaggcctaggaggccccccgtgtggacacagatcccactggaagatcccctctcctgcccaagcacttcacagctggaccctgcttcaccctcactacatctaatcagaggacagagctgt

SEQ ID NO: 27771 - DNA, 1662 bp, Homo sapiens
cgcgtggtaccggcccggaattttgggatcgtttccttctttcagccaactgctcactcgctcacctccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagcatgaactggccctgcggcagactgtggaggccgacgtcaatggcctgcgccgggtgttggatgagctgaccctggccaggactgacctggagatgcagatcgaaggcctgaaggaggagctggcctacctgaggaagaaccacgaggaggagatgcttgctctgagaggtcagaccggcggagatgtgaacgtggagatggatgctgcacctggcgtggacctgagccgcatcctgaatgagatgcgtgaccagtacgagcagatggcagagaaaaaccgcagagacgctgagacctggttcctgagcaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctctcctcctcccagttctcctctggatcgcagtcatccagagatgtgacctcctccagccgccaaatccgcaccaaggtcatggatgtgcacgatggcaaggtggtgtccacccacgagcaggtccttcgcaccaagaactgaggctgcccagccccgctcaggcctaggaggccccccgtgtggacacagatcccactggaagatcccctctcctgcccaagcacttcacagctggaccctgcttcaccctcaccccctcctggcaatcaatacagcttcattatctgagttgcataa

SEQ ID NO: 27772 - DNA, 1741 bp, Homo sapiens
agggactcccacgcgcaaacactttcccttctttggggagaaaaatctgctcactcgctcactccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaaggtgggtgtcatttgaggtggaaggaacccagaccacctgccttctggggccttctggtgtgaatggcattctcttttttgcagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctctcctcctcccagttctcctctggatcgcagtcatccagagatgtgacctcctccagccgccaaatccgcaccaaggtcatggatgtgcacgatggcaaggtggtgtccacccacgagcaggtccttcgcaccaagaactgaggctgcccagccccgctcaggcctaggaggccccccgtgtggacacagatcccactggaagatcccctctcctgcccaagcacttcacagctggaccctgcttcaccctcaccccctcctggcaatcaatacagcttcattatctgagttgcataa

SEQ ID NO: 27773 - DNA, 1731 bp, Homo sapiens
cgcgtggtaccggcccggaattttgggatcgtttccttctttcagccaactgctcactcgctcacctccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagcatttgaggaacccttgagggaaaaccaaaagggaattttttccttttccaaacaaggggccaccaaaccaaagggttgggggaacaaaatgccacatgcccattttgcagattgacaatgccaggctggcagccgatgacttcaggaccaagtatgagcatgaactggccctgcggcagactgtggaggccgacgtcaatggcctgcgccgggtgttggatgagctgaccctggccaggactgacctggagatgcagatcgaaggcctgaaggaggagctggcctacctgaggaagaaccacgaggaggagatgcttgctctgagaggtcagaccggcggagatgtgaacgtggagatggatgctgcacctggcgtggacctgagccgcatcctgaatgagatgcgtgaccagtacgagcagatggcagagaaaaaccgcagagacgctgagacctggttcctgagcaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctctcctcctcccagttctcctctggatcgcagtcatccagagatgtgacctcctccagccgccaaatccgcaccaaggtcatggatgtgcacgatggcaaggtggtgtccacccacgagcaggtccttcgcaccaagaactgaggctgcccagccccgctcaggcctaggaggccccccgtgtggacacagatcccactggaagatcccctctcctgcccaagcacttcacagctggaccctgcttcaccctcaccccctcctggcaatcaatacagcttcattatctgagttgcataa

SEQ ID NO: 27774 - DNA, 1501 bp, Homo sapiens
cgcgtggtaccggcccggaattttgggatcgtttccttctttcagccaactgctcactcgctcacctccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagcatgaactggccctgcggcagactgtggaggccgacgtcaatggcctgcgccgggtgttggatgagctgaccctggccaggactgacctggagatgcagatcgaaggcctgaaggaggagctggcctacctgaggaagaaccacgaggaggagatgcttgctctgagaggtcagaccggcggagatgtgaacgtggagatggatgctgcacctggcgtggacctgagccgcatcctgaatgagatgcgtgaccagtacgagcagatggcagagaaaaaccgcagagacgctgagacctggttcctgagcaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctctcctcctcccagttctcctctggatcgcagtcatccagagatgtgacctcctccagccgccaaatccgcaccaaggtcatggatgtgcacgatggcaaggtggtgtccacccacgagcaggtccttcgcaccaagaactgaggctgcccagccccgctcaggcctaggaggccccccgtgtggacacagatcccactggaagatcccctctcctgcccaagcacttcacagctggaccctgcttcaccctcaccccctcctggcaatcaatacagcttcattatctgagttgcataa

SEQ ID NO: 27775 - DNA, 1832 bp, Homo sapiens
  misc_feature (1827)..(1827): n is a, c, g, or t
cgcgtggtaccggcccggaattttgggatcgtttccttctttcagccaactgctcactcgctcacctccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagcatgaactggccctgcggcagactgtggaggccgacgtcaatggcctgcgccgggtgttggatgagctgaccctggccaggactgacctggagatgcagatcgaaggcctgaaggaggagctggcctacctgaggaagaaccacgaggaggagatgcttgctctgagaggtcagaccggcggagatgtgaacgtggagatggatgctgcacctggcgtggacctgagccgcatcctgaatgagatgcgtgaccagtacgagcagatggcagagaaaaaccgcagagacgctgagacctggttcctgagcaagaccgaggagctgaacaaagaagtggcctccaacagcgaactggtacagagcagccgcagtgaggtgacggagctccggagggtgctccagggcctggagattgagctgcagtcccagctcagcatgaaagcatccctggagaacagcctggaggagaccaaaggccgctactgcatgcagctgtcccagatccagggactgattggcagtgtggaggagcagctggcccagctacgctgtgagatggagcagcagagccaggagtaccagatcttgctggatgtgaagacgcggctggagcaggagattgccacctaccgccgcctgctggagggcgaggatgcccacctttcctcccagcaagcatctggccaatcctattcttcccgcgaggtcttcacctcctcctcgtcctcttcgagccgtcagacccggcccatcctcaaggagcagagctcatccagcttcagccagggccagagctcctagaactgagctgcctctaccacagcctcctgcccaccagctggcctcacctcctgaaggcccgggtcaggaccctgctctcctggcgcagttcccagctatctcccctgctcctctgctggtggtgggctaataaagctgactttctggttgatgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgccaaaaatttcccccggggggccccaattttccgcttccccttttttttgaaaagggggcccccttnagggg

SEQ ID NO: 27776 - DNA, 1800 bp, Homo sapiens
  misc_feature (1663)..(1663): n is a, c, g, or t
  misc_feature (1667)..(1667): n is a, c, g, or t
  misc_feature (1671)..(1671): n is a, c, g, or t
  misc_feature (1680)..(1680): n is a, c, g, or t
  misc_feature (1795)..(1795): n is a, c, g, or t
cgcgtggtaccggcccggaattttgggatcgtttccttctttcagccaactgctcactcgctcacctccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagcatgaactggccctgcggcagactgtggaggccgacgtcaatggcctgcgccgggtgttggatgagctgaccctggccaggactgacctggagatgcagatcgaaggcctgaaggaggagctggcctacctgaggaagaaccacgaggaggagatgcttgctctgagaggtcagaccggcggagatgtgaacgtggagatggatgctgcacctggcgtggacctgagccgcatcctgaatgagatgcgtgaccagtacgagcagatggcagagaaaaaccgcagagacgctgagacctggttcctgagcaagaccgaggagctgaacaaagaagtggcctccaacagcgaactggtacagagcagccgcagtgaggtgacggagctccggagggtgctccagggcctggagattgagctgcagtcccagctcagcatgaaagcatccctggagaacagcctggaggagaccaaaggccgctactgcatgcagctgtcccagatccagggactgattggcagtgtggaggagcagctggcccagctacgctgtgagatggagcagcagagccaggagtaccagatcttgctggatgtgaagacgcggctggagcaggagattgccacctaccgccgcctgctggagggcgaggatgcccacctttcctcccagcaagcatctggccaatcctattcttcccgcgaggtcttcacctcctcctcgtcctcttcgagccgtcagacccggcccatcctcaaggagcagagctcatccagcttcagccagggccagagctcctagaactgagctgcctctaccacagcctcctgcccaccagctggcctcacctcctgaaggcccgggtcaggaccctgctctcctggcgcagttcccagctatctcccctgctcctctgctggtggtgggctaataaagctgactttctggttgatgcaaaaanaacnaaanacacaaaanaaaacaaaaaaaaaaaaaaaaaaaaaaaaaaaaaaaaggggggggccgccaaaaatttcccccggggggccccaattttccgcttccccttttttttgaaaagggggcccccttnagggg

SEQ ID NO: 27777 - DNA, 1773 bp, Homo sapiens
  misc_feature (1768)..(1768): n is a, c, g, or t
cgcgtggtaccggcccggaattttgggatcgtttccttctttcagccaactgctcactcgctcacctccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagcatgaactggccctgcggcagactgtggaggccgacgtcaatggcctgcgccgggtgttggatgagctgaccctggccaggactgacctggagatgcagatcgaaggcctgaaggaggagctggcctacctgaggaagaaccacgaggaggagatgcttgctctgagaggtcagaccggcggagatgtgaacgtggagatggatgctgcacctggcgtggacctgagccgcatcctgaatgagatgcgtgaccagtacgagcagatggcagagaaaaaccgcagagacgctgagacctggttcctgagcaagaccgaggagctgaacaaagaagtggcctccaacagcgaactggtacagagcagccgcagtgaggtgacggagctccggagggtgctccagggcctggagattgagctgcagtcccagctcagcatgaaagcatccctggagaacagcctggaggagaccaaaggccgctactgcatgcagctgtcccagatccagggactgattggcagtgtggaggagcagctggcccagctacgctgtgagatggagcagcagagccaggagtaccagatcttgctggatgtgaagacgcggctggagcaggagattgccacctaccgccgcctgctggagggcgaggatgcccacctttcctcccagcaagcatctggccaatcctattcttcccgcgaggtcttcacctcctcctcgtcctcttcgagccgtcagacccggcccatcctcaaggagcagagctcatccagcttcagccagggccagagctcctagaactgagctgcctctaccacagcctcctgcccaccagctggcctcacctcctgaaggcccgggtcaggaccctgctctcctggcgcagttcccagctatctcccctgctcctctgctggtggtgggctaataaagctgactttctggttgatgcaaaaaaaaaaaaaaaaaaaaaaaaaaaaaaaaaggggggggccgccaaaaatttcccccggggggccccaattttccgcttccccttttttttgaaaagggggcccccttnagggg

SEQ ID NO: 27778 - DNA, 1802 bp, Homo sapiens
cgcgtggtaccggcccggaattttgggatcgtttccttctttcagccaactgctcactcgctcacctccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagcatgaactggccctgcggcagactgtggaggccgacgtcaatggcctgcgccgggtgttggatgagctgaccctggccaggactgacctggagatgcagatcgaaggcctgaaggaggagctggcctacctgaggaagaaccacgaggaggagatgcttgctctgagaggtcagaccggcggagatgtgaacgtggagatggatgctgcacctggcgtggacctgagccgcatcctgaatgagatgcgtgaccagtacgagcagatggcagagaaaaaccgcagagacgctgagacctggttcctgagcaagaccgaggagctgaacaaagaagtggcctccaacagcgaactggtacagagcagccgcagtgaggtgacggagctccggagggtgctccagggcctggagattgagctgcagtcccagctcagcatgaaagcatccctggagaacagcctggaggagaccaaaggccgctactgcatgcagctgtcccagatccagggactgattggcagtgtggaggagcagctggcccagctacgctgtgagatggagcagcagagccaggagtaccagatcttgctggatgtgaagacgcggctggagcaggagattgccacctaccgccgcctgctggagggcgaggatgcccacctttcctcccagcaagcatctggccaatcctattcttcccgcgaggtcttcacctcctcctcgtcctcttcgagccgtcagacccggcccatcctcaaggagcagagctcatccagcttcagccagggccagagctcctagaactgagctgcctctaccacagcctcctgcccaccagctggcctcacctcctgaaggcccgggtcaggaccctgctctcctggcgcagttcccagctatctcccctgctcctctgctggtggtgggctaataaagctgactttctggttgatgcaaacaaagacaacaaaacaaacaacccaaccacaacacaaccagaaacaacaaaaacaaaggggcgcgcaccacacaaaaaaacaccacaaaggggggacacacacacaagagacccacaccagattataaacaaaggccaccca

SEQ ID NO: 27779 - DNA, 1836 bp, Homo sapiens
agggactcccacgcgcaaacactttcccttctttggggagaaaaatctgctcactcgctcactccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaaggtgggtgtcatttgaggtggaaggaacccagaccacctgccttctggggccttctggtgtgaatggcattctcttttttgcagacagaggagctgaaccgcgaggtggccaccaacagcgagctggtgcagagcggcaagagcgagatctcggagctccggcgcaccatgcagaacctggagattgagctgcagtcccagctcagcatggtaggaatagtgccaggaagggtggtgcacccaggactggcagggagagaacggccacactcactaatcgttgattccctttccctccctcacagaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctctcctcctcccagttctcctctggatcgcagtcatccagagatgtgacctcctccagccgccaaatccgcaccaaggtcatggatgtgcacgatggcaaggtggtgtccacccacgagcaggtccttcgcaccaagaactgaggctgcccagccccgctcaggcctaggaggccccccgtgtggacacagatcccactggaagatcccctctcctgcccaagcacttcacagctggaccctgcttcaccctcaccccctcctggcaatcaatacagcttcattatctgagttgcataa

SEQ ID NO: 27780 - DNA, 1526 bp, Homo sapiens
agggactcccacgcgcaaacactttcccttctttggggagaaaaatctgctcactcgctcactccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctctcctcctcccagttctcctctggatcgcagtcatccagagatgtgacctcctccagccgccaaatccgcaccaaggtcatggatgtgcacgatggcaaggtggtgtccacccacgaggacggatccagttcttcggcctcatgtcagttcttcggcctcatgtga

SEQ ID NO: 27781 - DNA, 1664 bp, Homo sapiens
cgcgtggtaccggcccggaattttgggatcgtttccttctttcagccaactgctcactcgctcacctccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagcatgaactggccctgcggcagactgtggaggccgacgtcaatggcctgcgccgggtgttggatgagctgaccctggccaggactgacctggagatgcagatcgaaggcctgaaggaggagctggcctacctgaggaagaaccacgaggaggagatgcttgctctgagaggtcagaccggcggagatgtgaacgtggagatggatgctgcacctggcgtggacctgagccgcatcctgaatgagatgcgtgaccagtacgagcagatggcagagaaaaaccgcagagacgctgagacctggttcctgagcaagaccgaggagctgaacaaagaagtggcctccaacagcgaactggtacagagcagccgcagtgaggtgacggagctccggagggtgctccagggcctggagattgagctgcagtcccagctcagcatgaaagcatccctggagaacagcctggaggagaccaaaggccgctactgcatgcagctgtcccagatccagggactgattggcagtgtggaggagcagctggcccagctacgctgtgagatggagcagcagagccaggagtaccagatcttgctggatgtgaagacgcggctggagcaggagattgccacctaccgccgcctgctggagggcgaggatgcccacctttcctcccagcaagcatctggccaatcctattcttcccgcgaggtcttcacctcctcctcgtcctcttcgagccgtcagacccggcccatcctcaaggagcagagctcatccagcttcagccagggccagagctcctagaactgagctgcctctaccacagcctcctgcccaccagctggcctcacctcctgaaggcccgggtcaggaccctgctctcctggcgcagttcccagctatctcccctgctcctctgctggtggtgggcctctgctctccaaaggatcctctagagcacatct

SEQ ID NO: 27782 - DNA, 1499 bp, Homo sapiens
agggactcccacgcgcaaacactttcccttctttggggagaaaaatctgctcactcgctcactccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctctcctcctcccagttctcctctggatcgcagtcatccagagatgtgacctcctccagccgccaaatccgcaccaaggtcatggatgtgcacgatgcccctcctggcaatcaatacagcttcattatctgagttgcataa

SEQ ID NO: 27783 - DNA, 1496 bp, Homo sapiens
agggactcccacgcgcaaacactttcccttctttggggagaaaaatctgctcactcgctcactccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctttcctcccagcaagcatctggccaatcctattcttcccgcgaggtcttcacctcctcctcgtcctcttcgagccgtcagacccggcccatcctctgctggtggtgggctaataaagctgactttctggttgatgca

SEQ ID NO: 27784 - DNA, 2225 bp, Homo sapiens
agggactcccacgcgcaaacactttcccttctttggggagaaaaatctgctcactcgctcactccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctctcctcctcccagttctcctctggatcgcagtcatccagagatggtaagaccctcctcctctgcaggcctgggctccaggccaccctctgtaccccaagcaggtctaggcattggctaggggctccgtgaggggctgagctctagtgctgtcacccagtttcccttgtgaacctccttgggtggaagaagctattttctaaaccctccttagggctaggagaggcagcccccacctcttgcttctacgtggtgtctgtggcagatcctattgctgttgtggtcagcaccatgaacagggccctacagggctcttcccactgagaccactccattgggtgaatatggatggaaccagccaggtgtgagctcttaggaagctctaatctgagggcaaagactctgtctctgacctttgggagccctcgtctgaaagaaatgtgttgatggtatcagtgcttgggcaacagcagggagtgaagcagtaatcaggggagagggcaatggggagccagtttgagtttcctcaccttcttggcctccttactcctgattagtccattgtctgtccacctctggtaacgtcctcttcccacctcttccccagtgaccttgacctcctccagccgccaaatccgcaccaaggtcatggatgtgcacgatggcaaggtggtgtccacccacgagcaggtccttcgcaccaagaactgaggctgcccagccccgctcaggcctaggaggccccccgtgtggacacagatcccactggaagatcccctctcctgcccaagcacttcacagctggaccctgcttcaccctcaccccctcctggcaatcaatacagcttcattatctgagttgcataa

SEQ ID NO: 27785 - DNA, 2319 bp, Homo sapiens
agggactcccacgcgcaaacactttcccttctttggggagaaaaatctgctcactcgctcactccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccagtgagtcttggccctccccttagtccgccccccccatggcactctcacggccccaccatgtatctaatgatcctgtccttttctattttcacagcctctcctcctcccagttctcctctggatcgcagtcatccagagatggtaagaccctcctcctctgcaggcctgggctccaggccaccctctgtaccccaagcaggtctaggcattggctaggggctccgtgaggggctgagctctagtgctgtcacccagtttcccttgtgaacctccttgggtggaagaagctattttctaaaccctccttagggctaggagaggcagcccccacctcttgcttctacgtggtgtctgtggcagatcctattgctgttgtggtcagcaccatgaacagggccctacagggctcttcccactgagaccactccattgggtgaatatggatggaaccagccaggtgtgagctcttaggaagctctaatctgagggcaaagactctgtctctgacctttgggagccctcgtctgaaagaaatgtgttgatggtatcagtgcttgggcaacagcagggagtgaagcagtaatcaggggagagggcaatggggagccagtttgagtttcctcaccttcttggcctccttactcctgattagtccattgtctgtccacctctggtaacgtcctcttcccacctcttccccagtgaccttgacctcctccagccgccaaatccgcaccaaggtcatggatgtgcacgatggcaaggtggtgtccacccacgagcaggtccttcgcaccaagaactgaggctgcccagccccgctcaggcctaggaggccccccgtgtggacacagatcccactggaagatcccctctcctgcccaagcacttcacagctggaccctgcttcaccctcaccccctcctggcaatcaatacagcttcattatctgagttgcataa

SEQ ID NO: 27786 - DNA, 2134 bp, Homo sapiens
  misc_feature (2129)..(2129): n is a, c, g, or t
cgcgtggtaccggcccggaattttgggatcgtttccttctttcagccaactgctcactcgctcacctccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagcatgaactggccctgcggcagactgtggaggccgacgtcaatggcctgcgccgggtgttggatgagctgaccctggccaggactgacctggagatgcagatcgaaggcctgaaggaggagctggcctacctgaggaagaaccacgaggaggagatgcttgctctgagaggtcagaccggcggagatgtgaacgtggagatggatgctgcacctggcgtggacctgagccgcatcctgaatgagatgcgtgaccagtacgagcagatggcagagaaaaaccgcagagacgctgagacctggttcctgagcaagaccgaggagctgaacaaagaagtggcctccaacagcgaactggtacagagcagccgcagtgaggtgacggagctccggagggtgctccagggcctggagattgagctgcagtcccagctcagcatggtatgaaggacccagcacagcagcagcccccaagtcaccagtaatggccaccaccccctcaaaaagccacagtctagttccacctttcttttctcaggatgggaccaggggactcatgggaccgttatatagatagagaaactaagccctagaatagtgggctagcttttctccatattgtctggcccatcagtaccccaactgggatcaaaatccaggcatctctcaaaaaacatgcccagagacctggaggaacaggagtgaccacctccatggactctttttctctctctcacttgcagaaagcatccctggagaacagcctggaggagaccaaaggccgctactgcatgcagctgtcccagatccagggactgattggcagtgtggaggagcagctggcccagctacgctgtgagatggagcagcagagccaggagtaccagatcttgctggatgtgaagacgcggctggagcaggagattgccacctaccgccgcctgctggagggcgaggatgcccacctttcctcccagcaagcatctggccaatcctattcttcccgcgaggtcttcacctcctcctcgtcctcttcgagccgtcagacccggcccatcctcaaggagcagagctcatccagcttcagccagggccagagctcctagaactgagctgcctctaccacagcctcctgcccaccagctggcctcacctcctgaaggcccgggtcaggaccctgctctcctggcgcagttcccagctatctcccctgctcctctgctggtggtgggctaataaagctgactttctggttgatgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgccaaaaatttcccccggggggccccaattttccgcttccccttttttttgaaaagggggcccccttnagggg

SEQ ID NO: 27787 - DNA, 1587 bp, Homo sapiens
agggactcccacgcgcaaacactttcccttctttggggagaaaaatctgctcactcgctcactccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggagcagccgccccatctgccccacagtctccgcctctccagcctcagctcctcctagctcagctcctccacacga

SEQ ID NO: 27788 - DNA, 1495 bp, Homo sapiens
agggactcccacgcgcaaacactttcccttctttggggagaaaaatctgctcactcgctcactccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccagtgagtcccaggcccctcagttctgcctcccagaccctttagcctctcctgctgctctcagctactactgaatgacactgctttgtctctacccacagcctgtgcgtacactgcaagtatcgggtacaatcctagttt

SEQ ID NO: 27789 - DNA, 1395 bp, Homo sapiens
agggactcccacgcgcaaacactttcccttctttggggagaaaaatctgctcactcgctcactccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctcagctcctcctcagtatacgggatcctctatggtc

SEQ ID NO: 27790 - DNA, 2388 bp, Homo sapiens
  misc_feature (2383)..(2383): n is a, c, g, or t
cgcgtggtaccggcccggaattttgggatcgtttccttctttcagccaactgctcactcgctcacctccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagcatgaactggccctgcggcagactgtggaggccgacgtcaatggcctgcgccgggtgttggatgagctgaccctggccaggactgacctggagatgcagatcgaaggcctgaaggaggagctggcctacctgaggaagaaccacgaggaggagatgcttgctctgagaggtcagaccggcggagatgtgaacgtggagatggatgctgcacctggcgtggacctgagccgcatcctgaatgagatgcgtgaccagtacgagcagatggcagagaaaaaccgcagagacgctgagacctggttcctgagcaagaccgaggagctgaacaaagaagtggcctccaacagcgaactggtacagagcagccgcagtgaggtgacggagctccggagggtgctccagggcctggagattgagctgcagtcccagctcagcatggtatgaaggacccagcacagcagcagcccccaagtcaccagtaatggccaccaccccctcaaaaagccacagtctagttccacctttcttttctcaggatgggaccaggggactcatgggaccgttatatagatagagaaactaagccctagaatagtgggctagcttttctccatattgtctggcccatcagtaccccaactgggatcaaaatccaggcatctctcaaaaaacatgcccagagacctggaggaacaggagtgaccacctccatggactctttttctctctctcacttgcagaaagcatccctggagaacagcctggaggagaccaaaggccgctactgcatgcagctgtcccagatccagggactgattggcagtgtggaggagcagctggcccagctacgctgtgagatggagcagcagagccaggagtaccagatcttgctggatgtgaagacgcggctggagcaggagattgccacctaccgccgcctgctggagggcgaggatgcccagtgagtcccaggcccctcagttctgcctcccagaccctttagcccccctgctgctctcagcacaactgactgccctgccttttctctcccacagcctttcctcccagcaagcatctggccaatcctattcttcccgcgagggtaaggcttctgaggctccccggcactgcagcccctctgcctgtttccatggagtgggggctgggcccttctcctcagagctcccagccctcccttctccctgccctggagtcagcttagctctcagaccccttctcacctcctcttctctctcccacagtcttcacctcctcctcgtcctcttcgagccgtcagacccggcccatcctcaaggagcagagctcatccagcttcagccagggccagagctcctagaactgagctgcctctaccacagcctcctgcccaccagctggcctcacctcctgaaggcccgggtcaggaccctgctctcctggcgcagttcccagctatctcccctgctcctctgctggtggtgggctaataaagctgactttctggttgatgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgccaaaaatttcccccggggggccccaattttccgcttccccttttttttgaaaagggggcccccttnagggg

SEQ ID NO: 27791 - DNA, 1262 bp, Homo sapiens
agggactcccacgcgcaaacactttcccttctttggggagaaaaatctgctcactcgctcactccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagctccactacgggatcctttagagtctagctcaa

SEQ ID NO: 27792 - DNA, 1256 bp, Homo sapiens
agggactcccacgcgcaaacactttcccttctttggggagaaaaatctgctcactcgctcactccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcaccacaacggggatccttgagtcgac

SEQ ID NO: 27793 - DNA, 1817 bp, Homo sapiens
  misc_feature (1812)..(1812): n is a, c, g, or t
cgcgtggtaccggcccggaattttgggatcgtttccttctttcagccaactgctcactcgctcacctccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagcatgaactggccctgcggcagactgtggaggccgacgtcaatggcctgcgccgggtgttggatgagctgaccctggccaggactgacctggagatgcagatcgaaggcctgaaggaggagctggcctacctgaggaagaaccacgaggaggagatgcttgctctgagaggtcagaccggcggagatgtgaacgtggagatggatgctgcacctggcgtggacctgagccgcatcctgaatgagatgcgtgaccagtacgagcagatggcagagaaaaaccgcagagacgctgagacctggttcctgagcaagaccgaggagctgaacaaagaagtggcctccaacagcgaactggtacagagcagccgcagtgaggtgacggagctccggagggtgctccagggcctggagattgagctgcagtcccagctcagcatgaaagcatccctggagaacagcctggaggagaccaaaggccgctactgcatgcagctgtcccagatccagggactgattggcagtgtggaggagcagctggcccagctacgctgtgagatggagcagcagagccaggagtaccagatcttgctggatgtgaagacgcggctggagcaggagattgccacctaccgccgcctgctggagggcgaggatgcccacctttcctcccagcaagcatctggccaatcctattcttcccgcgaggtcttcacctcctcctcgtcctcttcgagccgtcagacccggcccatcctcaaggagcagagctcatccagcttcagccagggccagactgcctctaccacagcctcctgcccaccagctggcctcacctcctgaaggcccgggtcaggaccctgctctcctggcgcagttcccagctatctcccctgctcctctgctggtggtgggctaataaagctgactttctggttgatgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgccaaaaatttcccccggggggccccaattttccgcttccccttttttttgaaaagggggcccccttnagggg

SEQ ID NO: 27794 - DNA, 1353 bp, Homo sapiens
  misc_feature (1348)..(1348): n is a, c, g, or t
cgcgtggtaccggcccggaattttgggatcgtttccttctttcagccaactgctcactcgctcacctccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcctctgccaagacagtacgcatgcagagagaatcgagaacatgagggaggagatcattgcggccaccattgagaatgcgcagcccattttgcagtcccagctcagcatgaaagcatccctggagaacagcctggaggagaccaaaggccgctactgcatgcagctgtcccagatccagggactgattggcagtgtggaggagcagctggcccagctacgctgtgagatggagcagcagagccaggagtaccagatcttgctggatgtgaagacgcggctggagcaggagattgccacctaccgccgcctgctggagggcgaggatgcccacctttcctcccagcaagcatctggccaatcctattcttcccgcgaggtcttcacctcctcctcgtcctcttcgagccgtcagacccggcccatcctcaaggagcagagctcatccagcttcagccagggccagagctcctagaactgagctgcctctaccacagcctcctgcccaccagctggcctcacctcctgaaggcccgggtcaggaccctgctctcctggcgcagttcccagctatctcccctgctcctctgctggtggtgggctaataaagctgactttctggttgatgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgccaaaaatttcccccggggggccccaattttccgcttccccttttttttgaaaagggggcccccttnagggg

SEQ ID NO: 27795 - DNA, 1416 bp, Homo sapiens
cgcgtggtaccggcccggaattttgggatcgtttccttctttcagccaactgctcactcgctcacctccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagcatgaactggccctgcggcagactgtggaggccgacgtcaatggcctgcgccgggtgttggatgagctgaccctggccaggactgacctggagatgcagatcgaaggcctgaaggaggagctggcctacctgaggaagaaccacgaggaggagatgcttgctctgagaggtcagaccggcggagatgtgaacgtggagatggatgctgcacctggcgtggacctgagccgcatcctgaatgagatgcgtgaccagtacgagcagatggcagagaaaaaccgcagagacgctgagacctggttcctgagcaagacagaggagctgaaccgcgaggtggccaccaacagcgagctggtgcagagcggcaagagcgagatctcggagctccggcgcaccatgcagaacctggagattgagctgcagtcccagctcagcatggtaggaatagtgccaggaagggtggtgcacccaggactggcagggagagaacggccacactcactaatcgttgattccctttccctccctcacagaaagcatccctggagaacagcctggaggagaccaaaggtcgctactgcatgcagctggcccagatccaggagatgattggcagcgtggaggagcctatctccaggttctgcatggtgcccggagctccgagatctcgctcttccctctgcaccagctcgctgttggtgccacctcgcgcta

SEQ ID NO: 27796 - DNA, 1147 bp, Homo sapiens
agggactcccacgcgcaaacactttcccttctttggggagaaaaatctgctcactcgctcactccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagataactcaggggacctctagatcgactcacagcagcac

SEQ ID NO: 27797 - DNA, 895 bp, Homo sapiens
  misc_feature (854)..(854): n is a, c, g, or t
  misc_feature (865)..(865): n is a, c, g, or t
cgcgtggtaccggcccggaattttgggatcgtttccttctttcagccaactgctcactcgctcacctccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagcatgaactggccctgcggcagactgtggaggccgacgtcaatggcctgcgccgggtgttggatgagctgaccctggccaggactgacctggagatgcagatcgaaggcctgaaggaggagctggcctacctgaggaagaaccacgaggagcngaaaagtcaanccggggagatggtgacggcggaagactgga

SEQ ID NO: 27798 - DNA, 1029 bp, Homo sapiens
cgcgtggtaccggcccggaattttgggatcgtttccttctttcagccaactgctcactcgctcacctccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagattatgacagtgaaagaaatcagacttcattgactctatcttgtttctaacccttaagctgtccttgtgggattcctgggcttaggccgaactaaatgtaggaaggaattcagttcgtggcttgactctgaaagaaaattggtaacagccctttcccaataagacccccttcttgcctggggtccagtctgactttgcaggactaacaaattagctacaagattagaaattacaatttagaggtcatgcagcctctggctccaagagtctgaacctcctcaaattgctcctggggataacatcactattgtaaaacctaagatcagtgcgtgagatattttccagaccctgtactcgatggatcagctgacaccactcagaccagtaatctggcccaaccagttctgccattgcacc

SEQ ID NO: 27799 - DNA, 777 bp, Homo sapiens
gttcagcttccctgccttgggcccaggaagggggtgatcgggatggagtgcatccctacgtagcctgagctggtggagaaggcatgccagccctgccagccagaagacttccagatttggggcggttccttttgcccctttctgcctttcatgctcaagtagtaaggtccttggctgaccagggctcctgtcctcatccccactccagatcattgcggccaccattgagaatgcgcagcccattttgcagattgacaatgccaggctggcagccgatgacttcaggaccaagtgagcagccagcatggtgggctgggggcagagggcaagggacaaagagtggggcggtccacccagcagggccagcagaccccgagcctcagaatcctcagggctgcagcctgaggacctgacctctgtcctgccaggtatgagcatgaactggccctgcggcagactgtggaggccgacgtcaatggcctgcgccgggtgttggatgagctgaccctggccaggactgacctggagatgcagatcgaaggcctgaaggaggagctggcctacctgaggaagaaccacgaggagggtacggtcgctgctggcttccggggtgggaggctggtttggtggggttgccagatgcacccagggccaggagagaagtctgctgaactgaccgcctcctgccatcccttcccaggagatgcttgctctgagaggtcagaccggcggagatgtgaacgtggagatggatgctgcacctggcgtggacctgag

SEQ ID NO: 27800 - DNA, 462 bp, Homo sapiens
agaaataacaaaagttcaaaaaaaccaacaacatgagaaaaaccccactcttggctcaaagaaaaaatttataatagatcaattaagaaaaaaataaaaattaaaataccatatttaaaaatggtattagtagctcatattcagcttccattctagagtctttaacatgccattttcaatactcttgcttttaagttttccctcatgagcttgatccttgacccacagctgtaatgtgaaatttattctgagccctgatgaatgataggtggtgattatataagaactcaccttatatggctttttaaaatatgatacattaacgtgaaaaatcctagaatcactagaaacaagaaaattaaattgtgcttttaaaaatttgatatgcttaaatgttcagacaactcaaaaacatccaccagaatggagctaataatactgcctatttaatagaattgttag

SEQ ID NO: 27801 - DNA, 631 bp, Homo sapiens
caaaaaccagttatgtttatcacagaaatggcatagatattttaatattagtaaacctgtaaatataatctttgacatgaataggtcagtagagaaaacacatttgatttttcccaatatgtactaaaatgagtttgaataaattcagcatctatttttcacagaagtttttacaaaactagacacagaatacttcccattaaagtgaggaacaaaacaagttgtaagtattaaataagagcaaatccaagcattacaagtcctgtagcttatacaatttgggagccctttttaaaacaaaacaaaaaatacaagattttcttggcccctctcaggcctcacaaaaaaacctatgaaaaagagaagtttgaaacttaagcttccccccgccctcccctttttctcctatcctggggaaggccacctttgtacggctgttagaacttaatattttgttttagatgcttgggccaatgcagtaagaaatgacactgaaagaaaagctagaatcactagaaacaagaaaattaaattgtgcttttaaaaatttgatatgcttaaatgttcagacaactcaaaaacatccaccagaatggagctaataatactgcctatttaatagaattgttag

SEQ ID NO: 27802 - DNA, 613 bp, Homo sapiens
agaaataacaaaagttcaaaaaaaccaacaacatgagaaaaaccccactcttggctcaaagaaaaaatttataatagatcaattaagaaaaaaataaaaattaaaataccatatttaaaaatggtattagtagctcatattcagcttccattctagagtctttaacatgccattttcaatactcttgcttttaagttttccctcatgagcttgatccttgacccacagctgtaatgtgaaatttattctgagccctgatgaatgataggtggtgattatataagaactcaccttatatggctttttaaaatatgatacattaacgtgaaaaatccctagatttggatacttacagaggctgattatgaaatcagtaaaatggaaaactaaaaattataaaacagttttaataattatccctggggatataatctcataattgccaagagttagggtaccattatttaaaagtttaaaaggcagggtggggtgcagtagttcacacctgtaatcccagcactttggaaggctgaggcaggcggattgcttgagcccaagagtttgagaccagactgggcaacatggcaagactttgcctctacaaaaaatacaa

SEQ ID NO: 27803 - DNA, 2669 bp, Homo sapiens
cgcgtcctgtcccggcgccttccgcgcaccggccaccgccagtctccgagccccgtgacctgcaggtcctccggccgcgactccgggccggccctgcgtggtggctgtcggggggcgcgcggggaagcagcggaacttgcggtgtgaggggccggcggggcccggagcggtccccggcccgggaaacttggaccgagaccaggccggcgaccaccaggggcctgaggatgaagccaagtctgctgtgccggcccctgtcctgcttccttatgctgctgccctggcctctcgccaccctgacatcaacaaccctttggcagtgcccacctggggaggagcccgacctggacccagggcagggcacattatgcaggccctgccccccaggcaccttctcagctgcatggggctccagcccatgccagccccatgcccgttgcagcctttggaggaggctggaggcccaggtgggcatggcaactcgagatacactctgtggagactgctggcctgggtggtttgggccttggggggttccccgcgttccatgtcaaccatgttcctgggcacctctgggtactcatggctgtgatgagtgggggcggcgggcccgacgtggcgtggaggtggcagcaggggccagcagcggtggtgagacacggcagcctgggaacggcacccgggcaggtggcccagaggagacagccgcccagtacgcggtcatcgccatcgtccctgtcttctgcctcatggggctgttgggcatcctggtgtgcaacctcctcaagcggaagggctaccactgcacggcgcacaaggaggtcgggcccggccctggaggtggaggcagtggaatcaaccctgcctaccggactgaggatgccaatgaggacaccattggggtcctggtgcgcttgatcacagagaagaaagagaatgctgcggccctggaggagctgctgaaagagtaccacagcaaacagctggtgcagacgagccacaggcctgtgtccaagctgccgccagcgcccccgaacgtgccacacatctgcccgcaccgccaccatctccacaccgtgcagggcctggcctcgctctctggcccctgctgctcccgctgtagccagaagaagtggcccgaggtgctgctgtcccctgaggctgtagccgccactactcctgttcccagccttctgcctaacccgaccagggttcccaaggccggggccaaggcagggcgtcagggcgagatcaccatcttgtctgtgggcaggttccgcgtggctcgaattcctgagcagcggacaagttcaatggtgtctgaggtgaagaccatcacggaggctgggccctcgtggggtgatctccctgactccccacagcctggcctcccccctgagcagcaggccctgctaggaagtggcggaagccgtacaaagtggctgaagcccccagcagagaacaaggccgaggagaaccgctatgtggtccggctaagtgagagcaacctggtcatctgaggggcggtctagtctaaggacactgcggccctgccctgggaggttccgaaggcttcctggaggaggtggagctgcagctgggactgtgaggaccgagaagcaatggcccagcagacgagacagcaaagaccaaggcctggaggtgggagcgtctgccccagtgaggaggcaggtggccggcgggcactgtgtacaggagcaggctgagccccgcccctggccctgctgccatgttgctcccctgaaggatgccccgacccccgtgcctgccctggctggatcctaggagcccacgggattctctgtatcatcagaggctgggcttggcagaggggaggggcctgtgcccgtcacccctggccccattccttggtaattagccacacccttgcctctgtacagggccctagagcagatgtgcgtccccctcctcttccagcaggtctataaagggaaggggtagcagaaagtcctgggctaggagagtgagtccctgggttctaatcttgggcacatctgtggccatcgctgggtccatttttctgactgtgaagtaaggagagacgtctcagtacccagggcctcttcagctctttgtaggttctgggctgggttgtgggggactggggagctgggctctaccatccctcccattagtagctttatccagccccgtttttgctgcttccagggcctctgccttcaaggcccccatggggctgtccatccatggctctgcctacggaaggggcttaatgcatgtgcctgcccctcccccagctgtttttaatgaaactgaaaaaatagacttgatcccggcaggactgtgatacagagccctagcctgcccagccagccccaagatctcaggagctttagggagaagacttggtggggctggagcacaccttgggcctcagtggtttctgtgtccctgtggtgccagtgcttctgggcagtgcaggcggctgccaggcccagccctgacttccactctggctcagcaacctggttatttatgtggggccgtgcaggcatgggcccactgcctgtccatcctgtttctcttatttattgaaactcaccattgccctatccttgtgtctccacccccttccatgtgttgaataataaaaggtgggaaagtgc

SEQ ID NO: 27804 - DNA, 3440 bp, Homo sapiens
gggtctgcgcaccttcccggcccagccggcgattcattcaaaaggcgcgcaggctgcgcggctgtccgggcgctcgccgagccgggccgcggcgccgagtcgaacggggagccgagctggagctgccgcggcgcagccaggccggcgaccaccaggggcctgaggatgaagccaagtctgctgtgccggcccctgtcctgcttccttatgctgctgccctggcctctcgccaccctgacatcaacaaccctttggcagtgcccacctggggaggagcccgacctggacccagggcagggcacattatgcaggccctgccccccaggcaccttctcagctgcatggggctccagcccatgccagccccatgcccgttgcagcctttggaggaggctggaggcccaggtgggcatggcaactcgagatacactctgtggagactgctggcctgggtggtttgggccttggggggttccccgcgttccatgtcaaccatgttcctgggcacctctgggtactcatggctgtgatgagtgggggcggcgggcccgacgtggcgtggaggtggcagcaggggccagcagcggtggtgagacacggcagcctgggaacggcacccgggcaggtggcccagaggagacagccgcccagtacgcggtcatcgccatcgtccctgtcttctgcctcatggggctgttgggcatcctggtgtgcaacctcctcaagcggaagggctaccactgcacggcgcacaaggaggtcgggcccggccctggaggtggaggcagtggaatcaaccctgcctaccggactgaggatgccaatgaggacaccattggggtcctggtgcgcttgatcacagagaagaaagagaatgctgcggccctggaggagctgctgaaagagtaccacagcaaacagctggtgcagacgagccacaggcctgtgtccaagctgccgccagcgcccccgaacgtgccacacatctgcccgcaccgccaccatctccacaccgtgcagggcctggcctcgctctctggcccctgctgctcccgctgtagccagaagaagtggcccgaggtgctgctgtcccctgaggctgtagccgccactactcctgttcccagccttctgcctaacccgaccagggttcccaaggccggggccaaggcagggcgtcagggcgagatcaccatcttgtctgtgggcaggttccgcgtggctcgaattcctgagcagcggacaagttcaatggtgtctgaggtgaagaccatcacggaggctgggccctcgtggggtgatctccctgactccccacagcctggcctcccccctgagcagcaggccctgctaggaagtggcggaagccgtacaaagtggctgaagcccccagcagagaacaaggccgaggagaaccgctatgtggtccggctaagtgagagcaacctggtcatctgaggggcggtctagtctaaggacactgcggccctgccctgggaggttccgaaggcttcctggaggaggtggagctgcagctgggactgtgaggaccgagaagcaatggcccagcagacgagacagcaaagaccaaggcctggaggtgggagcgtctgccccagtgaggaggcaggtggccggcgggcactgtgtacaggagcaggctgagccccgcccctggccctgctgccatgttgctcccctgaaggatgccccgacccccgtgcctgccctggctggatcctaggagcccacgggattctctgtatcatcagaggctgggcttggcagaggggaggggcctgtgcccgtcacccctggccccattccttggtaattagccacacccttgcctctgtacagggccctagagcagatgtgcgtccccctcctcttccagcaggtctataaagggaaggggtagcagaaagtcctgggctaggagagtgagtccctgggttctaatcttgggcacatctgtggccatcgctgggtccatttttctgactgtgaagtaaggagagacgtctcagtacccagggcctcttcagctctttgtaggttctgggctgggttgtgggggactggggagctgggctctaccatccctcccattagtagctttatccagccccgtttttgctgcttccagggcctctgccttcaaggcccccatggggctgtccatccatggctctgcctacggaaggggcttaatgcatgtgcctgcccctcccccagctgtttttaatgaaactgaaaaaatagacttgatcccggcaggactgtgatacagagccctagcctgcccagccagccccaagatctcaggagctttagggagaagacttggtggggctggagcacaccttgggcctcagtggtttctgtgtccctgtggtgccagtgcttctgggcagtgcaggcggctgccaggcccagccctgacttccactctggctcagcaacctggttatttatgtggggccgtgcaggcatgggcccactgcctgtccatcctgtttctcttatttattgaaactcaccattgccctatccttgtgtctccacccccttccatgtgttgaataataaaaggtgggaaagtgctgtcacgaggagctccttttctctgtgcccttcccagcttatccgcctgttccacttgtacctgtccagccctgccctgtgttgggcaccgtgacaggctgccctcccctcacagttcctgcacctcagcagccagggaagcagggcccagaggagacccatcaactcatctggttctcaccaaagcccctagctagaggcagggctgtcccacagaaatagtgtgagccacatatgtgactttaaattttctgacagtcacatttcaaaaagtaaaaagaagcaggtgaacttaatttttttttaacccagtctatccaaaatattttcatttcaatataaaatcagtataaaaagtgtgaatgagctgtttttgcttttgctttgaaatctggagtgtatcttacacatcttgattggaactcaaatatttcaagggctccatagccacgtggccagcagctaccacactggtcagcgcagcacctgaggaaatgcactgtgtggagcccgggaggtaattgggggtgaggaagatgtgcgggccagggaatgtgttccacagagagggacagcatgtgcaaaggctgagcaccaacacatagtggtcacctgggccttatgcccagggagcctccaaagcattcagctcctgcttggccagtgtggagaggaaaggagccacaggagcgggtgctacacccggcaagacagagcgtctccatctaaaattcctagggcaagcttccaacccggcccaagggccgcatgtggcccaggatatggctttgaatggggcctaacacaaattcataaactttcttaaaacattg

SEQ ID NO: 27805 - DNA, 2936 bp, Homo sapiens
cgccccctcgcccgcccaattcaatgactggagttcacgtggccctgaagcctctatgcacccgggctgttgggtgcaggaagcactggtgttgaatcatgaaggtgatatgggcttctctgagcctggatcccacatttgcagggctctgggaggcttgtcacctaaatgcacatgctcagggcccttaagaaggccagggttgccctctgctggcagatcatggtttagctcaggagtgcggcttccccctcttccccaggatcagggcccttcttttccccaggaatcaaccctgcctaccggactgaggatgccaatgaggacaccattggggtcctggtgcgcttgatcacagagaagaaagagaatgctgcggccctggaggagctgctgaaagagtaccacagcaaacagctggtgcagacgagccacaggcctgtgtccaagctgccgccagcgcccccgaacgtgccacacatctgcccgcaccgccaccatctccacaccgtgcagggcctggcctcgctctctggcccctgctgctcccgctgtagccagaagaagtggcccgaggtgctgctgtcccctgaggctgtagccgccactactcctgttcccagccttctgcctaacccgaccagggttcccaaggccggggccaaggcagggcgtcagggcgagatcaccatcttgtctgtgggcaggttccgcgtggctcgaattcctgagcagcggacaagttcaatggtgtctgaggtgaagaccatcacggaggctgggccctcgtggggtgatctccctgactccccacagcctggcctcccccctgagcagcaggccctgctaggaagtggcggaagccgtacaaagtggctgaagcccccagcagagaacaaggccgaggagaaccgctatgtggtccggctaagtgagagcaacctggtcatctgaggggcggtctagtctaaggacactgcggccctgccctgggaggttccgaaggcttcctggaggaggtggagctgcagctgggactgtgaggaccgagaagcaatggcccagcagacgagacagcaaagaccaaggcctggaggtgggagcgtctgccccagtgaggaggcaggtggccggcgggcactgtgtacaggagcaggctgagccccgcccctggccctgctgccatgttgctcccctgaaggatgccccgacccccgtgcctgccctggctggatcctaggagcccacgggattctctgtatcatcagaggctgggcttggcagaggggaggggcctgtgcccgtcacccctggccccattccttggtaattagccacacccttgcctctgtacagggccctagagcagatgtgcgtccccctcctcttccagcaggtctataaagggaaggggtagcagaaagtcctgggctaggagagtgagtccctgggttctaatcttgggcacatctgtggccatcgctgggtccatttttctgactgtgaagtaaggagagacgtctcagtacccagggcctcttcagctctttgtaggttctgggctgggttgtgggggactggggagctgggctctaccatccctcccattagtagctttatccagccccgtttttgctgcttccagggcctctgccttcaaggcccccatggggctgtccatccatggctctgcctacggaaggggcttaatgcatgtgcctgcccctcccccagctgtttttaatgaaactgaaaaaatagacttgatcccggcaggactgtgatacagagccctagcctgcccagccagccccaagatctcaggagctttagggagaagacttggtggggctggagcacaccttgggcctcagtggtttctgtgtccctgtggtgccagtgcttctgggcagtgcaggcggctgccaggcccagccctgacttccactctggctcagcaacctggttatttatgtggggccgtgcaggcatgggcccactgcctgtccatcctgtttctcttatttattgaaactcaccattgccctatccttgtgtctccacccccttccatgtgttgaataataaaaggtgggaaagtgctgtcacgaggagctccttttctctgtgcccttcccagcttatccgcctgttccacttgtacctgtccagccctgccctgtgttgggcaccgtgacaggctgccctcccctcacagttcctgcacctcagcagccagggaagcagggcccagaggagacccatcaactcatctggttctcaccaaagcccctagctagaggcagggctgtcccacagaaatagtgtgagccacatatgtgactttaaattttctgacagtcacatttcaaaaagtaaaaagaagcaggtgaacttaatttttttttaacccagtctatccaaaatattttcatttcaatataaaatcagtataaaaagtgtgaatgagctgtttttgcttttgctttgaaatctggagtgtatcttacacatcttgattggaactcaaatatttcaagggctccatagccacgtggccagcagctaccacactggtcagcgcagcacctgaggaaatgcactgtgtggagcccgggaggtaattgggggtgaggaagatgtgcgggccagggaatgtgttccacagagagggacagcatgtgcaaaggctgagcaccaacacatagtggtcacctgggccttatgcccagggagcctccaaagcattcagctcctgcttggccagtgtggagaggaaaggagccacaggagcgggtgctacacccggcaagacagagcgtctccatctaaaattcctagggcaagcttccaacccggcccaagggccgcatgtggcccaggatatggctttgaatggggcctaacacaaattcataaactttcttaaaacattg

SEQ ID NO: 27806 - DNA, 2966 bp, Homo sapiens
gggtctgcgcaccttcccggcccagccggcgattcattcaaaaggcgcgcaggctgcgcggctgtccgggcgctcgccgagccgggccgcggcgccgagtcgaacggggagccgagctggagctgccgcggcgcagccaggccggcgaccaccaggggcctgaggatgaagccaagtctgctgtgccggcccctgtcctgcttccttatgctgctgccctggcctctcgccaccctgacatcaacaaccctttggcagtgcccacctggggaggagcccgacctggacccagggcagggcacattatgcaggccctgccccccaggcaccttctcagctgcatggggctccagcccatgccagccccatgcccgttgcagcctttggaggaggctggaggcccaggtgggcatggcaactcgagatacactctgtggagactgctggcctgggtggtttgggccttggggggttccccgcgttccatgtcaaccatgttcctgggcacctctgggtactcatggctgtgatgagtgggggcggcgggcccgacgtggcgtggaggtggcagcaggggccagcagcggtggtgagacacggcagcctgggaacggcacccgggcaggtggcccagaggagacagccgcccagtacgcggtcatcgccatcgtccctgtcttctgcctcatggggctgttgggcatcctggtgtgcaacctcctcaagcggaagggctaccactgcacggcgcacaaggaggtcgggcccggccctggaggtggaggcagtggaatcaaccctgcctaccggactgaggatgccaatgaggacaccattggggtcctggtgcgcttgatcacagagaagaaagagaatgctgcggccctggaggagctgctgaaagagtaccacagcaaacagctggtgcagacgagccacaggcctgtgtccaagctgccgccagcgcccccgaacgtgccacacatctgcccgcaccgccaccatctccacaccgtgcagggcctggcctcgctctctggcccctgctgctcccgctgtagccagaagaagtggcccgaggtgctgctgtcccctgaggctgtagccgccactactcctgttcccagccttctgcctaacccgaccagggttcccaaggccggggccaaggcagggcgtcagggcgagatcaccatcttgtctgtgggcaggttccgcgtggctcgaattcctgagcagcggacaagttcaatggtgtctgaggtgaagaccatcacggaggctgggccctcgtggggtgatctccctgactccccacagcctggcctcccccctgagcagcaggccctgctaggaagtggcggaagccgtacaaagtggctgaagcccccagcagagaacaaggccgaggagaaccgctatgtggtccggctaagtgagagcaacctggtcatctgaggggcggtctagtctaaggacactgcggccctgccctgggaggttccgaaggcttcctggaggaggtggagctgcagctgggactgtgaggaccgagaagcaatggcccagcagacgagacagcaaagaccaaggcctggaggtgggagcgtctgccccagtgaggaggcaggtggccggcgggcactgtgtacaggagcaggctgagccccgcccctggccctgctgccatgttgctcccctgaaggatgccccgacccccgtgcctgccctggctggatcctaggagcccacgggattctctgtatcatcagaggctgggcttggcagaggggaggggcctgtgcccgtcacccctggccccattccttggtaattagccacacccttgcctctgtacagggccctagagcagatgtgcgtccccctcctcttccagcaggtctataaagggaaggggtagcagaaagtcctgggctaggagagtgagtccctgggttctaatcttgggcacatctgtggccatcgctgggtccatttttctgactgtgaagtaaggagagacgtctcagtacccagggcctcttcagctctttgtaggttctgggctgggttgtgggggactggggagctgggctctaccatccctcccattagtagctttatccagccccgtttttgctgcttccagggcctctgccttcaaggcccccatggggctgtccatccatggctctgcctacggaaggggcttaatgcatgtgcctgcccctcccccagctgtttttaatgaaactgaaaaaatagacttgatcccggcaggactgtgatacagagccctagcctgcccagccagccccaagatctcaggagctttagggagaagacttggtggggctggagcacaccttgggcctcagtggtttctgtgtccctgtggtgccagtgcttctgggcagtgcaggcggctgccaggcccagccctgacttccactctggctcagcaacctggttatttatgtggggccgtgcaggcatgggcccactgcctgtccatcctgtttctcttatttattgaaactcaccattgccctatccttgtgtctccacccccttccatgtgttgaataataaaaggtgggaaagtgctgtcacgaggagctccttttctctgtgcccttcccagcttatccgcctgttccacttgtacctgtccagccctgccctgtgttgggcaccgtgacaggctgccctcccctcacagttcctgcacctcagcagccagggaagcagggcccagaggagacccatcaactcatctggttctcaccaaagcccctagctagaggcagggctgtcccacagaaatagtgtgagccacatatgtgactttaaattttctgacagtcacatttcaaaaagtaaaaagaagcaggtgaacttaatttttttttaacccagtctatccaaaatattttcatttcaatataaaatcagtataaaaagtg

SEQ ID NO: 27807 - DNA, 1114 bp, Homo sapiens
gggagactgctggcctgggtggtttgggccttggggggttccccgcgtcccatgccagccccatgcccgttgcagcctttggaggaggctggaggcccaggtgggcatggcaactcgagatacacttctggctcagcaacctggttatttatgtggggccgtgcaggcatgggcccactgcctgtccatcctgtttctcttatttattgaaactcaccattgccctatccttgtgtctccacccccttccatgtgttgaataataaaaggtgggaaagtgctgtcacgaggagctccttttctctgtgcccttcccagcttatccgcctgttccacttgtacctgtccagccctgccctgtgttgggcaccgtgacaggctgccctcccctcacagttcctgcacctcagcagccagggaagcagggcccagaggagacccatcaactcatctggttctcaccaaagcccctagctagaggcagggctgtcccacagaaatagtgtgagccacatatgtgactttaaattttctgacagtcacatttcaaaaagtaaaaagaagcaggtgaacttaatttttttttaacccagtctatccaaaatattttcatttcaatataaaatcagtataaaaagtgtgaatgagctgtttttgcttttgctttgaaatctggagtgtatcttacacatcttgattggaactcaaatatttcaagggctccatagccacgtggccagcagctaccacactggtcagcgcagcacctgaggaaatgcactgtgtggagcccgggaggtaattgggggtgaggaagatgtgcgggccagggaatgtgttccacagagagggacagcatgtgcaaaggctgagcaccaacacatagtggtcacctgggccttatgcccagggagcctccaaagcattcagctcctgcttggccagtgtggagaggaaaggagccacaggagcgggtgctacacccggcaagacagagcgtctccatctaaaattcctagggcaagcttccaacccggcccaagggccgcatgtggcccaggatatggctttgaatggggcctaacacaaattcataaactttcttaaaacattg

SEQ ID NO: 27808 - DNA, 2607 bp, Homo sapiens
gggtctgcgcaccttcccggcccagccggcgattcattcaaaaggcgcgcaggctgcgcggctgtccgggcgctcgccgagccgggccgcggcgccgagtcgaacggggagccgagctggagctgccgcggcgcagccaggccggcgaccaccaggggcctgaggatgaagccaagtctgctgtgccggcccctgtcctgcttccttatgctgctgccctggcctctcgccaccctgacatcaacaaccctttggcagtgcccacctggggaggagcccgacctggacccagggcagggcacattatgcaggccctgccccccaggcaccttctcagctgcatggggctccagcccatgccagccccatgcccgttgcagcctttggaggaggctggaggcccaggtgggcatggcaactcgagatacactctgtggagactgctggcctgggtggtttgggccttggggggttccccgcgttccatgtcaaccatgttcctgggcacctctgggtactcatggctgtgatgagtgggggcggcgggcccgacgtggcgtggaggtggcagcaggggccagcagcggtggtgagacacggcagcctgggaacggcacccgggcaggtggcccagaggagacagccgcccagtacgcggtcatcgccatcgtccctgtcttctgcctcatggggctgttgggcatcctggtgtgcaacctcctcaagcggaagggctaccactgcacggcgcacaaggaggtcgggcccggccctggaggtggaggcagtggaatcaaccctgcctaccggactgaggatgccaatgaggacaccattggggtcctggtgcgcttgatcacagagaagaaagagaatgctgcggccctggaggagctgctgaaagagtaccacagcaaacagctggtgcagacgagccacaggcctgtgtccaagctgccgccagcgcccccgaacgtgccacacatctgcccgcaccgccaccatctccacaccgtgcagggcctggcctcgctctctggcccctgctgctcccgctgtagccagaagaagtggcccgaggtgctgctgtcccctgaggctgtagccgccactactcctgttcccagccttctgcctaacccgaccagggttcccaaggccggggccaaggcagggcgtcagggcgagatcaccatcttgtctgtgggcaggttccgcgtggctcgaattcctgagcagcggacaagttcaatggtgtctgaggtgaagaccatcacggaggctgggccctcgtggggtgatctccctgactccccacagcctggcctcccccctgagcagcaggccctgctaggaagtggcggaagccgtacaaagtggctgaagcccccagcagagaacaaggccgaggagaaccgctatgtggtccggctaagtgagagcaacctggtcatctgaggggcggtctagtctaaggacactgcggccctgccctgggaggttccgaaggcttcctggaggaggtggagctgcagctgggactgtgaggaccgagaagcaatggcccagcagacgagacagcaaagaccaaggcctggaggtgggagcgtctgccccagtgaggaggcaggtggccggcgggcactgtgtacaggagcaggctgagccccgcccctggccctgctgccatgttgctcccctgaaggatgccccgacccccgtgcctgccctggctggatcctaggagcccacgggattctctgtatcatcagaggctgggcttggcagaggggaggggcctgtgcccgtcacccctggccccattccttggtaattagccacacccttgcctctgtacagggccctagagcagatgtgcgtccccctcctcttccagcaggtctataaagggaaggggtagcagaaagtcctgggctaggagagtgagtccctgggttctaatcttgggcacatctgtggccatcgctgggtccatttttctgactgtgaagtaaggagagacgtctcagtacccagggcctcttcagctctttgtaggttctgggctgggttgtgggggactggggagctgggctctaccatccctcccattagtagctttatccagccccgtttttgctgcttccagggcctctgccttcaaggcccccatggggctgtccatccatggctctgcctacggaaggggcttaatgcatgtgcctgcccctcccccagctgtttttaatgaaactgaaaaaatagacttgatcccggcaggactgtgatacagagccctagcctgcccagccagccccaagatctcaggagctttagggagaagacttggtggggctggagcacaccttgggcctcagtggtttctgtgtccctgtggtgccagtgcttctgggcagtgcaggcggctgccaggcccagccctgacttccactctggctcagcaacctggttatttatgtggggccgtgcaggcatgggcccactgcctgtccatcctgtttctcttatttattgaaactcaccattgccctatccttgtgtctccacccccttccatgtgttgaataataaaaggtgggaaagtgc

SEQ ID NO: 27809 - DNA, 485 bp, Homo sapiens
gggtctgcgcaccttcccggcccagccggcgattcattcaaaaggcgcgcaggctgcgcggctgtccgggcgctcgccgagccgggccgcggcgccgagtcgaacggggagccgagctggagctgccgcggcgcagccaggccggcgaccaccaggggcctgaggatgaagccaagtctgctgtgccggcccctgtcctgcttccttatgctgctgccctggcctctcgccaccctgacatcaacaaccctttggcagtgcccacctggggaggagcccgacctggacccagggcagggcacattatgcaggccctgccccccaggcaccttctcagctgcatggggctccagcccatgccagccccatgcccgttgcagcctttggaggaggctggaggcccaggtgggcatggcaactcgagatacactctgtggagactgctggcctgggtaagccaaagggagtgcggggagggctcctgg

SEQ ID NO: 27810 - DNA, 3261 bp, Homo sapiens
gggtctgcgcaccttcccggcccagccggcgattcattcaaaaggcgcgcaggctgcgcggctgtccgggcgctcgccgagccgggccgcggcgccgagtcgaacggggagccgagctggagctgccgcggcgcagccaggccggcgaccaccaggggcctgaggatgaagccaagtctgctgtgccggcccctgtcctgcttccttatgctgctgccctggcctctcgccaccctgacatcaacaaccctttggcagtgcccacctggggaggagcccgacctggacccagggcagggcacattatgcaggccctgccccccaggcaccttctcagctgcatggggctccagcccatgccagccccatgcccgttgcagcctttggaggaggctggaggcccaggtgggcatggcaactcgagatacactctgtggagactgctggcctgggaatcaaccctgcctaccggactgaggatgccaatgaggacaccattggggtcctggtgcgcttgatcacagagaagaaagagaatgctgcggccctggaggagctgctgaaagagtaccacagcaaacagctggtgcagacgagccacaggcctgtgtccaagtgagtgggctggtgggagataacggggccaaaacctacattaaccagcctgcctcctggggatctcccacttgggtctccctcaagtcaccctgttccctgctggggtctcctgcccctggcctggcctatggccacttctgcctgtgccccctgcaggctgccgccagcgcccccgaacgtgccacacatctgcccgcaccgccaccatctccacaccgtgcagggcctggcctcgctctctggcccctgctgctcccgctgtagccagaagaagtggcccgaggtgctgctgtcccctgaggctgtagccgccactactcctgttcccagccttctgcctaacccgaccagggttcccaaggccggggccaaggcagggcgtcagggcgagatcaccatcttgtctgtgggcaggttccgcgtggctcgaattcctgagcagcggacaagttcaatggtgtctgaggtgaagaccatcacggaggctgggccctcgtggggtgatctccctgactccccacagcctggcctcccccctgagcagcaggccctgctaggaagtggcggaagccgtacaaagtggctgaagcccccagcagagaacaaggccgaggagaaccgctatgtggtccggctaagtgagagcaacctggtcatctgaggggcggtctagtctaaggacactgcggccctgccctgggaggttccgaaggcttcctggaggaggtggagctgcagctgggactgtgaggaccgagaagcaatggcccagcagacgagacagcaaagaccaaggcctggaggtgggagcgtctgccccagtgaggaggcaggtggccggcgggcactgtgtacaggagcaggctgagccccgcccctggccctgctgccatgttgctcccctgaaggatgccccgacccccgtgcctgccctggctggatcctaggagcccacgggattctctgtatcatcagaggctgggcttggcagaggggaggggcctgtgcccgtcacccctggccccattccttggtaattagccacacccttgcctctgtacagggccctagagcagatgtgcgtccccctcctcttccagcaggtctataaagggaaggggtagcagaaagtcctgggctaggagagtgagtccctgggttctaatcttgggcacatctgtggccatcgctgggtccatttttctgactgtgaagtaaggagagacgtctcagtacccagggcctcttcagctctttgtaggttctgggctgggttgtgggggactggggagctgggctctaccatccctcccattagtagctttatccagccccgtttttgctgcttccagggcctctgccttcaaggcccccatggggctgtccatccatggctctgcctacggaaggggcttaatgcatgtgcctgcccctcccccagctgtttttaatgaaactgaaaaaatagacttgatcccggcaggactgtgatacagagccctagcctgcccagccagccccaagatctcaggagctttagggagaagacttggtggggctggagcacaccttgggcctcagtggtttctgtgtccctgtggtgccagtgcttctgggcagtgcaggcggctgccaggcccagccctgacttccactctggctcagcaacctggttatttatgtggggccgtgcaggcatgggcccactgcctgtccatcctgtttctcttatttattgaaactcaccattgccctatccttgtgtctccacccccttccatgtgttgaataataaaaggtgggaaagtgctgtcacgaggagctccttttctctgtgcccttcccagcttatccgcctgttccacttgtacctgtccagccctgccctgtgttgggcaccgtgacaggctgccctcccctcacagttcctgcacctcagcagccagggaagcagggcccagaggagacccatcaactcatctggttctcaccaaagcccctagctagaggcagggctgtcccacagaaatagtgtgagccacatatgtgactttaaattttctgacagtcacatttcaaaaagtaaaaagaagcaggtgaacttaatttttttttaacccagtctatccaaaatattttcatttcaatataaaatcagtataaaaagtgtgaatgagctgtttttgcttttgctttgaaatctggagtgtatcttacacatcttgattggaactcaaatatttcaagggctccatagccacgtggccagcagctaccacactggtcagcgcagcacctgaggaaatgcactgtgtggagcccgggaggtaattgggggtgaggaagatgtgcgggccagggaatgtgttccacagagagggacagcatgtgcaaaggctgagcaccaacacatagtggtcacctgggccttatgcccagggagcctccaaagcattcagctcctgcttggccagtgtggagaggaaaggagccacaggagcgggtgctacacccggcaagacagagcgtctccatctaaaattcctagggcaagcttccaacccggcccaagggccgcatgtggcccaggatatggctttgaatggggcctaacacaaattcataaactttcttaaaacattg

SEQ ID NO: 27811 - DNA, 1295 bp, Homo sapiens
cgcgtcctgtcccggcgccttccgcgcaccggccaccgccagtctccgagccccgtgacctgcaggtcctccggccgcgactccgggccggccctgcgtggtggctgtcggggggcgcgcggggaagcagcggaacttgcggtgtgaggggccggcggggcccggagcggtccccggcccgggaaacttggaccgagaccaggccggcgaccaccaggggcctgaggatgaagccaagtctgctgtgccggcccctgtcctgcttccttatgctgctgccctggcctctcgccaccctgacatcaacaaccctttggcagtgcccacctggggaggagcccgacctggacccagggcagggcacattatgcaggccctgccccccaggcaccttctcagctgcatggggctccagcccatgccagccccatgcccgttgcagcctttggaggaggctggaggcccaggtgggcatggcaactcgagatacactctgtggagactgctggcctgggtggtttgggccttggggggttccccgcgttccatgtcaaccatgttcggtggtgagacacggcagcctgggaacggcacccgggcaggtggcccagaggagacagccgcccagtacgcggtcatcgccatcgtccctgtcttctgcctgtccatcctgtttctcttatttattgaaactcaccattgccctatccttgtgtctccacccccttccatgtgttgaataataaaaggtgggaaagtgctgtcacgaggagctccttttctctgtgcccttcccagcttatccgcctgttccacttgtacctgtccagccctgccctgtgttgggcaccgtgacaggctgccctcccctcacagttcctgcacctcagcagccagggaagcagggcccagaggagacccatcaactcatctggttctcaccaaagcccctagctagaggcagggctgtcccacagaaatagtgtgagccacatatgtgactttaaattttctgacagtcacatttcaaaaagtaaaaagaagcaggtgaacttaatttttttttaacccagtctatccaaaatattttcatttcaatataaaatcagtataaaaagtgaaaacaaaaaaaaaaaaaaaaaaaaaaaaaaaaggggggcacaaatacggcggcggaaacagggctaaaaagggccatggcacaacgggtctcacaccaggttctggaccaagggggaaacacggcgaccccaatagagggcgcgaaaatgcgaaaacccgggttacccgtagag

SEQ ID NO: 27812 - DNA, 316 bp, Homo sapiens
cgacttcaaaagggctttttctaccagaatggacataatttaaataggacggtcagcttttagacaggcacaacactatatatacagatctcaagaaaaactggtgcttccttatgtcgttggttcatttaagaaatatttattgaatacctctttgtctctggtgcacatttttataaaattaccttgagccctagatcaaatgtcacctccctgtcaagcttttcccaaagctctcaggcagaatgactctttgaaaactatatgtaaataaatgtatttatttacccatctatagtttatcttgcctggtgtc

SEQ ID NO: 27813 - DNA, 413 bp, Homo sapiens
gaaaaacagcttagaaacttcaatctggtgaaagtatcattgacttacattgggttgtttcagccctgcatcagatcccaaagtaacaaataatcttaatgtaactactatttccatccaaccagttataagcatctcctaacccaaagaacacttccagatttttcttgctgctttatcagagttcaggttcactttgtcaaactttttacagttctaaaatagaaaacagaaccgatgccctatgtcttacaattaattgcatgcacttctgtttgttccaccaagtttctcgacagatacaatttctcccctttcgaaggtaagcagaaggggtcatgtattccttagtacatgctgtgataacagtccttgtctgtcatacacagtagggccgatgctaagacgaatct

SEQ ID NO: 27814 - DNA, 365 bp, Homo sapiens
cggctcactgcaagctccgcctcccaggttcatgccattctcctgcctcagcctcccgagtagctgggactacaggagcccgccaccaggcccggctaattttttgtattttcagtagagacggggtttcaccgtgttagccaggatggtgtttttgttttgttttgttttgggctaggtcttggacaaaaagtcaagtcactagggcaaatacgttaaatagtttatcagctggtgccacagttcaccggacctttttttttttttttgaaacaagatcttgctctgtcatccaggctgtagtgcagtagcaccatcacagctcactgcactccggcttgggcaacaagagcaaaacttggtgt

SEQ ID NO: 27815 - DNA, 394 bp, Homo sapiens
ccttgagtgacgcacccttcatgttgtagccttcaatgatgcacactccatgttatagccttgaatgatataccctttatgctgcagcctttctcttatggggaaaagcctgcagatatcctgctgcttaactgacaagtgtggtgagaaataagtagaaatctaaagaggggaagaccattttggacacttatctgcaaggcagatccaacacacttttccagtagtcaagctacttctaattttgttcagtatcaaaatgagaaacaggcctgattctccagcactcttgtcaacacaacttccccccatatttatatatatacacacacatatatatctttatatatatacacacatatatatctttatatatatatatttatatatatat

SEQ ID NO: 27816 - DNA, 460 bp, Homo sapiens
cagagagagattagcataaccatgtggtggaagatttatggacagaaaaaggaaagttatgtaacagaaaacagaaattaggtacagaaacagccagattggttacagcttggtgtttgcctcatttgagcctggtttgaacagttggccacctttggccaaaactcagtgattggcacaaaagtcggttgcagtctgtttacacatggaaaggttacagtttactgtgcacagagaaaccattaggtcacatttagaatatataaggaggcagcattgggctaaacttgacaattgcttatttttgaaaactcaaagcattttcaattaagtttacaataattaaacatcaaatacgtaagtttcaaattaacataattgtcttttggagaatagttactcaaaaatgtctattgagtatatactatgtgcagacattgtccttattgtttgagattct

SEQ ID NO: 27817 - DNA, 146 bp, Homo sapiens
tttattgtacagtcagttctataaaatttctcttttgagttttatacctttgtagcattttagatgacattgtgtttgtactttgttgtgtagagtggaagaattgtgttgaataaacccaagatcggaatgcaaatctaaaaaaa

SEQ ID NO: 27818 - DNA, 483 bp, Homo sapiens
cacagtcaccagttttccgagaagcacagggaggggtgcatgtcaggcccagccctgcctgctgataccacctcacagacgcaggcgaaatgtcttcaccagcttcttctcggttgccaagggggcctgctttcaaggggttgttttgtatggggtgtgggtgttaaccagggagaggttcctggcaggagttcctgtcagatgccattttccattctggttacttgaaccggggtcctttttcatcctctacctcaggggccagagcttcctcatcaccctgcaccccctagcaagggaggtgcccgctacacggtccaaagtcctctccagacattcgggccctgcccgccttgctggagggctcaggagttcaccaggtttgcttccagaagagccaggctggggatgcctgcttgcaaatgcagcaaataaaaaataaataaataaataaaaatcacctttctcccccccccacccaaa

SEQ ID NO: 27819 - DNA, 404 bp, Homo sapiens
tttgcctgcctgggaaacaggcatcctcggagggctgtgcctccttgagtgcggggcagggatgcagtggcaggtcatggaaagagattatggcttaaaatcactaaaggaggccgggcacagtggctcacacctgtaataccagcatttaggggggccaaggcgggtggatccgaggtcaggagttcgagaccagcctgacgaacacggtgaaaccccgactctactaaaaatacaaaaattagctgggtgtggtggtgcacacctaaaattcccgctactcaggaggctgaggcaggagaatcacttgaacctgggaggcggacgttccagtgagcagagatcatgccactgcactctaccctgggcaacagggtagacctgagacagcgagactccatctc

SEQ ID NO: 27820 - DNA, 623 bp, Homo sapiens
atgttatgtagcatcaagagaaatctagttaataggagattctcatgttactccttttcttaaaactctgtgtcacctcattatctacagaggtggaacttactgtgctgtaaaaggccctcattgctctagggtggaatgaatgggccaaaatgtattttgaggaattctgagcttcttcactgggctttggttgttgttgattttcaaaagggcattgctttcaaacaaatatatttatatacatacatacacacgtgtgtttgtgtgtgtgtgtggtgtgtgtggagaatctatatatatattttggagatggagtcttgctaggttgcccaggctggagtgctgtggctattcacaggcaaggtcatagtgccctacagcccggagctcctggatgcaagtgatcttcctgcctcagcctcccgagtagctcatactgcaggtgcacaccaccacatttgaccaaatgaatatatttttaaaaataaaaaatgcctcagttttgagactgggtatagtagtatgtgcctgtaatcccagctacttaggaggctgagataggaggatcggttgagtccagaagtttgagaccaacctgggaaacatagtgagactgtctc

SEQ ID NO: 27821 - DNA, 1439 bp, Homo sapiens
tgcaagttcagattagagaggccactttcccagaatccacagctgcactaagctaaggagaagccagatgccggttactgggtgtgcaggggctgttctgagctggggggatcattgtgaaggccttcttccctgggcacctggtacctggggacctacaaggtggtgagggaagggtacgagtacattccttttccctctgacctgggcgctagcaagggcaaagaacccgagcctgccagcttggcctcctcccacagcctccctcggaggcatgccatgccaagcactctttctgtctctgttcatgaataaaagagatggatgggcttattcttatagagaagtgaatttcacttactcccctggcccgaaaactagaccaaatgaggaactgttttagctcatcaaactcatatattcctcctggcttccttacaaaacaagcctttcaaacaatcattgtcctcaggaaagttgttgagcttcctccagctgtgagaataagtcctaatctccagagaaatggtggggggaggaggaggcttattgcttcccagcatttggggggaacatgatccaacccctggcctcctgccacccatctgccctgctcccacatgctcaggtcccagggcacagaaaaagggcagactccctaatcacactaacatcaaaataaagaggctgggccgctgtgtagccaggacatgcccatgccaccgcctattgaacagttcataggagtggcagtaatctactgtgtgaggagagagggcaattaaaaagctgaaagagaaggaggccctctgtgtattccgttccctcctccttaatgcctccaagggtccttgcatccctagtctcctaaactccagctctgattcgccatcaacccatggagcaattccaaggccccagttacccatcacctccacaccaggtcaagttttgtctcagccccaaaggcactgacatttctagtttgccccctctgccctgaaccccacagcatgcctgtctcagctccctgtccctcggcacttccccaggctcatttgagcaggtgtgccttcgcagctcccctaaacttcccaggtgcctcatccataatgagataatgcatgtaggggaaaagtttctcaagaaggtggaagaggcagcaggacttggataaggagtacctgctggtcagccttgagatgcacaggtgaaggttagggtgagatgagaacatgccataccctggtgctgaatccctgaggggccagcttgccaggcttaagccaaatctgccttaaattgggggtggggaggggtaagtaaggaagtggggtttgtttttgtgttgttttcatcttcatctttgtattactagcatccagcagagtgcctagcacatactggatgctcaataaacttttgatgaaatgaaatga

SEQ ID NO: 27822 - DNA, 1022 bp, Homo sapiens
gatgaccccctccagcagctttggtgctgatgggaataagtcgacctgcagcggaagttcagcccaagtctcagcccagcagcctccccaaacctggccagggtctggtcatgctgccgtctctgcggttctctgtggagttgtggtttctgtaccttgaagagaacttccccttctgggacccagaaacccagtgaaccctcaggaaaaaagggaatgaaattactgaagacaactctgtggcagggagagggaaaagaggctctttgtttttgttttttattttttatttttttattttttgagacagagcttcactcttgttgcccagactggattgtagtggctcgatctcggctcactgcaacctctgcctcccatgttcaagcacttctcgtgcctccgcctccagagtagctgggacaataggcacacaccaccacacccagctaatttttgtatttgtagtagagatggggttttgccatgttgcccaggctggtctcgaactcctggcctcaagtaatccacctgccttggcctcccaaagtgctgggactacagatgtgggccaccgtgcccagccctcactgtatggattttctaaaaaaaaaaaaagattacatttgtcttacttacgttactcctctcctctcctttttaaagagtatttccttgataaaccttgtaatataaataacttcttttgtgcctttgatatgtacctaaatcttttaaaaaggtaaatgaacttcttgccaacattacaacccaggattttttttttttgagacagaatctcgctgtcacccaggctggagtgcaggggtataatctcggctcactgcaacctccacttcccaggttcaagcaattctcccatctcaacctcctgagtagctgagactacaggcgtctgccaccacgcctggctaatttttgtatttttagtagagacagggtttcaccttgttggtctggctggtcttgaactcctgacctcaggtgatccaccagcctcg

SEQ ID NO: 27823 - DNA, 171 bp, Homo sapiens
caaaatcgtttgctctctctttcctagttaacaggctttcaaatattagaagatcaatgttctgaccccattgaaatttctcttttgtggaatgaaaagctctgatttaacccatcttcaagcctggtttgcatattcctctcgaactcgtggcctcaggtgatcagcccg

SEQ ID NO: 27824 - DNA, 816 bp, Homo sapiens
caaaatcgtttgctctctctttcctagttaacaggctttcaaatattagaagatcaatgttctgaccccattgaaatttctcttttgtggaatgaaaagctctgatttaacccatcttcaagcctggtttgcatattcctctctcttccggccatcttgtctagacacactacactgaggccgtgcccatcgtaaatgatgttgatacgttgtcaaaaaattggcaaaccaggcgcggtggctcatgcctgtaatcctaccactttaagaagcagaggcagacagatcaccagaggtctcgaactcctggcctcaagtaatccacctgccttggcctcccaaagtgctgggactacagatgtgggccaccgtgcccagccctcactgtatggattttctaaaaaaaaaaaaagattacatttgtcttacttacgttactcctctcctctcctttttaaagagtatttccttgataaaccttgtaatataaataacttcttttgtgcctttgatatgtacctaaatcttttaaaaaggtaaatgaacttcttgccaacattacaacccaggattttttttttttgagacagaatctcgctgtcacccaggctggagtgcaggggtataatctcggctcactgcaacctccacttcccaggttcaagcaattctcccatctcaacctcctgagtagctgagactacaggcgtctgccaccacgcctggctaatttttgtatttttagtagagacagggtttcaccttgttggtctggctggtcttgaactcctgacctcaggtgatccaccagcctcg

SEQ ID NO: 27825 - DNA, 335 bp, Homo sapiens
caacacggtgaaaccctgtctttactaaaaatacaaaatgagccaggcatgatggggcatgcctgtgatcccagctacttgggaggctgaggcaggagaatcgcttgaacctgggaggtggaggttgcagtgagccgagactgtgccattgcactccagcctgggcaactagagcaaaactctgtcctaaaaaaaaaaaacaaaaaaaaaaaacaattatatatcaacaaaaaaaagaaaattttaaaaagtaacaatttgaaaaagtcaaataggcaatcaaaagtattcctttcaccagccactaaaaaggcacctgtacatgggaatggtag

SEQ ID NO: 27826 - DNA, 674 bp, Homo sapiens
ctggagtgcagtgctgcaatcacagctcactacagcttctaactcctgggctcaagtcatcatcccagctcagactctcgagtaactaggactataggttttatgaaaatctttacaacctatgcctgacctttgtgtaacgtaagacggggaaaggaaagatgtgcttcccctctgatcaatttaataaagacaacttagaattaagtaggtctgtttgcttatgagaagtgtaattctcagaagactagtgtcagttttaaatttgtgaaccggcaatcaagatccattttaagtcttgttttgtttttcttttctttctttttggacagtaatgaatgacaaacaaacatgttatttatttccaaacaatactggatgtagaagccaaatgtggtttttccttctctgggggtattcctaatgttgatataaaagtacaggctgggtgtggtggctcctgcctgtaatcccagagctttgggaggctgagcggggaggactgctagagggcaggagttcaagaccatcctgggcaacatagggagaccctgtctctaaaaacataaaataaaaaaaaaggaatacttcaaaaataaagtacattttcttcagcaaaatataaataaaacaatagcaccgtggtatagtagaaaagaaagaacgctggactc

SEQ ID NO: 27827 - DNA, 672 bp, Homo sapiens
ttcaaatacttgatggatacatgtggctagtggctaacataagggatagcacagatataaaacatttgctcgtcatataaagttctattggatagtgctggtctgtagcttataggatggtatcttagtctgcttcagctgctaaaacagaataccataaattaggtagcttaaacagtagatattttgaccaggcgtggtggcttatgcctgtattcccaaagtgctgggattacaggcatgagccaccgcgccgggcctatcatatgaattttgagggaacacaaacatgcagtctgtagcagatggtaataggctgacatattacacttgttgatgtaaatctgataggtttctttctctccaaggacagctttttaaatatttaacagtatcaataatttttcaggttctgtgagaattttataatttataatttgcagacttaatgtataatctattttgtcctaacaattacaaatatattttttatttcagattgtatatattcctaccagatggagataattacagctttaaaaatttttattttttcattttatttcacacattgacattaaatttttatggacacataataactgtacatatatatggggtagaatgtgatgttttaatacatgtactcaatgtgtaatgatcaaatcaggg

SEQ ID NO: 27828 - DNA, 476 bp, Homo sapiens
acatgaaggaatctcagtattgaggaatttgtaccagaaacctcgaagacctccttagcctacagtccaatcatggagtgtgtgtgtgtgtgtgtgtgtgtgtgtgtgtgttatacagtctattttgttttgtgcacatagttttaattgttttacctgtaaagtttcttctgtgtacttcccaattttagcgggtacttttaataatgaactagacctagaggttgggcgggtaactttcttggacaagataaacctggggagctgtagagtttaatggggacataccaactctgagactttcgcagacacaaaattgtctaacacttttaaattctttttaattctttaaggagttttctttttattttcagcaagtagaatatgtgctctttggcactgttcttactattctttcttctttggcattgtttgtacttgcaatatcatagtattcagtaagtaaagaagatgga

SEQ ID NO: 27829 - DNA, 532 bp, Homo sapiens
aagatgttggaaaagcttcagagaccaaaaaagaaaagctaaaggtatttaatttggtcatatcaacatgactgtgtcatttatatcaggcacttacccataggccctatagaaacaagcatgagtattattaaaagcattcatagacctccagtaaactttatttggttttaactctaaaccctaagtatgtttttttcatagttgattcttcttctaataacattcattaaccagaatttatggtatttattttggctaatatttactgagctcttgccatatgacaggcactgtgtaaacactttaattgatatctaatttaatcttcaccacgatctttgaagtagaaatcattgatattcttattttgtagattagggaatcaaggcacaaaaaggttaatcaactcacccaggttacactacatgaaacagggatagcgaggaccagtactcaagcaatcgccagatcacaactttaaatctttcatgatcactctaacttcagccctgaatgtgcagagataaga

SEQ ID NO: 27830 - DNA, 517 bp, Homo sapiens
cggtaaagggctaatagctaaaactgtggattgtgtctagattctttacctaacccaatggtttgctggcatttaggttagtgtctttataaagagctagctctcattgggagagttgagccagagcaaccatagtaaacatagcttactgataatagcaattacgtagggataagataacattctctcacttacctaaattttaatgtgtcctgttacataggttaatttgtgcttggaaatgaattttagttaagtgagaaatacctgttgtttgctttctgacattatagtaatatgtacagagaataatttaaaattataatttatgggtctttaaaaggttttgttcctaacaacatttataaaaatttattgtactattgtaaagttttttatatatgggtttttttccagcctcaaattcttttgtgacttggaagagtattatggacagaagcttgggtactgcttaaaatttatgtttttagaagtagaacttttatttaaaaaaaaa

SEQ ID NO: 27831 - DNA, 917 bp, Homo sapiens
tggttgtttactttctgctcagggcttgctatttcagcaacactaaactgcctgcaatgaccacaggttgttaccctctactattgttgactggagtcacctcccgttgttaatgtctgttgttattgtctgggccattccttgctgttacttgcctcattgactttgcatttcctttccttagaaggctacatctctcttctatgccctgctcagttaacttgtttgttctggaagactgcttttgaaatggtcttccccaggaagacttttctgactttaccctttcctcttcctcttaatctttgtttcaactaactgattctcagtagttgattgagagtatgtccagagaaggggattgtgtagctgtagtgtccaatacagtgtctgatatgcagtaggcagtaaatgtttattgactgtattaacagattaaggtactcccaaattgtgatacttttgtcaatgaaaagtgtcaaactctaaaatattctaagagatttattctgagctaaatgtgagtgaccatggctcatgacacagccccaggagatcctgagaaaatgtgcccaaggtggtcgggctacagcttggttttatacattttagggagacctaagccatcactcagtacatgtaagatgtacattgatttggtctggaaagctgggacaactcgaagggtgaggggggcggtcttccaagtcacaggtggattcaaagatttgctgactggcaattgggtgagagttcatttaaatccctggaatcagtagaatggagtgtctaggttaagataggggtgtggaggctgggcacagtggcacgcgcctgtaatcccagcactttgggaggctgaggcgggtggatcacaagctcaggagatcgacatcattctggctaacatggtgaaa

SEQ ID NO: 27832 - DNA, 399 bp, Homo sapiens
cataactgtcacatcaaaaaagaaatcaaagagaaatcagaaagtactttgaaatgaataaaaatgaagacacagtataagagaatttaagagatgcatctaaagcaaacttagagggagaaggggagaattatagctctaaatgcctatattaagaaagaaatctcaaataagtagcctagccttctactgtaagacactcaaaaaagaagagtaaaccaaactcaaaggaagcagaagaaaggaaataataaagattagagaagaagttgatgaaatgaaattaattaaataatactaaaacagtagagaaaaatcaatgaaaccaaaaactagtcctttgaaaataacaaaattgagaaattttagctagattgaccaagaagaaaaagagaagac

SEQ ID NO: 27833 - DNA, 286 bp, Homo sapiens
actggtatgattttccagaacaagtgctccacaacataaatatcataataccatattaaactaaactaaaaccacaacataataccataatcccaccagaatggctaaaacttgaaagatagataataccaagtttgggcaaggatagagcaactaaaaatctcacactgctggtaagatgtaactggtacaaatgcttgggaaaattatttggcaatatctactaaagctgaacataacctacaacccagcacttaattccacttctaagtacctacctcagaga

SEQ ID NO: 27834 - DNA, 399 bp, Homo sapiens
gaaaaaaaaattgactctaggaaacaaaacatcttatttaccaaaaacgtactcaagtcatgtatactaagaggcatttgagttactttttatttttctgaggagatatttaatttaggccaggagcagtggctcacgcctgtaatcccagcactttgggaggccgaggtgggtggatcacaaggtcagaagatcgagaccatcgtggctaacacggtgaaaccccgtctctactaaaaatagaaacaattagccgggtgttgtggcgggcgcctgtaagtcccagctactcgggaggctgaggcaggagaatggcatcaacccgggaggtggagcttgcagtgagctgagatcacgccactgcactccagcctgggcgacagagcgagactctgtctc

SEQ ID NO: 27835 - DNA, 614 bp, Homo sapiens
caacttctgggctcaagcagtcttcccacctcagcctcccaagtagctgggactccaggtataagccagtgcattattgaacccatctgctccacgtgtctggactggggcacctcagcagccagtgtttctctccagaacactggaaagcacagtacccaccgaagcctgtggagcaggcactctacacagatgagaataccacagctccaagagatactgcagaaagaggttagggaacttcccggggatgcacaggtactaagaggcctgtctgatgtcattgcatcttcctgcggatgctgtgacctttgccccgtcttcgtgtccttgatttctctatagaggctgatccagaaccttctgccttctgaagctgcgtccagtcttttccctttcgtggtgcctggcccttctccggcctcctcagccagccttcccatcttcctcatgagctcttcttcctaaagatcttgtattctattactcagaggtcagcagtcgcttctgactttttagtatgaaaaaaatcaatgtcttttgagcaatccattctagacttatatataaaatgaaggtgtatttgtgctgtgtctaaaagggaacccattctc

SEQ ID NO: 27836 - DNA, 446 bp, Homo sapiens
taatttttttatttttagtagagacggagtttcaccatgttggtcaggctggtcttgaactcttgacctcaggtgatccacccgcctcggcctcccaaaagtgctgggattaaaggcgtgagccactgcgcccggcctacctcctgtcttatatctgagatatccagaggacccttgagaccttctccccagaaccttcacctccttggagtccaaggtcgactgttaacaggctgtacaggttataattagtacctgcttgttcctgccagaactttgagacgccaggtttacgacgtgcctgtgagaagccgggcatccagcctaggaactgccttttgtcccgctgctctctatggatcccaacctgaaggggctaccctcaggagtgagtgataccttgcagacgcgtaggtgtcctcttgagtccccagacctcagcacca

SEQ ID NO: 27837 - DNA, 1272 bp, Homo sapiens
tataagctacccacgtacttggtgctttaccccaacccttccaacagtgctgtgaggttggtattatttcattttttagatgagaaaatgggagctcagagaggttatatatttaagttggtgcaaaagtaattgcaagttttgccaccgaaaggaatggcaaaaccacaattatttttgaaccaacctaataatttaccgtaagtcctacatttagtatcaagctagagactgaatttgaactcaactctgtccaactccaaaattcatgtgctttttccttctaggcctttcataccaaactaatagtagtttatattctcttccaacaaatgcatattggattaaattgactagaatggaatctggaatatagttcttctggatggctccaaaacacatgtttttcttcccccgtcttcctcctcctcttcatgctcagtgttttatatatgtagtatacagttaaaatatacttgttgctggtactggcagcttatattttctctcttttttcatggattaaccttgcttgagggctttaacaattgtattactttttcaaagaactaagctttagcttcattgatttttttctatttaattgggttttgctcttctctttagcattggaaacatagaaatgctttctgatttctttgggtagatttacgtattcagcttcttgagatggaagtttagatcactgatccttcagcttgttttcttttttgtatacatagattttaggacgatatattttcccttgagttctgctttagctgcagctcttatgttttgatatgcctctctttattatccttcagttaaaaatatctttcaattcattgttatataaaaatatgtgcctagtttttaacatctggagattttctagttttgaaaaaaacataagccaggcatggtggctcacacctgtatccccagcactttgggaggccgagacgggaggatcgcctgagctcaggagtttttacaccagcctgggaataacagtgagacattatctccaaaaaaaattacctgggtatggtgttgtgcacctgtagtcccagctactctggagactgaggtgggaggattgtttgagcttgggaggttgaggctgcagggagctgtgatcacaccactgcactctggcctgagtgacagattgagaccctgtctcaataaaagcaaaaataaagaaaataaaccatatgtgttgaacaaagaattaataaattaatttgagactccttcagggaatga

SEQ ID NO: 27838 - DNA, 111 bp, Homo sapiens
tcatttccctctcttccctctctcatttactgtgtgctaactggggctaatactcaaaatgcttaacaatgtagatggcactggccaatcaaaatggattctggccataaa

SEQ ID NO: 27839 - DNA, 312 bp, Homo sapiens
ttttgagatggagtctcactgtcacccaggctggagtgtagtgctgcgatcctgactcgctgcaacctccacctctggagttcaggtgattctcctgcctcagccttccgagtacctgggaatacaggaatgcaccaccatgcccggcgaatttttctattttcagtagagacggagttttgccatgttggccaggctggtctcgaactcctgaactcaggtgatccacccgcctcagtctcccaatagattacatatattattaatgaattgcttcctttaacaccctattcattgaattttccagtaaac

SEQ ID NO: 27840 - DNA, 406 bp, Homo sapiens
ggagttgaaggccagcctggccaacatggtgtactaaaaatacaaaaattagcggtgatgggcgcctgtaatcccagctacttaggaggctgaggcaagagaatcgctcgaaaccgggaggcagaggctgcagtgagctgagactgcaccactgcactccagcctgggagacagagtgagactctgtcttaaaaaaaaaaaagagagcgagagagacaagtaaattatactgaaagaagtagagttttaaccatgactgtcttctaagcaacggtcaaacaaattacaagcatagagacaagagagatactatgacacttatagctgcaaatggctcttcactctacagagcctctcaataaagctttttatttttctagccaggcatggtggcacatgcctctgg

SEQ ID NO: 27841 - DNA, 486 bp, Homo sapiens
ataagtcctgacctggcatggtggatcacacctataatcctaacacattgggaggctgaggcagatggatcacttgtgcccaggagttcaagcctgggcaacatggcaaaaccctgtctctacaaaaataaaaataataataagctggcatggtggtgtgtgcctggagtcccagctacttgagaggctgaggtgggaggatcacttgagcctgggaggcagaggctgctgtgagctgataaaagaagaaatgatgagtcctatacaaaatgttaggaacacattctcaaagtccagccataacttgactatcacttgggtgaaataagtttgttacctttccacagtacccaatatttccaatattactcatctgttgtagcactttcttacttaagtccaggttaaatgctttttttaagttacgttaaatataactttggagagcagactctaattctccatacaaaagggaaacctgtagaa

SEQ ID NO: 27842 - DNA, 690 bp, Homo sapiens
tctgaagatgtattaggaattagtaatttgggtattggcaactttcatggttctgtgagaagaggccctaaattgaattgatttggatgggtggagggggacatttttcatttttgtcttacacttactgcttttctcaaaagtgacacattttaattaaattcttgattcaagataatagcatgaggaacttgtctgtcatccatagttacagtctcctttcttgacttatcatagtagctaataaagcaattccaattttagtatgcttataattgttccttggaataacagaacagtaaaaagaacaacagaacattgctgatgatgccagcttagtatccataagtttttccatttatggaaagcaaaggtagcttcagagatatgtttgcaatcccagttcagtttttaatttttctttttctttttggataagttgggaagtcttgttctataatataatgttataaaataggttcatgtaaagctaccaaccttaataggatcttttaatgttcatacagttaacatctcttctttaaaataatctcttattggtgggattagtattcaatggggaattcctcactaatttttggatattattataaaaagcatgtctccaaatagagataatgggctaaggatatgaacaggcatttcacagagaagtacattcaaatgacc

SEQ ID NO: 27843 - DNA, 558 bp, Homo sapiens
atcaatccagaggcacttcctcctccaagaagcaccaggtctaagtaaataaagctcctttggagggttccagcacaatccctccccactgggaacttcacacagagaaacctgactggcctttctagagccctctactgcgtcaggcatagccctgggcctggtgagtggcaggtggcctttcttccccacctgcctaaggaagtcagccgaacaggtcctcccactgctggggcccctgggctctcaaggaaactgagtcaggtaaaactagatcagagatgggcatgtggggccatcacctgaactgccgtggctgcgccgcggacgggcccagaagaccgagggctcctgacatcttcccaagtggaccctgcgggagctgcgcttcagaatcgttgctcacaacacagggcaggtctcgagtctgaggccccaccgcacccatgggtgcccccttctgtcatctgctcattgaaccgcggggctgctgtgactgtgagagctgctgccccgtgtgctgcctgctggcccggcccacccagtggggccatcaga

SEQ ID NO: 27844 - DNA, 443 bp, Homo sapiens
atgtggaccgggtcgacggaaggaatgaatgcggtcaggacgctggctggagaatgtctgagatggccacttgcagagaggagcaggctggctgcgtctctcactgtgcctgggatggtcgctgacagaggaaacggataccacataagagtcagagacacccaatgaagaaacaaaagcagtttacaggatgaaaagtacacagacacggacactcagaagaatgtggccaagggaccgccactgtgtatgcactgaagaggttccctaagaatgcggccacgggactactgccatgtacacactgaagacgttccctaagtatgcggccaagggaccaccgccatgtacacactgaagacattccctaagactgtggccaagggacctccaccatgtacacactgaagacgctcccaaagaatgcagccaaaggacggcac

SEQ ID NO: 27845 - DNA, 439 bp, Homo sapiens
gataacaagcttttggaagagttacagtatttgtccagcagtgaggggcaaaacataagggtcttcacagacttttccttcagctcgtagttgtcattaaacatgtaactctgtctattgtggtggcaggtttcttcacaatctcttagggtagttttgagtattccagaaaataacccacgtaagatacctggcacacacttggcacctaggctgagatcagtattagtaccttgctttcattttctccctataacctagaaccatttcaggaaaagcagaatgccattgagcagtttattttctttgaatgttcttactgcccttttctatactccggtatcatgagatcgtgacattcgttcactcattcactaacagttcactgttcccttgtgagttggaacagaaaagtggtggaagcagtgacttagtcctt

SEQ ID NO: 27846 - DNA, 462 bp, Homo sapiens
atagacggtgctatggaaatggaagtagttggggtgacaaaaaataaaaacgcaaaatgttatacggaatttacataacaacatggaggttcaaatcacagaagaggtactgtgacagcacatgacattgctaaatcaatgatagagatgatgatgccatataaattcaaagatggggccaggcgtggtggctcatgcctgtaattccagcactttgggagggcgatgcaggcagatctcctgaggtcaggagtttgagaccagcctggccaacatggtgaaaccctgtctctactaaaaatacaaaacaattagcggggtgtggtggtgcacacctgtagtcccagttacttgggaggcttaggcaggagaattgcttgaacccaggaggcggcagttgcagtgagctgagatcacaccactgcacccagcctgggcgacagagtgagactctgtctcaaa

SEQ ID NO: 27847 - DNA, 382 bp, Homo sapiens
aaggtttttttggtgggagaagtatagcaaatgtaactgcaattcacacaggttctctcaactttttcaataaaaccgattctagactctagagcagaagggtaagttattttctcctccttcaaacacccagtcctggaagtccccaacctgtagttgtcatggggacccaataagagacattctgtctcctattctcttcatacttcctccgacggaccggaatgcaagttcctccttctcttttcccactcagttttccaatagtgacctcagctccaatgcgctgactcctccagtctccggggctctggatcttctccctcaacattcgtttcctctcagagttcgtaccccaagccccttcgtccgagttccatta

SEQ ID NO: 27848 - DNA, 415 bp, Homo sapiens
caaatctggaggcatgcactacctgatttcaaactatactataaggccatagtcaccaaaacaacatggtactggttgaaaaacaggcatatagaccaatggaacagaacagagaagccagaaataaaccccaaaacttacagccaactgatcttcaacaaagcaaacaaaaacataaagtggggaaaggacatcactttcagcaaatgttgctggtataattggcaagccacatgtgggagaatgaaactggatcctcatctctcaccttatacaaaaatcaacgccaaacgaattaaggacttaaacctaagaactaaactataaaaattctagaagataatgttggaaaaatccttctagacattgggttaggcaaagatttcatgacaaagaacccaaaagcaaatgcaat

SEQ ID NO: 27849 - DNA, 537 bp, Homo sapiens
agccttgatcttttttatcttttattgcttttccttgactaagagaatttggttttggtaaagctaaatgaatttagaataaagtcatttatttgtgtcatacgtaagcttgattaagaaggtttttatggccaagagccatggctcatgcctgtaatcccagcactttgagaagctgaggcaggaggatcacatgagtcttggagttcaaaaccagcctgggcaacatagtgagatcttgtctctacaaaaaataaaaataaaaaaaatagcaaggcatagtggcctggcattgcactccggtgatcacaccattgcactccagccctgggtgacagagtgagatcctgtctcaaaaaaacaaaggaagattttttttttttctatttagaaagagagtgcataaaagagaaaccataggcagggacagtacctcatgcctgtaatctcagcactttggcagggcaaggcaagcggatcgcttgagtctaggagtttgagagaagcctgggcaacatagagagacctcatctctcc

SEQ ID NO: 27850 - DNA, 258 bp, Homo sapiens
ggcagagagttttcttttggggtgatgaaatgttttggaactagatagaggtggtgtttgcacaacattgcaaatggactaaacgtcattgagagagttaattttacattatgtggatttcaacttactaaaaatgaatgccagagtggcagctgagcctcctcactccacacccaccctcctctgcatcctgcagataggcccttcacccttatggtctgcaagactgagagagacatgccttctccatacctgtca

SEQ ID NO: 27851 - DNA, 482 bp, Homo sapiens
gtcccctcattgtgatttctgctgccactgtctcgaacattcttcaggaagactgttttgctttaaaacttcaggcccagcagagacatgcaccccgtactgtgttcctagtacagttaagactctctacagatataccaacccatgaggaagatagatggaggtgaatacagattgtatgtagatcatataggggtctaatcgtgtatggagcagtaaaggatatatatgttataaaacatgggatccagatctctatagctttttaaatatccaaggactgatcagtactttggcagacaactctgattataattgaaaaccatcattgtatacatgaagaactctttcttctaaccacagagtgccatgtttataatctgattaagaaatagtcttctgcatatagccaagatgaagactcctactaggtaaaggcaaccttgaactgtctactcaaataaacactatcaaaaatgtac

SEQ ID NO: 27852 - DNA, 535 bp, Homo sapiens
ggaaacacaaaaccacagaattgtaaagcaaaaaactccacctaatcttccttaaatttatagacttttaatctgtggcatttcatttctgacagtctgaagtcccatgacacaatgtcatgtccattgtgaataaaggtaaaagaattcagtctctttcttccttcctaatagaagctccaaatgctggagcatagagcatacagcagtttgccttccttgttagagccgatttacatagagccgatttacagctcaacaagctgtgcagattgagttaatacctagaactgtcatgggtttttatattgctgctttgtagagttgtcacagttgacgggcccttgtgatctttgaacgtcctgctgagtctagctatgaccacgttgctaaacgtaaagctctaggtgccacacacaccacaaagagtgcttttctcactttgatttccttcccatgacatctgtcccctaacctcattatttcttgaaattttgttatattcccacacatctattatagtatgtaaaatttt

SEQ ID NO: 27853 - DNA, 742 bp, Homo sapiens
gaggtttgtgcccagttggggcacctactttacccttgtgcatatcccctatttatctgtgcccaggacattttgcgtgggctacgtgtagaggtggtggccatacatagttatctttattctggcataaatcagatgtcacgttctcttttgccatatgtaataatcaagagtacccaaaagtgggtcttgaaatataattgtttctgagaggaacttattctcaggatatttttgtaagagggacaaaactacttaacagtgtgtatccttgcaataagtatattaatgaatacgatacaaccattttatacaggcaaaagatggtttaatgccaaagcacaaactcataaacccagttgatgaggagccagaacaatggtcattactgtatagagatgttttaaaaagtcaccatataagctttgaaataattctaatgaaaattatatgaccttgaggctgggcgcggtggctcatgcctgtaatcccagcactttgggaggccgaggtgggtggatcacaaggtcaggagatcgagaccatcctggccaacatggtgaaaccctgtcactactaaaatacaaaaaattagccgggcatgatggtgcatgcctgtagtcccagcttcttgggaggctgaggtgggggaatcgcttgaacctgggaggcagagattgcagcgagccgagatcacgccactgcactccagcctgacgacagagtgagactccgtctcaaa

SEQ ID NO: 27854 - DNA, 939 bp, Homo sapiens
gattatttgatagtaaagctttaaccttttatagagaactttgatttagagtaattttttggtcttatatattctttcctaaatttagaccttaaatcatacatgtgcatcttttgcacatggctgtgcagtttggatttttgcatgggacttatgaatagtcagctaataaaataagagtaaccttaatgccaaaatctatacaaatgagcagaggaaagaaagggcagtataaattatgtgtaagactttctaagtccagctctatgagcaagtcatgaaaatgaggcacttatgtgctcaaagcaagaaatagagggagaagaaataaattggtactgtgaagaggtacctaatccttcttaatatctaattttttatgggacatatcgtggttgaatacagatttcctgtggataagaagtcagatgggagtggtttgttttattctttgtattaacaagtatagggggtgatttttaattacgacatattgtttgactgaaaatgttttgttgtgactcagttctttttttttctcctagtactgtgaatatatgcctgatgttgctaaatgtagacaatggttagagaagaattttccaaatgaatttgcaaaacttactgtaggtatgaacattttttttcttgcattaaacttctgtacctgagacaaatgcatgtatggcattattctaaagataggaaagtcctcctttagtaggatattacagaattaacatttatctgttagctgtttaagttctctctgagataggataggtctgaatatcaactttcttacataaaaaagtaaatgggccgggcgcagtggctcacacctataatcctagcagtttgggaggctgaggcaggcggatcacaaggtcaggagatcaagatcatcttggctaacacagtgaaaccccatctctacta

SEQ ID NO: 27855 - DNA, 2488 bp, Homo sapiens
agcggtttgtctcgcgggagcgctgctggcggtcgggcgctcgggcggccctggccggggagacgagttgcatgtgttggttcagctggcgatagcggcgggagcggagccggcggggcctgtgcgaccgcctgggtttgtgaaatggctgctgacatttctgaatccagcggggctgactgcaaaggagacccaaggaacagtgccaagttagatgccgattacccacttcgagtcctttattgtggagtctgttcattaccaacagagtactgtgaatatatgcctgatgttgctaaatgtagacaatggttagagaagaattttccaaatgaatttgcaaaacttactgtagaaaattcacccaaacaagaagctggaattagtgagggtcaaggaacagcaggggaagaagaggagaagaaaaaacagaagagaggtggaaggggtcaaataaaacaaaaaaagaagaccgtaccacaaaaggttactatagccaaaattcccagagcaaagaagaaatatgtgacaagagtatgtggccttgcaacttttgaaattgatcttaaagaagcacaaagattttttgctcaaaaattctcctgtggtgcctcagtaacaggggaggatgaaattatcattcagggagattttacagatgacataattgatgtcattcaggaaaaatggccagaggtagatgatgacagcatcgaagatcttggagaagtaaagaagtgaatttgaaaatttgtctgtatttaatggcctgaactgagagttgatatggccaaagggagagaggccttttaaaatatatatatatatacacatatatatgtatatatacacatatatgtatgtatacacatatacacatgtatatatacatgtgtgtatgtatacatgtatatacatatatacatacacatatatgtatacatatatacacatatatgtatacatatatacacatatatgtatacatatatatatattctacagtaaaactgtagactgtcctcgtccttggcattttcactgttctgtacaaggctgcttgtttttttattgccaaagtcaaataaacgggagactgtcatgctcatgcatgaatagaatttagtcaaataaaaaattttggtcatttggtactgactttctctctctctctctctctcttttttttttttgacagagtctcgcactgttgcctgggctggaatgcagtggtgcgatctcggctcactgcaacctccgcctcccgggttcaagtgattctcctgcctcagcctcccaagtaggtgggattacaggcgcccgccaccacgcccagctaatttttgtatttttagtagagatggggtttcactatgttggccaggctggtctcgaactcctgacctcgtgattggcccacctcagcctcccaaagtgctggtattacagatgtgagccaccgcacccagcctgagtttctctttctctctttttaactttattttttgaaaaacccggtagactttgtggggagcatttttgttgataattttactgatctaaagctgagtgattttttaaaagaatttgaatttggcttcctcaccagtaatatgtctccttgcttctttgatgtgatagttttgagatgggtgagaatctaatagatctgtggttgaatttgctgtgttgttatgaagtccaccctgtgggcacaataacataactgttggtaggagttgtttgagctattctggagattatttggtaaagtatactaaaagccttaaaaccatgtatgtgcgctgtttgaaccagtaagccacttctttgacattagaagacattagaagaaataatcagccttgcataaaacttatggatgaaagtattcatcaccaatattatttataataaaaaattgcaaatgttataaatgaacaattgggaaatggttaaagaagtgatggtgcattgtgtggtagaatattatgcatatgtttaaagaatcatattttctaagattatttggaagcatgtttggtaatgtcaagtggagtaccccagatacattttagacatttatcgtcatcatctgctctgagtggaaggccgttcagagaggctagaggttcttattctggctataaattatgtgagtaaaattgtgctaaccagttaaaagtactgtacacccatgctcaatatatagtcctggaaatagcaattgaaacatgtcttctcacaagagaaaatgacagttttaatgatgtatttgatgaatttaaactttaagtcaggtgctgcaaattggaaagaagacttgtggtgttttaagttgctgtggacacttttaagaaacttagaacccatggaacccttgtttatcgccatgcaaattacaatcttgaatgagtgttttttaaaaataaagtattagaaaaatgtgtagtaaagatgtaaattaaaaaatggaattctccattaa

SEQ ID NO: 27856 - DNA, 2763 bp, Homo sapiens
gattatttgatagtaaagctttaaccttttatagagaactttgatttagagtaattttttggtcttatatattctttcctaaatttagaccttaaatcatacatgtgcatcttttgcacatggctgtgcagtttggatttttgcatgggacttatgaatagtcagctaataaaataagagtaaccttaatgccaaaatctatacaaatgagcagaggaaagaaagggcagtataaattatgtgtaagactttctaagtccagctctatgagcaagtcatgaaaatgaggcacttatgtgctcaaagcaagaaatagagggagaagaaataaattggtactgtgaagaggtacctaatccttcttaatatctaattttttatgggacatatcgtggttgaatacagatttcctgtggataagaagtcagatgggagtggtttgttttattctttgtattaacaagtatagggggtgatttttaattacgacatattgtttgactgaaaatgttttgttgtgactcagttctttttttttctcctagtactgtgaatatatgcctgatgttgctaaatgtagacaatggttagagaagaattttccaaatgaatttgcaaaacttactgtagaaaattcacccaaacaagaagctggaattagtgagggtcaaggaacagcaggggaagaagaggagaagaaaaaacagaagagaggtggaaggggtcaaataaaacaaaaaaagaagaccgtaccacaaaaggttactatagccaaaattcccagagcaaagaagaaatatgtgacaagagtatgtggccttgcaacttttgaaattgatcttaaagaagcacaaagattttttgctcaaaaattctcctgtggtgcctcagtaacaggggaggatgaaattatcattcagggagattttacagatgacataattgatgtcattcaggaaaaatggccagaggtagatgatgacagcatcgaagatcttggagaagtaaagaagtgaatttgaaaatttgtctgtatttaatggcctgaactgagagttgatatggccaaagggagagaggccttttaaaatatatatatatatacacatatatatgtatatatacacatatatgtatgtatacacatatacacatgtatatatacatgtgtgtatgtatacatgtatatacatatatacatacacatatatgtatacatatatacacatatatgtatacatatatacacatatatgtatacatatatatatattctacagtaaaactgtagactgtcctcgtccttggcattttcactgttctgtacaaggctgcttgtttttttattgccaaagtcaaataaacgggagactgtcatgctcatgcatgaatagaatttagtcaaataaaaaattttggtcatttggtactgactttctctctctctctctctctcttttttttttttgacagagtctcgcactgttgcctgggctggaatgcagtggtgcgatctcggctcactgcaacctccgcctcccgggttcaagtgattctcctgcctcagcctcccaagtaggtgggattacaggcgcccgccaccacgcccagctaatttttgtatttttagtagagatggggtttcactatgttggccaggctggtctcgaactcctgacctcgtgattggcccacctcagcctcccaaagtgctggtattacagatgtgagccaccgcacccagcctgagtttctctttctctctttttaactttattttttgaaaaacccggtagactttgtggggagcatttttgttgataattttactgatctaaagctgagtgattttttaaaagaatttgaatttggcttcctcaccagtaatatgtctccttgcttctttgatgtgatagttttgagatgggtgagaatctaatagatctgtggttgaatttgctgtgttgttatgaagtccaccctgtgggcacaataacataactgttggtaggagttgtttgagctattctggagattatttggtaaagtatactaaaagccttaaaaccatgtatgtgcgctgtttgaaccagtaagccacttctttgacattagaagacattagaagaaataatcagccttgcataaaacttatggatgaaagtattcatcaccaatattatttataataaaaaattgcaaatgttataaatgaacaattgggaaatggttaaagaagtgatggtgcattgtgtggtagaatattatgcatatgtttaaagaatcatattttctaagattatttggaagcatgtttggtaatgtcaagtggagtaccccagatacattttagacatttatcgtcatcatctgctctgagtggaaggccgttcagagaggctagaggttcttattctggctataaattatgtgagtaaaattgtgctaaccagttaaaagtactgtacacccatgctcaatatatagtcctggaaatagcaattgaaacatgtcttctcacaagagaaaatgacagttttaatgatgtatttgatgaatttaaactttaagtcaggtgctgcaaattggaaagaagacttgtggtgttttaagttgctgtggacacttttaagaaacttagaacccatggaacccttgtttatcgccatgcaaattacaatcttgaatgagtgttttttaaaaataaagtattagaaaaatgtgtagtaaagatgtaaattaaaaaatggaattctccattaa

SEQ ID NO: 27857 - DNA, 2434 bp, Homo sapiens
agcggtttgtctcgcgggagcgctgctggcggtcgggcgctcgggcggccctggccggggagacgagttgcatgtgttggttcagctggcgatagcggcgggagcggagccggcggggcctgtgcgaccgcctgggtttgtgaaatggctgctgacatttctgaatccagcggggctgactgcaaaggagacccaaggaacagtgccaagttagatgccgattacccacttcgagtcctttattgtggagtctgttcattaccaacagagtactgtgaatatatgcctgatgttgctaaatgtagacaatggttagagaagaattttccaaatgaatttgcaaaacttactgtagaaaattcacccaaacaagaagctggaattagtgagggtcaaggaacagcaggggaagaagaggagaagaaaaaacagaagagaggtggaaggggtcaaataaaacaaaaaaagaagaccgtaccacaaaaggttactatagccaaaattcccagagcaaagaagaaatatgtgacaagagtatgtggccttgcaacttttgaaattgatcttaaagaagcacaaagattttttgctcaaaaattctcctgtggtgcctcagtaacaggggaggatgaaattatcattcagggagattttacagatgacataattgatgtcattcaggaaaaatggccagaggtagatgatgacagcatcgaagatcttggagaagtaaagaagtgaatttgaaaatttgtctgtatttaatggcctgaactgagagttgatatggccaaagggagagaggccttttaaaatatatatatatatacacatatatatgtatatatacacatatatgtatgtatacacatatacacatgtatatatacatgtgtgtatgtatacatgtatatacatatatacatacacatatatgtatacatatatacacatatatgtatacatatatacacatatatgtatacatatatatatattctacagtaaaactgtagactgtcctcgtccttggcattttcactgttctgtacaaggctgcttgtttttttattgccaaagtcaaataaacgggagactgtcatgctcatgcatgaatagaatttagtcaaataaaaaattttggtcatttggtactgactttctctctctctctctctctcttttttttttttgacagagtctcgcactgttgcctgggctggaatgcagtggtgcgatctcggctcactgcaacctccgcctcccgggttcaagtgattctcctgcctcagcctcccaagtaggtgggattacaggcgcccgccaccacgcccagctaatttttgtatttttagtagagatggggtttcactatgttggccaggctggtctcgaactcctgacctcgtgattggcccacctcagcctcccaaagtgctggtattacagatgtgagccaccgcacccagcctgagtttctctttctctctttttaactttattttttgaaaaacccggtagactttgtggggagcatttttgttgataattttactgatctaaagctgagtgattttttaaaagaatttgaatttggcttcctcaccagtaatatgtctccttgcttctttgatgtgatagttttgagatgggtgagaatctaatagatctgtggttgaatttgctgtgttgttatgaagtccaccctgtgggcacaataacataactgttggtaggagttgtttgagctattctggagattatttggtaaagtatactaaaagccttaaaaccatgtatgtgcgctgtttgaaccagtaagccacttctttgacattagaagacattagaagaaataatcagccttgcataaaacttatggatgaaagtattcatcaccaatattatttataataagcattgtgtggtagaatattatgcatatgtttaaagaatcatattttctaagattatttggaagcatgtttggtaatgtcaagtggagtaccccagatacattttagacatttatcgtcatcatctgctctgagtggaaggccgttcagagaggctagaggttcttattctggctataaattatgtgagtaaaattgtgctaaccagttaaaagtactgtacacccatgctcaatatatagtcctggaaatagcaattgaaacatgtcttctcacaagagaaaatgacagttttaatgatgtatttgatgaatttaaactttaagtcaggtgctgcaaattggaaagaagacttgtggtgttttaagttgctgtggacacttttaagaaacttagaacccatggaacccttgtttatcgccatgcaaattacaatcttgaatgagtgttttttaaaaataaagtattagaaaaatgtgtagtaaagatgtaaattaaaaaatggaattctccattaa

SEQ ID NO: 27858 - DNA, 1925 bp, Homo sapiens
gattatttgatagtaaagctttaaccttttatagagaactttgatttagagtaattttttggtcttatatattctttcctaaatttagaccttaaatcatacatgtgcatcttttgcacatggctgtgcagtttggatttttgcatgggacttatgaatagtcagctaataaaataagagtaaccttaatgccaaaatctatacaaatgagcagaggaaagaaagggcagtataaattatgtgtaagactttctaagtccagctctatgagcaagtcatgaaaatgaggcacttatgtgctcaaagcaagaaatagagggagaagaaataaattggtactgtgaagaggtacctaatccttcttaatatctaattttttatgggacatatcgtggttgaatacagatttcctgtggataagaagtcagatgggagtggtttgttttattctttgtattaacaagtatagggggtgatttttaattacgacatattgtttgactgaaaatgttttgttgtgactcagttctttttttttctcctagtactgtgaatatatgcctgatgttgctaaatgtagacaatggttagagaagaattttccaaatgaatttgcaaaacttactgtagaaaattcacccaaacaagaagctggaattagtgagggtcaaggaacagcaggggaagaagaggagaagaaaaaacagaagagaggtggaaggggtcaaataaaacaaaaaaagaagaccgtaccacaaaaggttactatagccaaaattcccagagcaaagaagaaatatgtgacaagatatgttggccaggctggtctcgaactcctgacctcgtgattggcccacctcagcctcccaaagtgctggtattacagatgtgagccaccgcacccagcctgagtttctctttctctctttttaactttattttttgaaaaacccggtagactttgtggggagcatttttgttgataattttactgatctaaagctgagtgattttttaaaagaatttgaatttggcttcctcaccagtaatatgtctccttgcttctttgatgtgatagttttgagatgggtgagaatctaatagatctgtggttgaatttgctgtgttgttatgaagtccaccctgtgggcacaataacataactgttggtaggagttgtttgagctattctggagattatttggtaaagtatactaaaagccttaaaaccatgtatgtgcgctgtttgaaccagtaagccacttctttgacattagaagacattagaagaaataatcagccttgcataaaacttatggatgaaagtattcatcaccaatattatttataataaaaaattgcaaatgttataaatgaacaattgggaaatggttaaagaagtgatggtgcattgtgtggtagaatattatgcatatgtttaaagaatcatattttctaagattatttggaagcatgtttggtaatgtcaagtggagtaccccagatacattttagacatttatcgtcatcatctgctctgagtggaaggccgttcagagaggctagaggttcttattctggctataaattatgtgagtaaaattgtgctaaccagttaaaagtactgtacacccatgctcaatatatagtcctggaaatagcaattgaaacatgtcttctcacaagagaaaatgacagttttaatgatgtatttgatgaatttaaactttaagtcaggtgctgcaaattggaaagaagacttgtggtgttttaagttgctgtggacacttttaagaaacttagaacccatggaacccttgtttatcgccatgcaaattacaatcttgaatgagtgttttttaaaaataaagtattagaaaaatgtgtagtaaagatgtaaattaaaaaatggaattctccattaa

SEQ ID NO: 27859 - DNA, 1153 bp, Homo sapiens
ggccgggcgcagtggctcacgcctgtaatcccagcactatgttggccaggctggtctcgaactcctgacctcgtgattggcccacctcagcctcccaaagtgctggtattacagatgtgagccaccgcacccagcctgagtttctctttctctctttttaactttattttttgaaaaacccggtagactttgtggggagcatttttgttgataattttactgatctaaagctgagtgattttttaaaagaatttgaatttggcttcctcaccagtaatatgtctccttgcttctttgatgtgatagttttgagatgggtgagaatctaatagatctgtggttgaatttgctgtgttgttatgaagtccaccctgtgggcacaataacataactgttggtaggagttgtttgagctattctggagattatttggtaaagtatactaaaagccttaaaaccatgtatgtgcgctgtttgaaccagtaagccacttctttgacattagaagacattagaagaaataatcagccttgcataaaacttatggatgaaagtattcatcaccaatattatttataataaaaaattgcaaatgttataaatgaacaattgggaaatggttaaagaagtgatggtgcattgtgtggtagaatattatgcatatgtttaaagaatcatattttctaagattatttggaagcatgtttggtaatgtcaagtggagtaccccagatacattttagacatttatcgtcatcatctgctctgagtggaaggccgttcagagaggctagaggttcttattctggctataaattatgtgagtaaaattgtgctaaccagttaaaagtactgtacacccatgctcaatatatagtcctggaaatagcaattgaaacatgtcttctcacaagagaaaatgacagttttaatgatgtatttgatgaatttaaactttaagtcaggtgctgcaaattggaaagaagacttgtggtgttttaagttgctgtggacacttttaagaaacttagaacccatggaacccttgtttatcgccatgcaaattacaatcttgaatgagtgttttttaaaaataaagtattagaaaaatgtgtagtaaagatgtaaattaaaaaatggaattctccattaa

SEQ ID NO: 27860 - DNA, 1177 bp, Homo sapiens
aagcttgcggccgctcccacttcacattggtaacccagagtttagaagtattgaaagacactatgttggccaggctggtctcgaactcctgacctcgtgattggcccacctcagcctcccaaagtgctggtattacagatgtgagccaccgcacccagcctgagtttctctttctctctttttaactttattttttgaaaaacccggtagactttgtggggagcatttttgttgataattttactgatctaaagctgagtgattttttaaaagaatttgaatttggcttcctcaccagtaatatgtctccttgcttctttgatgtgatagttttgagatgggtgagaatctaatagatctgtggttgaatttgctgtgttgttatgaagtccaccctgtgggcacaataacataactgttggtaggagttgtttgagctattctggagattatttggtaaagtatactaaaagccttaaaaccatgtatgtgcgctgtttgaaccagtaagccacttctttgacattagaagacattagaagaaataatcagccttgcataaaacttatggatgaaagtattcatcaccaatattatttataataaaaaattgcaaatgttataaatgaacaattgggaaatggttaaagaagtgatggtgcattgtgtggtagaatattatgcatatgtttaaagaatcatattttctaagattatttggaagcatgtttggtaatgtcaagtggagtaccccagatacattttagacatttatcgtcatcatctgctctgagtggaaggccgttcagagaggctagaggttcttattctggctataaattatgtgagtaaaattgtgctaaccagttaaaagtactgtacacccatgctcaatatatagtcctggaaatagcaattgaaacatgtcttctcacaagagaaaatgacagttttaatgatgtatttgatgaatttaaactttaagtcaggtgctgcaaattggaaagaagacttgtggtgttttaagttgctgtggacacttttaagaaacttagaacccatggaacccttgtttatcgccatgcaaattacaatcttgaatgagtgttttttaaaaataaagtattagaaaaatgtgtagtaaagatgtaaattaaaaaatggaattctccattaa

SEQ ID NO: 27861 - DNA, 519 bp, Homo sapiens
atcagcaaagtcatttaatatattaataatgtgaagtcactcataattcattcatgtcaattgtcatatcaactatcataatacatatgaaattgaaaagtctttcatttcataattagattgtatagaatttaatgattatgaaaagctgagctgtttgttaaaatatgaaacaatggtagaaatgagattcaaaaaataaaaggccacataagaaactcttctcccccgaaggaaaaattacaaataattacaagaatgtaactttacttattttcctggcttagaatgatcctcttgaataggaaatcaagaagaattactgtaggtaaaactgtcttcttaaaagtgaagattcagggtctgatttgctcagtagctaaatacagagcccgtttcaaactgtggagctctttcctgtgaggtttgtctgaattgcaacactgccaaacatcgctcggtgctcttccctagcagtctctaactctggcaccagcttccacaatgacgcgctaccag

SEQ ID NO: 27862 - DNA, 4354 bp, Homo sapiens
  misc_feature (3306)..(3306): n is a, c, g, or t
gtcagtgtcaagatcaatgttgtttgttttcttaaaagcaattatgatgcttggagatgccaaaattggcaataacagtgtcagctctttaaagaatgatgacttcaccatgagaggtttgcgatgtgatgggaatgctgatgatatctggactgcctcacaaaatccaaaatcctgtgggaaaagcatttccatagaaactgccaatttaagagaatacgctagatatgtactgaggactatctgtcaacaggaatgggtaggagagcattgcttaaaagaacctgaaagattatgtacagacaaagaacttatattggaccctgtgctttcaaatatgcaagcacagaaattactgcagcttatctgttatcctcatggcattaaagaatgtaccgagggggacaatctgcaaagacagcacattaagcgtattcttcagaatcttgagcagtggacactgaggcaatcctggttagaactccagctaatgatcaaacagtgcttgaaggaccctggctctggttctgtggccgaaatgaacaacttactggacaatattgcaaaggcaacaatagaggtattccagcagtctgcagacctaaataattcttctaattctggcatgagcctcttcaacccaaacagtattggaagtgctgatacaagtagcacgagacagaatggaataaagacattcctaagttcctccgaacgcaggggtgtatggttggtggcccccctcatcgccaggttgccaacttctgtgcaaggaagagtgctgaaagccgctggggaagagctggagaagggacagcacttgggttcttcttccaaaaaggaaagggacagacagaaacagaaaagtatgtctcttttgagtcaacaacccttcctctcactggtacttacctgccttaagggacaagatgaacaaagggaaggcctcctaacatctctccagaatcaagttaaccagattttaagtaactggagagaagaacgataccaagatgacataaaagcgcggcagatgatgcacgaagcattgcaactccgcctaaatttggtaggaggaatgtttgacacggtgcagaggagcacccagtggactacagactgggccctgctactccttcagatcattacttcaggaactgttgacatgcacactaacaatgaattattcacaacagttcttgacatgctgggtgttttaatcaatggaacgttagcctctgacctatcaaatgcatcccctgggggatctgaagagaacaagcgtgcatacatgaatttagtaaagaaactgaaaaaagagctaggagacaagcgatcagaaagtattgacaaagttcgacagttactacctttgccgaaacagacatgtgatgtcatcacttgtgaacctatgggttccttgattgacacaaaaggaaacaaaattgctggatttgactctatagataaaaaacagggtctccaggtctctacgaagcagaaggtgtccccgtgggacttgtttgagggtcagaagaacccagctcctttgtcctgggcctggtttgggacagtccgagtggaccgaagagtgatcaagtacgaggagcagcatcacctcctgctgtatcacacacaccccatgcccaagccccgcagttactacctccagccactgcccctgcctcctgaggaggaagaggaagagcccacatctccagtttctcaggaaccagaaaggaagtccgctgagctgtcagatcagggaaaaaccacaacagatgaagaaaagaaaacaaaaggaaggaagcgcaagacgaaatctagctcaagagttgatgaatatccacagagcaacatataccgagtgcctcctaattactcgcctatctcctcccaaatgatgcaccatccacagtccaccttgtggggttacaacctcgtgggccagccccagcagcccggctttttccttcagaaccaatctcttactccaggtggctccagattggaccctgcaggctcctttgtcccaaccaacaccaaacaagctctgtcaaacatgctacagcggcgctcaggcgccatgatgcagccgccttctcttcatgcaatcacatcgcagcagcagttgatacagatgaagcttctgcagcagcagcagcaacagcgacttctcaggcaagcccagactcggcctttccaacagggccagccgggggaccaggctgctctctttgctgcgcaagcacggccctcccctcagctccctcagtatccagggctgcagcaagcacagaccatgccacagggctatacaatgtatgggacacagatgcctttgcagcagacatcgcagcagcaggctggcagtgtggtcctgtctcccagctataactccagagcctatccggccgcacattccaaccccgtgctaatggaaagactcagacagattcagcagcagccgagtggctatgttcagcagcaggcctcgccgtacctgcagcccctgactggctctcagagactgaaccatcaggctctacagcagagccctctggtgggcgggggaattgatgctgtgctgacttctgcacatccaaaccttccctccgtgcccctgcctcaggatcccatgagacccagacagccgcaagttcgacagcagcagagactcctccagatgcagcagccccagcagccccagccccagcagcctccccagccccagcagtcctcgcagtcccagagtcagacccttggtctccaagcaatgcagccccagcagcccttgtttcccaggcaaggcttgcagcagacccagcagcagcagcagacggccgccttggtgcggcagctccagaagcagctttccagcaaccagccacagcaaggagtgactccgtatgggcatccttcacacttctgaatctgcaagaggagaagacatgacgttttatgtttgcactgaaaaacagaaaatcaaatttaatgcattagtcatcttaaaaatgtccctttttttcatttctttgacattttactatattttatgctacatctcacaaaaaaaaaaaggtgtttaaacaaaaagccaaggagaagttgtggtttgattttgttgaattcacctttaaagtaggtttacaaatgtgaatcatgcaggcaggcctactcccggaagagtgtgctagcagaccttttgaaattggtgctttttttgaatctcacatttctagaaagaatggattatgatggatctaaggtatttatgtatttcattcattaatgatgacgttgttnttttttttttaattttattttccaaactgtgctggaccaaactactgatttgaaaggcatgtcagatcttgacagaaacatggcctgtttattctgcattcacctgtgatggtgaaacggacatttatttgcatcgctctaatttgaaatgtttgtaatctcataagcactttataaactttgttcttatttatgtaggactcttctttgcttttgttgtggtcaaaaggtgctgaaacagattgttgcttcgtacttaaacttcttaaaccaagaacctaaaccaaggtttctttgagagccgccctaagatgtgcggaaacctgttagaagtagctgtactcaaatttgttttgaggcaagatcattgatgagagtcattgtgaaggtacaacatgtaaatcctaaaggcctgaaagaactgcagtggaatcgtccaactatttattgccagttttggttctcctgaaccttatgccaccttaaggggaaaaaaaaatccagtagctggcttgagattccagtgctcacacttgacatggtttccagagaatctggccccaaagtccagaaggctctggttttcataaaaggtgtatttgctgtttattttgtatggtaagtatttgctcttttgaatttaattattactgtcagtgtcagtcttggttgtgtattgcatatactgtatttataaattggtgcaaaaagcacaagtaaattatacatcaaatttattataaagaaatagtaactattttaactttgttcaagtatgtggtaatttgctcctattagagtaaaaaagaaaccagtaaattatcagtttgtgtaacttaagagtattctatataatatttttttagatttagatgcataaaattttgaatgtgaaaattgcagggcattttaaaacatatgtgggggatattttcccatgttctctgttatttcattttcttttgccatatgattttacatataatatagtcaagcatactgtgaatagacttgtctataatgagcagaccatgtaaatctacttttt

SEQ ID NO: 27863 - DNA, 260 bp, Homo sapiens
cgaaatctagctcaagagttgatgtaagtggggaaaggaaggagaaccttggctcattagcatttagtatgagatttactcgtgcccaaatcatatccctcgaaacattaccaagagcaggataagttttgttatgacagttctcctaacaggtttctgcattaactgaatggcacacaatgacttgtcacagacaaaagattaaagcttttgattttccgtcctccacttttaataattttattttaattgtaggcttc

SEQ ID NO: 27864 - DNA, 388 bp, Homo sapiens
gagaactttcaatgttttatgaaacttttactgtattccttttgaaagttaataccaagtagtttagttcagagggagacactctggatgggccagtaacctaaatcctgcggccttgcattggcaagtgtggactgtgaataaaggtgtcccctctgcagggtggtacttgaatcccaccacaagggtttttcagggcaaggatagtactctccggccattctgtttccctgtacctgcagctggtactgagagcagtgacaagagggtagcatccatctgtgcaatagttttgtgtctgtaattttggttcaatttatttttctccttaggcaaccagccacagcaaggagtgactccgtatgggcatccttcacacttctgaatc

SEQ ID NO: 27865 - DNA, 466 bp, Homo sapiens
tataaataagaatgcctgtattttgaaaaaaaccgtatttgggtccacctaaattacatgatgtctataaattttttgatgcccttaaaaatgtaaatcgtagctcagatttattcacgaaactaaaaatattctaattcgtgtatgtactgattattgtttgttgcttaacagcattgtcaaaaatatttgaagccattgttatcttcttctcaaggttctactaagttatttgacaaatgagtattttatctgtgaatctaagaaaatgacttgtttgatgttagtgaaatatatgttaattaagtatatcacaggtgagtatttctcttttgtacaaggttactttctgtgtcttctttttcttttctaggattaacgacatagccaatttctcctctgagcttacggcttgctgcactgttcttagttcagaatggctgggggttctgaaggctctttgttg

SEQ ID NO: 27866 - DNA, 5731 bp, Homo sapiens
  misc_feature (8)..(8): n is a, c, g, or t
  misc_feature (10)..(12): n is a, c, g, or t
  misc_feature (15)..(15): n is a, c, g, or t
  misc_feature (4683)..(4683): n is a, c, g, or t
attttctntnnntcnggatgaatcttcaagtcatgaatgtaaccagcgcacaatccttctctatggagtcggcaaagagcgtgatgaagcaaggcatcagctgaagaagattaccaaagatatcctgaaaattctaaataagaagagcaccacagagacaggggttggggacgaaggacaaaaagccaggaagaacaaacaggagacatttccaacactggagactgtgttcactaaactccagctcctttcatattttgatcaacatcaagtgacatctcagatttctaacaatgtgctagaacaaatcacaagctttgcgtcaggaacatcctatcatctccctttggctcaccacattcagctcatctttgatctcatggagccagcactgaacatcaacggactaattgacttcgcaatacagttactaaatgaactgagtgttgtggaagctgaactgctcctaaaatcctccagcctggcaggaagttatacaacaggactgtgtgtctgcatcgtggctgttctcaggcgctatcacagttgtctaatcttgaatcctgatcagacagcccaggtgtttgaagggttgtgtggtgtggtcaagcatgtcgtaaacccctcagaatgttcttcccctgaaagatgcattttagcctacctctatgatctctatgtgtcatgtagccacctcagaagtaaatttggagacctcttcagtagtgcctgttcaaaagtaaagcaaaccatatataataacgtgatgcctgcaaattcgaacttgcgatgggatccagacttcatgatggattttattgagaatccctcagcccgcagcatcaactactcaatgctgggcaagatcctcagtgacaatgcggccaatcgctacagctttgtctgcaatacactcatgaatgtatgtatgggccatcaggatgctggcaggattaacgacatagccaatttctcctctgagcttacggcttgctgcactgttcttagttcagaatggctgggggttctgaaggctctttgttgttcttcaaatcacgtgtgggggtttaatgatgtactttgcactgtagatgtgagtgacctttcattccatgattcattagctactttcattgctattctgatagcacgacagtgtttttccctggaggacgtcgtgcagcatgtcgcacttccctctcttctagcagcagcttgtggggatgcggacgccgagcctggggcgagaatgacatgccgactcttgcttcatctcttccgagctccccaggcctgcttcttacctcaagcaacgggcaaacctttccctggaataagatcatcttgtgatagacacctcttagccgctgctcacaacagcattgaagtgggagccgtgtttgctgtcttaaaagcaattatgatgcttggagatgccaaaattggcaataacagtgtcagctctttaaagaatgatgacttcaccatgagaggtttgcgatgtgatgggaatgctgatgatatctggactgcctcacaaaatccaaaatcctgtgggaaaagcatttccatagaaactgccaatttaagagaatacgctagatatgtactgaggactatctgtcaacaggaatgggtaggagagcattgcttaaaagaacctgaaagattatgtacagacaaagaacttatattggaccctgtgctttcaaatatgcaagcacagaaattactgcagcttatctgttatcctcatggcattaaagaatgtaccgagggggacaatctgcaaagacagcacattaagcgtattcttcagaatcttgagcagtggacactgaggcaatcctggttagaactccagctaatgatcaaacagtgcttgaaggaccctggctctggttctgtggccgaaatgaacaacttactggacaatattgcaaaggcaacaatagaggtattccagcagtctgcagacctaaataattcttctaattctggcatgagcctcttcaacccaaacagtattggaagtgctgatacaagtagcacgagacagaatggaataaagacattcctaagttcctccgaacgcaggggtgtatggttggtggcccccctcatcgccaggttgccaacttctgtgcaaggaagagtgctgaaagccgctggggaagagctggagaagggacagcacttgggttcttcttccaaaaaggaaagggacagacagaaacagaaaagtatgtctcttttgagtcaacaacccttcctctcactggtacttacctgccttaagggacaagatgaacaaagggaaggcctcctaacatctctccagaatcaagttaaccagattttaagtaactggagagaagaacgataccaagatgacataaaagcgcggcagatgatgcacgaagcattgcaactccgcctaaatttggtaggaggaatgtttgacacggtgcagaggagcacccagtggactacagactgggccctgctactccttcagatcattacttcaggaactgttgacatgcacactaacaatgaattattcacaacagttcttgacatgctgggtgttttaatcaatggaacgttagcctctgacctatcaaatgcatcccctgggggatctgaagagaacaagcgtgcatacatgaatttagtaaagaaactgaaaaaagagctaggagacaagcgatcagaaagtattgacaaagttcgacagttactacctttgccgaaacagacatgtgatgtcatcacttgtgaacctatgggttccttgattgacacaaaaggaaacaaaattgctggatttgactctatagataaaaaacagggtctccaggtctctacgaagcagaaggtgtccccgtgggacttgtttgagggtcagaagaacccagctcctttgtcctgggcctggtttgggacagtccgagtggaccgaagagtgatcaagtacgaggagcagcatcacctcctgctgtatcacacacaccccatgcccaagccccgcagttactacctccagccactgcccctgcctcctgaggaggaagaggaagagcccacatctccagtttctcaggaaccagaaaggaagtccgctgagctgtcagatcagggaaaaaccacaacagatgaagaaaagaaaacaaaaggaaggaagcgcaagacgaaatctagctcaagagttgatgaatatccacagagcaacatataccgagtgcctcctaattactcgcctatctcctcccaaatgatgcaccatccacagtccaccttgtggggttacaacctcgtgggccagccccagcagcccggctttttccttcagaaccaatctcttactccaggtggctccagattggaccctgcaggctcctttgtcccaaccaacaccaaacaagctctgtcaaacatgctacagcggcgctcaggcgccatgatgcagccgccttctcttcatgcaatcacatcgcagcagcagttgatacagatgaagcttctgcagcagcagcagcaacagcgacttctcaggcaagcccagactcggcctttccaacagggccagccgggggaccaggctgctctctttgctgcgcaagcacggccctcccctcagctccctcagtatccagggctgcagcaagcacagaccatgccacagggctatacaatgtatgggacacagatgcctttgcagcagacatcgcagcagcaggctggcagtgtggtcctgtctcccagctataactccagagcctatccggccgcacattccaaccccgtgctaatggaaagactcagacagattcagcagcagccgagtggctatgttcagcagcaggcctcgccgtacctgcagcccctgactggctctcagagactgaaccatcaggctctacagcagagccctctggtgggcgggggaattgatgctgtgctgacttctgcacatccaaaccttccctccgtgcccctgcctcaggatcccatgagacccagacagccgcaagttcgacagcagcagagactcctccagatgcagcagccccagcagccccagccccagcagcctccccagccccagcagtcctcgcagtcccagagtcagacccttggtctccaagcaatgcagccccagcagcccttgtttcccaggcaaggcttgcagcagacccagcagcagcagcagacggccgccttggtgcggcagctccagaagcagctttccagcaaccagccacagcaaggagtgactccgtatgggcatccttcacacttctgaatctgcaagaggagaagacatgacgttttatgtttgcactgaaaaacagaaaatcaaatttaatgcattagtcatcttaaaaatgtccctttttttcatttctttgacattttactatattttatgctacatctcacaaaaaaaaaaaggtgtttaaacaaaaagccaaggagaagttgtggtttgattttgttgaattcacctttaaagtaggtttacaaatgtgaatcatgcaggcaggcctactcccggaagagtgtgctagcagaccttttgaaattggtgctttttttgaatctcacatttctagaaagaatggattatgatggatctaaggtatttatgtatttcattcattaatgatgacgttgttnttttttttttaattttattttccaaactgtgctggaccaaactactgatttgaaaggcatgtcagatcttgacagaaacatggcctgtttattctgcattcacctgtgatggtgaaacggacatttatttgcatcgctctaatttgaaatgtttgtaatctcataagcactttataaactttgttcttatttatgtaggactcttctttgcttttgttgtggtcaaaaggtgctgaaacagattgttgcttcgtacttaaacttcttaaaccaagaacctaaaccaaggtttctttgagagccgccctaagatgtgcggaaacctgttagaagtagctgtactcaaatttgttttgaggcaagatcattgatgagagtcattgtgaaggtacaacatgtaaatcctaaaggcctgaaagaactgcagtggaatcgtccaactatttattgccagttttggttctcctgaaccttatgccaccttaaggggaaaaaaaaatccagtagctggcttgagattccagtgctcacacttgacatggtttccagagaatctggccccaaagtccagaaggctctggttttcataaaaggtgtatttgctgtttattttgtatggtaagtatttgctcttttgaatttaattattactgtcagtgtcagtcttggttgtgtattgcatatactgtatttataaattggtgcaaaaagcacaagtaaattatacatcaaatttattataaagaaatagtaactattttaactttgttcaagtatgtggtaatttgctcctattagagtaaaaaagaaaccagtaaattatcagtttgtgtaacttaagagtattctatataatatttttttagatttagatgcataaaattttgaatgtgaaaattgcagggcattttaaaacatatgtgggggatattttcccatgttctctgttatttcattttcttttgccatatgattttacatataatatagtcaagcatactgtgaatagacttgtctataatgagcagaccatgtaaatctacttttt

SEQ ID NO: 27867 - DNA, 382 bp, Homo sapiens
ttggggtgtgtccgggatgagcaggggctgacagaacatgtccccccacctctcatcttcagccttttctgagccgcagggcctctccactcccagactgaagggtattagaagagaagacaagggaacatttttccactgttgcgcatttgttcaacaaatgctagctgaaaagagcctctagtgacttgtcgcagctacccaatctacccaggccgggcctagaggccaatgccatggcccaagggcacagctcatggtgaggtccagctgctgggcaggaaaaggacaagaggtcaggtggctgcagaggtgatggctgggggcctgtcagacgggggccaaagacattcctcccctcgtgatccctgacccaagcgcg

SEQ ID NO: 27868 - DNA, 448 bp, Homo sapiens
agttttttttcattgttatagtctgtattcaataaaattacccagatcttaactaggcagtttgataaatcctgacaaatgtaaacactcatgttaccatcacccaaattaagatattgtaaaacattttcattactctagaaagttcactcatgcctctctccagtcactacccctgaggcagccactgtgctgatttcccatcaccatacattagttgtacctagccttgaacttcatagaaatagagtcatacatacttccttgtctgccttgtttctcaacatgatgttttgaaattcatccatgttgcacctaacagtaatgagtcgtaatttattaatgagtagtagtgtattgtacaaatttgtttattcgttctcttgttggtatttggattgtttccagtttgggactattgttaataaacctgtgaatctgcaagcct

SEQ ID NO: 27869 - DNA, 876 bp, Homo sapiens
atgatacccatccaactcactgtcttcttcatgatcatctatgtgcttgagtccttgacaattattgtgcagagcagcctaattgttgcagtgctgggcagagaatggctgcaagtcagaaggctgatgcctgtggacatgattctcatcagcctgggcatctctcgcttctgtctacagtgggcatcaatgctgaacaatttttgctcctattttaatttgaattatgtactttgcaacttaacaatcacctgggaattttttaatatccttacattctggttaaacagcttgcttaccgtgttctactgcatcaaggtctcttctttcacccatcacatctttctctggctgaggtggagaattttgaggttgtttccctggatattactgggttctctgatgattacttgtgtaacaatcatcccttcagctattgggaattacattcaaattcagttactcaccatggagcatctaccaagaaacagcactgtaactgacaaacttgaaaattttcatcagtatcagttccaggctcatacagttgcattggttattcctttcatcctgttcctggcctccaccatctttctcatggcatcactgaccaagcagatacaacatcatagcactggtcactgcaatccaagcatgaaagcgcgcttcactgccctgaggtcccttgccgtcttatttattgtgtttacctcttactttctaaccatactcatcaccattataggtactctatttgataagagatgttggttatgggtctgggaagcttttgtctatgctttcatcttaatgcattccacttcactgatgctgagcagccctacgttgaaaaggattctaaagggaaagtgctag

SEQ ID NO: 27870 - DNA, 467 bp, Homo sapiens
acttcacttaaatctgctctgagtctctggatgcctggcaggtggagaattcaatcttgtcgttaccagtattcctttcccttctccatgggcttatgtaagaattctgggcttacacactgttggaaagccaggtaggaactacctcccccgaactctccattcttccagctgctcatgatccatcaaccttctttgggccacctgctatagcaagaccctcctcacagcatcattccactgacccacaggctcagccccagggaccctcactagaacaggtctccactatgcataggaactcacaaaaaccttctcttcatcttggcttctgctgatatccagccactcccccacttctcatcttaaacacagatggcagctccttcccatcgttccaaaacagggggattgtccagccaaattctctgcagacaccaaagcttcacccgtcctcttcagggagg

SEQ ID NO: 27871 - DNA, 439 bp, Homo sapiens
aggaagttaattgtcatgacgaggctcattcttagaagttcattttaatagagaatgttatgtaatagtttcatatgtgacttcagtgttatagtcaaaggtttattacaactttgaaggggatacatttagagagttttaaaaaccattttgtaaataatttaaatatttttttttttggctgggcatggtggctcacacctgtaatctcagcactttgggaggctgaggcgggcagatcacttgaggtcaggagttcgagaccagcctggccaacatggtgaaaccccatttgcactaaaaatacaaaaattagctgagcgagcatggtggcatatgcctgttatcccagctactcggggggctgaggcaggagaatcacttgaacccgggaggtggaggttgcagtgagccaagatcgcgctgctgcactccagcc

SEQ ID NO: 27872 - DNA, 330 bp, Homo sapiens
gcaaaacccttcagtccaagctgggcacccctcctgggttcacttatgagattgagctgagtttattttcattgctcattacactgctgtccccccacccccaggtgagctccctgaggtcagggaacatgccatatttactgctgtatctccagggcccagcccagtgtggcccatcagaggcactcaataatcatttactgaatgacagtatttgtcataggataagtgaggggaaaacaggaccttttagatttgtagagtgtttccaagcatttctatccacatctcacttgatttatatggaacgaacaagcagggattgttacc

SEQ ID NO: 27873 - DNA, 431 bp, Homo sapiens
tccaattacacatatattggcccacgagtcacagagacttgttcatttctttttcctctccttttttctctctgtagttaacttcagtgaagttttcttcgtagtttccaatctgtcatttagcatattcagtgaatttttcatttcagatattacattttttgttctaggttttccatttgattcttatttagagctctactttggctgatattctctatctgtgcatggatactgttcatcttttcctttaaatctttgagcctatttaccagagacaacataaaatagttggctgctaattccatgtctctgtcatctctgggtctatttctatttttttccctatagttccctgcttcttcatttgtttagtaattttttatacagctggtcattgtgggtactatgttgtggaacatttggaattc

SEQ ID NO: 27874 - DNA, 164 bp, Homo sapiens
catcacactacaaacacagccaccctctctggggaacgtaagagaaacttttgggcttccacttcccctccatttgtttgaaggatcaagagaacactgttccattttcaacaaaaattaaaaaggaaaatcatgaaaagagccaacctcctcttttttgtttt

SEQ ID NO: 27875 - DNA, 402 bp, Homo sapiens
tgcaatatcaagaggttcccagagcccctgaagctcatctgtgcgtcccaggttaagaatttctaacttatccaaccccactggaaacaagaaaataatagaatttctaacttacttggcacttaggcctgggagaaacagaagagggcaggggagagagggagagagtgcttctctgcagtttcctagggtgcactgggagagtcgcctaaatgcagtggacaggtggagagactacctgagcaagcgggtggactcactcacgatcatgtggcccagcagatccaggggaaggaacccaggtcctagaataagttgagtggtccagacatggaggtcagtaatgtgccaagccataacaactgaagtggaggaggtttgaaataaacaccagtctgtggg

SEQ ID NO: 27876 - DNA, 539 bp, Homo sapiens
tgtacatacggtgaggagcatccaaaccccagatgaaatccacgtgagcccattcaggaatattcttatggtagatgaggttggtcacctcagagagcagcattttcacgtcttctggatttgaaagccagtcctgacctcctgtccacattgctgtagggaccgtcatatctctgactctgtaccttacaggagttggctagagaaaaggaatagttcttaactctaggtaacatttggactttcaggctcataatttatgtttcaaatagacataataaacatgccatctgttgtggtgaagggtacatgggtgttagagccacacaactctgttaagaatttctgttcccgcccttactttaaggtaaaattacttaacattattgaacctcagtttcttcttctgtgactggggataatatctgtaataacttgctagatcaaatgacaaaacacataaaaacatgtaatgccttgtatttcttttttcttcctattaaatattttgtaaataaattgtttttaaaaataatgcc

SEQ ID NO: 27877 - DNA, 451 bp, Homo sapiens
tagactgaaggataatttgcaaattcctacaacgattagagattaagttgccagctttaaaaatggggactagtgtgtaagccttttgtatgtacatatgtacatgcactaagtatgtaaatacatacatattgtgagactaggttctcacagtaaatatctgataaaaatccctgggggaggggaaaaggaaccattttgaaatacaccacagcactctgttcttaaaaaggtctctcctcaagagaaactagtgtatataaaaaacttactttctaaatgtaactgttactctactaatccagagtttcaaacatgtgtgaacaataagatagcatacataatttggcattttaaaagttatccaaagatacttttgtagaagccacttagctgatgatagaagatatttaaaagatcaaataataccagatattgtacatcgtatatg

SEQ ID NO: 27878 - DNA, 470 bp, Homo sapiens
caggcttctgacctctagaactgggagattatcagtttgtgttgttttaagccactaaatatgtgatcatttgtcataacagcaataggaacctaatacaggggcacatgtaaactgctgagcagaagtttaaataaccagctgggggctatggccatctttcttttgcctccagcataaggtgagcaaagtcctggtggggacacttgctgcttcagccagggtccagagtgagacagacatggaccagagcctgtccagtgaagaaatgaaccttggttgtaagccactgagatttggaggctgcttgttaccacagcataacctagcctctcctgatggacccatttcacctggcactcctcacaaaggaactcaagacttccatttcatttcatcagattactttgcagtgtcctttgatggccaggcactgtttggcccctagtatactatcagtaacaaacaga

SEQ ID NO: 27879 - DNA, 452 bp, Homo sapiens
gctcgacttctaaacaacaaatagatcttatgtgatttagaagaagacaaatgatttacttcttctaaacaacaaatagatcttatgtgatttagaagaagtaaatcacataagatctatttgttgtttaagttagcaattaaagttcagcagcaaagtctgaaatcacctcttctccttgtcacccactcgtaacagaaacattggcactaacacatgtgaccttcagaatagccgttgcctctcataaaatctaacagtgttttcttcagaaataaggactacgaagccacagacctcaagtccctttgagactcattgacatagtacttatctagctgaaaccaagggtgccctaatcacaggacacctacaaaatttcctttctttctttttagcatttacagacatgggctaccggagctgtattacagattagctttatctaatgt

SEQ ID NO: 27880 - DNA, 435 bp, Homo sapiens
aatatgttgactatggcaggcatggtggctcacacctgcaatctcagcactttggaaggccaaggcaggaggatcccttgagctgaggatttcgggaacagcctgcacaacatagcaagatccctgtctctaccaaaaaaaaaaaaaaaaattgagtaaattcagaggggaatgtttaacattcttcttttaacattatagttttaaaatgagccaactactaaattgtgtgctcaagatacatcttttctttcataaatgaagtaccaaattgtgagcctaaaaggagttagaatgagtcaagctgaatgtcatatgactggatattgaaaagtcattattgattcacatcactttcttccttactgtgcatagtactgaagtcgttaatggaagaagatgtacttacccaataaacttaagcatttaaacatg

SEQ ID NO: 27881 - DNA, 595 bp, Homo sapiens
aatatgttgactatggcaggcatggtggctcacacctgcaatctcagcactttggaaggccaaggcaggaggatcccttgagctgaggatttcgggaacagcctgcacaacatagcaagatccctgtctctaccaaaaaaaattcaaaaattatccaggtgtggtggtgcgcagctatagtgccagctacttctggaggtgagacgggaggatcatttgagcttcggaggtcgagactgtagtaagccatgattgtaccactgcactccaggtggagagacaaagcgatttttctgtctcaaaaaaaaaaattgagtaaattcagaggggaatgtttaacattcttcttttaacattatagttttaaaatgagccaactactaaattgtgtgctcaagatacatcttttctttcataaatgaagtaccaaattgtgagcctaaaaggagttagaatgagtcaagctgaatgtcatatgactggatattgaaaagtcattattgattcacatcactttcttccttactgtgcatagtactgaagtcgttaatggaagaagatgtacttacccaataaacttaagcatttaaacatg

SEQ ID NO: 27882 - DNA, 265 bp, Homo sapiens
aaaaaagaaagtaataggttgggtgtttcaaaagatttttagccttaagatccagattatttaaaaagtgaactgcctactccctttcttggactccctcctctatgagtaaaaatgtattacagcaactgtaacacatcattatccccattccactttccactatgaaacttaagacttttgatgacagggataacatctactttatctttgtaactcctgcctctaacgcaatgcctagcaagtgatacaggtatgatgcttg

SEQ ID NO: 27883 - DNA, 765 bp, Homo sapiens
tgaggttaatcacagtgaccaccgaacacattactatgagaataaaaggaggcaaggcatttaagtaccagattcacacacatcgtgatgtcctataaagaccataagactttctctgatttttttctgttcttaaactgttttttctatttctcttttatctttaatatcatgttgcctgtggtgcctctgcctatattaccctaaattaggctttgcattagtactttgtacatagtatgtacccaatatctattgacatacataaaaatgaatttcttaatgtatgtgttttataagttcgaattttgatatatagaatttacctcgtgcccagagtccaatgcatgccaagcctacagtagatgttcagtaaatatttgttgagtgctgaaaaaagtagtgcttattgcattatcaaatagaaatactctttctcagtgaagttactagagagtagacaaaataccctctcctcttgtgatggctccaactccatcacttaggtggcatcttgacctggcattctaactcttggaaattgagcactctgccaggtagagtagaggcacagagaagttgaaagcatgttccctgtctctactaaaaatacaaaaattagccaggcatggtggtgggtgcctgtagtcccagctactcaggaggctgaggcaagaggattgcttgagttaaggaagtcaaggctgcagtgagctatggtcatgccactgcactccagcctgggcaacagcaagaccctgtgtc

SEQ ID NO: 27884 - DNA, 355 bp, Homo sapiens
tgaggcaggagaatcatttgaacctgggaggtggaggctgcagtgagccgagatcgtaccattgcactccagcctgggtgacagagcgagactctgtctcaaaaaaaaaaaaaacccaaaaaccaacaaacaaacaaaacaaaacaccaatgcagctaaagctgatagataattgggtcaaaaaggaaagacaattgaaccgaaaacagaccgttgggttaaaacaaaagtggttgaaaatagccagaagcaggcaatttagtcaagagctacttagtagaaagcagagcctgggcaaaagcaaaaagaatccaactcaaagtaatttacccttcataagcagataatttgtcag

SEQ ID NO: 27885 - DNA, 587 bp, Homo sapiens
taattagcatgcacattccagtttgagaaaagcggcactaaaaagctttgtcaaataggcagtgtgctcccatttctcggtattgtgcctgtgacaggcatcaataatcaaccagagaatcacttccttctgagagcagaatattctcaagtcatggtttcaggtcgcagtgaccaatcaatgggagttggatcaaaattaaacctatcttccatactggtgtcaacacttgaagaaagctcttttatttccacccatatacacatcatacatgcctgataaatgtttgtggaatgaatgtgttttcccctagccttgtttcctgtgatattcacactattccagtccatacccacagaaaatcagaacttcactgggcatctgggaagttcagcagctgttctaggtgttggattttgctattggccatgacccattagaaggttgaggtgaggttggaaagatgttagggatggaatgaagacacttgggaacccatctcgctgtggcacatggacctcaaaccatgcaagttttcttttttctttctttctttttttctttttcttgagatggagtcttgctct

SEQ ID NO: 27886 - DNA, 534 bp, Homo sapiens
cattcattcattcattcattcattaaaggaaaacgccttggagatcgcgcgtttcgaaagcgcgttttcgttttctctcctgggcgggttatggccctaccggggcgccgtagccggcccgcgcgtgcccagtcttggcgaagagtagcggtaggtcggcgggacttccgtgttggcgggattctgaacgctgccatggctcagaccgtgcagaatgttacattgtcgctcactctgcccatcacgtgccacatttgcttggggaaggtaatgggtgattgtgggcacagctacaaaacggggttggataagtcgctcgccggggccgagggccgtctcgtgcgggggcggggaaggggcgtgaggcgcggagatgggagaaaacgctaacccgcgttcttgatgggaggccgcgtcctgggagatgggggtagcgcaccgtgattaatggattcatctgggcgcctttcggaggagggtgacagcggcccgtggtctgccgggagggcggcgagacggccctgccaccgcccg

SEQ ID NO: 27887 - DNA, 3558 bp, Homo sapiens
cattcattcattcattcattcattaaaggaaaacgccttggagatcgcgcgtttcgaaagcgcgttttcgttttctctcctgggcgggttatggccctaccggggcgccgtagccggcccgcgcgtgcccagtcttggcgaagagtagcggtacgtcagcctgtcatatgcatcaacaaccatgtattttgttcgatttgtattgatttgtggttgaagaataatagccagtgtccagcttgcagagtccccatcactcctgaaaatccttgcaaagaaattataggaggaacaagtgaaagtgaacctatgctaagccatacggtcaggaagcatcttcggaaaactagacttgaattactacacaaagaatatgaggacgaaatagattgtttacagaaagaagtagaagagcttaagagtaaaaatctcagcttggagtcacagatcaaaactattctggatcctttaaccttggtgcagggcaaccaaaatgaagacaaacatctagtcacagataatccaagtaaaattaacccagaaactgtagcagagtggaagaaaaaactcagaacagctaatgaaatctatgaaaaagtgaaagatgatgtggataagctaaaggaggcaaataaaaaattgaaattggaaaatggtggtctggtgagggagaatttacgactgaaggctgaagttgataacagatcacctcaaaagtttggaaggtttgcagttgctgctcttcagtccaaagtagaacagtatgagcgtgaaaccaatcgcctcaagaaagccctggaacgaagtgataagtatatagaggaactagaatctcaagttgcacagctaaaaaattcaagtgaagagaaagaagctatgaattccatttgccagacagcactttctgcagatggcaaagggagcaaaggcagtgaggaggatgtggtgtcaaagaatcaaggcgatagtgccagaaagcagcctggctcatccacctccagttcttctcacctagcgaagccttccagcagcagactgtgtgacaccagttctgcaaggcaggaaagtaccagcaaagcagaccttaactgttctaagaacaaagacctatatcaagaacaggtagaagtaatgttagatgtgacagatacaagtatggatacttatttggaaagagaatgggggaataaaccaagtgactgtgtaccctacaaagatgaagaactttatgatcttccagctccttgtactcctttgtcccttagttgccttcagctcagtactccagaaaatagagagagctctgtggtccaagcaggaggttccaaaaagcactcaaaccatctcagaaaattggtgtttgatgatttttgtgattcttcaaatgtttctaataaagattcttcagaagatgatataagtagaagtgaaaatgaaaagaaatcagaatgtttttcttccccaaagacaggattttgggactgttgttccacaagctatgcccaaaacttagattttgaaagttcagaggggaacacgatagcaaattctgttggagaaatatcttcaaaattgagtgagaaatcaggcttatgtttatccaaaaggttgaattctattcgctcttttgaaatgaaccggacaagaacatccagtgaagcatcgatggatgctgcttaccttgacaaaatctctgagttggattcaatgatgtcagagtcagacaacagcaagagcccttgtaataacggttttaagtcactggatttggatgggttatcaaagtcatctcaaggcagtgaatttcttgaggaacctgataagttggaagaaaaaactgagctaaacctttccaaaggttctctaactaatgatcagttagaaaatggaagtgaatggaaacccacttctttttttctcctctctccatctgaccaagaaatgaatgaagatttttcactccattccagttcttgtccagtaactaatgaaatcaaacccccaagctgcttgtttcagacagagttttcccagggcattttgttaagcagttcacatcgactatttgaagatcaaagatttgggtcatctttgtttaagatgtcctcagagatgcacagtcttcataaccaccttcagtctccttggtctacttcctttgtgcctgaaaagaggaataaaaatgtgaatcaatcaacaaaaagaaaaatccagagcagcctttccagtgccagcccatcaaaagcaactaaaagttgactcattagaaaggtgtcatttgtggttttgtcctgagagaaatagaaaagttgttaaagttaccttttttcctcataaaagttctatacaaattggaattgataatctttagtcaagtatcaagtcaggatggtggattaacctgtacccagaatacttattgttcattttgaaaagactttgttcttttcatttttatttgggagtctttgtgaccagagaagttagggaggaggttatttttgtgttttggggttggttggttggttggttttgtttttggttttgtttttttactgaatttgatatgtatctcggttggatatacattgtttttttaaaaaatgttatttaactgttagatacagtggcctgttgataagccccacttgtcttcagaacttggatttcttaaataaaacttttagtgttgtctatacactgctcaataagacacttgagtttaagcttttcccagggtggaaattattttacctgtccctttttatttatgtttagtgatggcctagtttttctgcagggccatgatggagaaatagcactctagccttagtccaatattgatttactttctttttttaggttttatgtatatgtttgcattttttagcattgtgttttgtccagttttgtgaaaatgttctgctagtatgaaagaaaacattttctatatgaagacatttgttttatgttaggtagcttacattttctcctctgcgtgtgtgtgtatgtgtgtaaaatcagaaatttagcatactatggaaagaaggcatggagcacttgggtttagaggaacctaaaacatcatagcttcattgttccagatgtaacaggtttgaaagagctcatcgccaagttcttgatccacttgcattccaggggagttttcttttgagtagtatgtttcttgtttgcatgttcctgttctttgtggaaactatgcatggtagcatttttgcttgctgtgttttccatacttaagaaaaagaggtttcagttggctgatagaatatcttttatgtaggacaaaacttttctgtgaagagtgttgagggggtgaagataggtaagaggtaagcacaatttttaatttaggctctgaaaaagtgtattgttctaaacgtatttggtatgcctatataggtctttaaaaatgggtatgtatgctgtttaatgtgcactgaacattttacattaatattgtactgttttacattaatactgcatgcttttctatgtgaattgaataaagaatgtcataagcactgtgttccttga

SEQ ID NO: 27888 - DNA, 4112 bp, Homo sapiens
cattcattcattcattcattcattaaaggaaaacgccttggagatcgcgcgtttcgaaagcgcgttttcgttttctctcctgggcgggttatggccctaccggggcgccgtagccggcccgcgcgtgcccagtcttggcgaagagtagcggtaggtcggcgggacttccgtgttggcgggattctgaacgctgccatggctcagaccgtgcagaatgttacattgtcgctcactctgcccatcacgtgccacatttgcttggggaaggtacgtcagcctgtcatatgcatcaacaaccatgtattttgttcgatttgtattgatttgtggttgaagaataatagccagtgtccagcttgcagagtccccatcactcctgaaaatccttgcaaagaaattataggaggaacaagtgaaagtgaacctatgctaagccatacggtcaggaagcatcttcggaaaactagacttgaattactacacaaagaatatgaggacgaaatagattgtttacagaaagaagtagaagagcttaagagtaaaaatctcagcttggagtcacagatcaaaactattctggatcctttaaccttggtgcagggcaaccaaaatgaagacaaacatctagtcacagataatccaagtaaaattaacccagaaactgtagcagagtggaagaaaaaactcagaacagctaatgaaatctatgaaaaagtgaaagatgatgtggataagctaaaggaggcaaataaaaaattgaaattggaaaatggtggtctggtgagggagaatttacgactgaaggctgaagttgataacagatcacctcaaaagtttggaaggtttgcagttgctgctcttcagtccaaagtagaacagtatgagcgtgaaaccaatcgcctcaagaaagccctggaacgaagtgataagtatatagaggaactagaatctcaagttgcacagctaaaaaattcaagtgaagagaaagaagctatgaattccatttgccagacagcactttctgcagatggcaaagggagcaaaggcagtgaggaggatgtggtgtcaaagaatcaaggcgatagtgccagaaagcagcctggctcatccacctccagttcttctcacctagcgaagccttccagcagcagactgtgtgacaccagttctgcaaggcaggaaagtaccagcaaagcagaccttaactgttctaagaacaaagacctatatcaagaacaggtagaagtaatgttagatgtgacagatacaagtatggatacttatttggaaagagaatgggggaataaaccaagtgactgtgtaccctacaaagatgaagaactttatgatcttccagctccttgtactcctttgtcccttagttgccttcagctcagtactccagaaaatagagagagctctgtggtccaagcaggaggttccaaaaagcactcaaaccatctcagaaaattggtgtttgatgatttttgtgattcttcaaatgtttctaataaagattcttcagaagatgatataagtagaagtgaaaatgaaaagaaatcagaatgtttttcttccccaaagacaggattttgggactgttgttccacaagctatgcccaaaacttagattttgaaagttcagaggggaacacgatagcaaattctgttggagaaatatcttcaaaattgagtgagaaatcaggcttatgtttatccaaaaggttgaattctattcgctcttttgaaatgaaccggacaagaacatccagtgaagcatcgatggatgctgcttaccttgacaaaatctctgagttggattcaatgatgtcagagtcagacaacagcaagagcccttgtaataacggttttaagtcactggatttggatgggttatcaaagtcatctcaaggcagtgaatttcttgaggaacctgataagttggaagaaaaaactgagctaaacctttccaaaggttctctaactaatgatcagttagaaaatggaagtgaatggaaacccacttctttttttctcctctctccatctgaccaagaaatgaatgaagatttttcactccattccagttcttgtccagtaactaatgaaatcaaacccccaagctgcttgtttcagacagagttttcccagggcattttgttaagcagttcacatcgactatttgaagatcaaagatttgggtcatctttgtttaagatgtcctcagagatgcacagtcttcataaccaccttcagtctccttggtctacttcctttgtgcctgaaaagaggaataaaaatgtgaatcaatcaacaaaaagaaaaatccagagcagcctttccagtgccagcccatcaaaagcaactaaaagttgactcattagaaaggtgtcatttgtggttttgtcctgagagaaatagaaaagttgttaaagttaccttttttcctcataaaagttctatacaaattggaattgataatctttagtcaagtatcaagtcaggatggtggattaacctgtacccagaatacttattgttcattttgaaaagactttgttcttttcatttttatttgggagtctttgtgaccagagaagttagggaggaggttatttttgtgttttggggttggttggttggttggttttgtttttggttttgtttttttactgaatttgatatgtatctcggttggatatacattgtttttttaaaaaatgttatttaactgttagatacagtggcctgttgataagccccacttgtcttcagaacttggatttcttaaataaaacttttagtgttgtctatacactgctcaataagacacttgagtttaagcttttcccagggtggaaattattttacctgtccctttttatttatgtttagtgatggcctagtttttctgcagggccatgatggagaaatagcactctagccttagtccaatattgatttactttctttttttaggttttatgtatatgtttgcattttttagcattgtgttttgtccagttttgtgaaaatgttctgctagtatgaaagaaaacattttctatatgaagacatttgttttatgttaggtagcttacattttctcctctgcgtgtgtgtgtatgtgtgtaaaatcagaaatttagcatactatggaaagaaggcatggagcacttgggtttagaggaacctaaaacatcatagcttcattgttccagatgtaacaggtttgaaagagctcatcgccaagttcttgatccacttgcattccaggggagttttcttttgagtagtatgtttcttgtttgcatgttcctgttctttgtggaaactatgcatggtagcatttttgcttgctgtgttttccatacttaagaaaaagaggtttcagttggctgatagaatatcttttatgtaggacaaaacttttctgtgaagagtgttgagggggtgaagataggtaagaggtaagcacaatttttaatttaggctctgaaaaagtgtattgttctaaacgtatttggtatgcctatataggtctttaaaaatgggtatgtatgctgtttaatgtgcactgaacattttacattaatattgtactgttttacattaatactgcatgcttttctatgtgaattgaataaagaatgtcataagcactgtgttccttgaaaaaaaaaaaacacaatacgaaacaaccaccaaggagcaccacccagcccacaaccacgcacaaccagcagcacctaccacacacaacacgcacgcgaacgccgccaaccaccaccgccccgacccggcggccaccacaaccgacccgcgaacaccactgcatcactaaccagcatgagcaagcacgcaacccaagaacaccgtgcaacgagcccagcgaacacgacagaaaacatcagaagagccagcgaacaacaaacaagcgcggctaccacgacaaccgagaaacaggccgccgacacaaagccaacctagcgggcgcagccagccagcagcgacacacctcatccgtcagcgcctgagcacccacgacaaaacacgacgctagccctcatacagaccacctaccgtagccagtagagaaaaaggaggggata

SEQ ID NO: 27889 - DNA, 284 bp, Homo sapiens
tgctattattatcatatgtttattattatgtaagtggggaaaccattttttgaaaatatacatctggcatttgccctactcattgagtggtctgaaatgtcactgttaggtgaaattagaatagcctgggacagtttgcactctcaaaccttgaaaagaaaaaagcttgagttataagattaactatctttccattctttgtaggtttggaaggtttgcagttgctgctcttcagtccaaagtagaacagtatgagcgtgaaaccaatcgcctcaagaaagccc

SEQ ID NO: 27890 - DNA, 3675 bp, Homo sapiens
cattcattcattcattcattcattaaaggaaaacgccttggagatcgcgcgtttcgaaagcgcgttttcgttttctctcctgggcgggttatggccctaccggggcgccgtagccggcccgcgcgtgcccagtcttggcgaagagtagcggtaggtcggcgggacttccgtgttggcgggattctgaacgctgccatggctcagaccgtgcagaatgttacattgtcgctcactctgcccatcacgtgccacatttgcttggggaaggtacgtcagcctgtcatatgcatcaacaaccatgtattttgttcgatttgtattgatttgtggttgaagaataatagccagtgtccagcttgcagagtccccatcactcctgaaaatccttgcaaagaaattataggaggaacaagtgaaagtgaacctatgctaagccatacggtcaggaagcatcttcggaaaactagacttgaattactacacaaagaatatgaggacgaaatagattgtttacagaaagaagtagaagagcttaagagtaaaaatctcagcttggagtcacagatcaaaactattctggatcctttaaccttggtgcagggcaaccaaaatgaagacaaacatctagtcacagataatccaagtaaaattaacccagaaactgtagcagagtggaagaaaaaactcagaacagctaatgaaatctatgaaaaagtgaaagatgatgtggataagctaaaggaggcaaataaaaaattgaaattggaaaatggtggtctggtgagggagaatttacgactgaaggctgaagttgataacagatcacctcaaaagtttggaaggtttgcagttgctgctcttcagtccaaagtagaacagtatgagcgtgaaaccaatcgcctcaagaaagccctggaacgaagtgataagtatatagaggaactagaatctcaagttgcacagctaaaaaattcaagtgaagagaaagaagctatgaattccatttgccagacagcactttctgcagatggcaaagggagcaaaggcagtgaggaggatgtggtgtcaaagaatcaaggcgatagtgccagaaagcagcctggctcatccacctccagttcttctcacctagcgaagccttccagcagcagactgtgtgacaccagttctgcaaggcaggaaagtaccagcaaagcagaccttaactgttctaagaacaaagacctatatcaagaacaggtagaagtaatgttagatgtgacagatacaagtatggatacttatttggaaagagaatgggggaataaaccaagtgactgtgtaccctacaaagatgaagaactttatgatcttccagctccttgtactcctttgtcccttagttgccttcagctcagtactccagaaaatagagagagctctgtggtccaagcaggaggttccaaaaagcactcaaaccatctcagaaaattggtgtttgatgatttttgtgattcttcaaatgtttctaataaagattcttcagaagatgatataagtagaagtgaaaatgaaaagaaatcagaatgtttttcttccccaaagacaggattttgggactgttgttccacaagctatgcccaaaacttagattttgaaagttcagaggggaacacgatagcaaattctgttggagaaatatcttcaaaattgagtgagaaatcaggcttatgtttatccaaaaggttgaattctattcgctcttttgaaatgaaccggacaagaacatccagtgaagcatcgatggatgctgcttaccttgacaaaatctctgagttggattcaatgatgtcagagtcagacaacagcaagagcccttgtaataacggttttaagtcactggatttggatgggttatcaaagtcatctcaaggcagtgaatttcttgaggaacctgataagttggaagaaaaaactgagctaaacctttccaaaggttctctaactaatgatcagttagaaaatggaagtgaatggaaacccacttctttttttctcctctctccatctgaccaagaaatgaatgaagatttttcactccattccagttcttgtccagtaactaatgaaatcaaacccccaagctgcttgtttcagacagagttttcccagggcattttgttaagcagttcacatcgactatttgaagatcaaagatttgggtcatctttgtttaagatgtcctcagagatgcacagtcttcataaccaccttcagtctccttggtctacttcctttgtgcctgaaaagaggaataaaaatgtgaatcaatcaacaaaaagaaaaatccagagcagcctttccagtgccagcccatcaaaagcaactaaaagttgactcattagaaaggtgtcatttgtggttttgtcctgagagaaatagaaaagttgttaaagttaccttttttcctcataaaagttctatacaaattggaattgataatctttagtcaagtatcaagtcaggatggtggattaacctgtacccagaatacttattgttcattttgaaaagactttgttcttttcatttttatttgggagtctttgtgaccagagaagttagggaggaggttatttttgtgttttggggttggttggttggttggttttgtttttggttttgtttttttactgaatttgatatgtatctcggttggatatacattgtttttttaaaaaatgttatttaactgttagatacagtggcctgttgataagccccacttgtcttcagaacttggatttcttaaataaaacttttagtgttgtctatacactgctcaataagacacttgagtttaagcttttcccagggtggaaattattttacctgtccctttttatttatgtttagtgatggcctagtttttctgcagggccatgatggagaaatagcactctagccttagtccaatattgatttactttctttttttaggttttatgtatatgtttgcattttttagcattgtgttttgtccagttttgtgaaaatgttctgctagtatgaaagaaaacattttctatatgaagacatttgttttatgttaggtagcttacattttctcctctgcgtgtgtgtgtatgtgtgtaaaatcagaaatttagcatactatggaaagaaggcatggagcacttgggtttagaggaacctaaaacatcatagcttcattgttccagatgtaacaggtttgaaagagctcatcgccaagttcttgatccacttgcattccaggggagttttcttttgagtagtatgtttcttgtttgcatgttcctgttctttgtggaaactatgcatggtagcatttttgcttgctgtgttttccatacttaagaaaaagaggtttcagttggctgatagaatatcttttatgtaggacaaaacttttctgtgaagagtgttgagggggtgaagataggtaagaggtaagcacaatttttaatttaggctctgaaaaagtgtattgttctaaacgtatttggtatgcctatataggtctttaaaaatgggtatgtatgctgtttaatgtgcactgaacattttacattaatattgtactgttttacattaatactgcatgcttttctatgtgaattgaataaagaatgtcataagcactgtgttccttga

SEQ ID NO: 27891 - DNA, 2130 bp, Homo sapiens
cattcattcattcattcattcattaaaggaaaacgccttggagatcgcgcgtttcgaaagcgcgttttcgttttctctcctgggcgggttatggccctaccggggcgccgtagccggcccgcgcgtgcccagtcttggcgaagagtagcggtaggtcggcgggacttccgtgttggcgggattctgaacgctgccatggctcagaccgtgcagaatgttacattgtcgctcactctgcccatcacgtgccacatttgcttggggaaggtacgtcagcctgtcatatgcatcaacaaccatgtattttgttcgatttgtattgatttgtggttgaagaataatagccagtgtccagcttgcagagtccccatcactcctgaaaatccttgcaaagaaattataggaggaacaagtgaaagtgaacctatgctaagccatacggtcaggaagcatcttcggaaaactagacttgaattactacacaaagaatatgaggacgaaatagattgtttacagaaagaagtagaagagcttaagagtaaaaatctcagcttggagtcacagatcaaaactattctggatcctttaaccttggtgcagggcaaccaaaatgaagacaaacatctagtcacagataatccaagtaaaattaacccagaaactgtagcagagtggaagaaaaaactcagaacagctaatgaaatctatgaaaaagtgaaagatgatgtggataagctaaaggagaggaataaaaatgtgaatcaatcaacaaaaagaaaaatccagagcagcctttccagtgccagcccatcaaaagcaactaaaagttgactcattagaaaggtgtcatttgtggttttgtcctgagagaaatagaaaagttgttaaagttaccttttttcctcataaaagttctatacaaattggaattgataatctttagtcaagtatcaagtcaggatggtggattaacctgtacccagaatacttattgttcattttgaaaagactttgttcttttcatttttatttgggagtctttgtgaccagagaagttagggaggaggttatttttgtgttttggggttggttggttggttggttttgtttttggttttgtttttttactgaatttgatatgtatctcggttggatatacattgtttttttaaaaaatgttatttaactgttagatacagtggcctgttgataagccccacttgtcttcagaacttggatttcttaaataaaacttttagtgttgtctatacactgctcaataagacacttgagtttaagcttttcccagggtggaaattattttacctgtccctttttatttatgtttagtgatggcctagtttttctgcagggccatgatggagaaatagcactctagccttagtccaatattgatttactttctttttttaggttttatgtatatgtttgcattttttagcattgtgttttgtccagttttgtgaaaatgttctgctagtatgaaagaaaacattttctatatgaagacatttgttttatgttaggtagcttacattttctcctctgcgtgtgtgtgtatgtgtgtaaaatcagaaatttagcatactatggaaagaaggcatggagcacttgggtttagaggaacctaaaacatcatagcttcattgttccagatgtaacaggtttgaaagagctcatcgccaagttcttgatccacttgcattccaggggagttttcttttgagtagtatgtttcttgtttgcatgttcctgttctttgtggaaactatgcatggtagcatttttgcttgctgtgttttccatacttaagaaaaagaggtttcagttggctgatagaatatcttttatgtaggacaaaacttttctgtgaagagtgttgagggggtgaagataggtaagaggtaagcacaatttttaatttaggctctgaaaaagtgtattgttctaaacgtatttggtatgcctatataggtctttaaaaatgggtatgtatgctgtttaatgtgcactgaacattttacattaatattgtactgttttacattaatactgcatgcttttctatgtgaattgaataaagaatgtcataagcactgtgttccttga

SEQ ID NO: 27892 - DNA, 1187 bp, Homo sapiens
cttagatttggaggttttgcggtactgaggggagttgggggaagaatggaaataccattgacctcctaaaaagttgttacttgcaaagtttgggaggtgacatcaaaaactcaactgcccttacaatagtcattccatccatctgttgcttatttgaattctcatttatttttactttatggcattaaaatacaataaatctgtcaattatgtattttatattagtagtagcttaagattgggtcacttcatttcggtagatataattgttagtattatccttcaggacaaaaagcatctgctaacaacctgtggtttaaaaatataggccaactttatgttcaaacattatgttgataatatttttagcagtattacacagtggaggtccaaattggattagacttttgcattgaattccaaagtattggtaagtctagcacatactataaagtcttgctaaattcttgtgggtacattatttttaaaacctgtctgtctgtcggtatcacacagaggtcacttcttgagtaaaataagatgaccttaagaattcacataattcttgaagaagaatataagtcacgatgcttccacatgaggccgcgtcacaccaccatcgtttggaaatccagcaccccagccgttttaccctaagataacagtgcagcacttagtgtggttgaatgtgtcatgtgggaatgatttttggtcaccttttcagttcattgttagtccttttatgtttgtgtgcatctatgttcgtctgtgtgtttggtaaatatgaattgaatagatgacttcttattttatgttttaggccaagattgacagacacctaatattcatgacttgagaatattctgcagctataaattttgaaccattgatgtgcaaagcaagacctgaagcccactccggaaactaaagtgaggctcgctaaccctctagattgcctcacagttgtttgtttacaaagtaaactttacatccaggggatgaagagcacccaccagcagaagactttgcagaacctttaattggatgtgttaagtgtttttaatgagtgtatgaaatgtagaaagatgtacaagaaataaattaggagagattactttgtattgtactgccattcctactgtatttttatactttttggcagcattaaatatttttgttaaatagtc

SEQ ID NO: 27893 - DNA, 1709 bp, Homo sapiens
cgccgcgctcgggcgccgagtctgcgcgctgacgtccgacgctccaggtactttccccacggccgacagggcttggcgtgggggcggggcgcggcgcgcagcgcgcatgcgccgcagcgccagcgctctccccggatcgtgcggggcctgagcctctccgccggcgcaggctctgctcgcgccagctcgctcccgcagccatgcccaccaccatcgagcgggagttcgaagagttggatactcagcgtcgctggcagccgctgtacttggaaattcgaaatgagtcccatgactatcctcatagagtggccaagtttccagaaaacagaaatcgaaacagatacagagatgtaagcccatatgatcacagtcgtgttaaactgcaaaatgctgagaatgattatattaatgccagtttagttgacatagaagaggcacaaaggagttacatcttaacacagggtccacttcctaacacatgctgccatttctggcttatggtttggcagcagaagaccaaagcagttgtcatgctgaaccgcattgtggagaaagaatcggttaaatgtgcacagtactggccaacagatgaccaagagatgctgtttaaagaaacaggattcagtgtgaagctcttgtcagaagatgtgaagtcgtattatacagtacatctactacaattagaaaatatcaatagtggtgaaaccagaacaatatctcactttcattatactacctggccagattttggagtccctgaatcaccagcttcatttctcaatttcttgtttaaagtgagagaatctggctccttgaaccctgaccatgggcctgcggtgatccactgtagtgcaggcattgggcgctctggcaccttctctctggtagacacttgtcttgttttgatggaaaaaggagatgatattaacataaaacaagtgttactgaacatgagaaaataccgaatgggtcttattcagaccccagatcaactgagattctcatacatggctataatagaaggagcaaaatgtataaagggagattctagtatacagaaacgatggaaagaactttctaaggaagacttatctcctgcctttgatcattcaccaaacaaaataatgactgaaaaatacaatgggaacagaataggtctagaagaagaaaaactgacaggtgaccgatgtacaggactttcctctaaaatgcaagatacaatggaggagaacagtgagagtgctctacggaaacgtattcgagaggacagaaaggccaccacagctcagaaggtgcagcagatgaaacagaggctaaatgagaatgaacgaaaaagaaaaaggccaagattgacagacacctaatattcatgacttgagaatattctgcagctataaattttgaaccattgatgtgcaaagcaagacctgaagcccactccggaaactaaagtgaggctcgctaaccctctagattgcctcacagttgtttgtttacaaagtaaactttacatccaggggatgaagagcacccaccagcagaagactttgcagaacctttaattggatgtgttaagtgtttttaatgagtgtatgaaatgtagaaagatgtacaagaaataaattaggagagattactttgtattgtactgccattcctactgtatttttatactttttggcagcattaaatatttttgttaaatagtc

SEQ ID NO: 27894 - DNA, 2538 bp, Homo sapiens
cgccgcgctcgggcgccgagtctgcgcgctgacgtccgacgctccaggtactttccccacggccgacagggcttggcgtgggggcggggcgcggcgcgcagcgcgcatgcgccgcagcgccagcgctctccccggatcgtgcggggcctgagcctctccgccggcgcaggctctgctcgcgccagctcgctcccgcagccatgcccaccaccatcgagcgggagttcgaagagttggatactcagcgtcgctggcagccgctgtacttggaaattcgaaatgagtcccatgactatcctcatagagtggccaagtttccagaaaacagaaatcgaaacagatacagagatgtaagcccatatgatcacagtcgtgttaaactgcaaaatgctgagaatgattatattaatgccagtttagttgacatagaagaggcacaaaggagttacatcttaacacagggtccacttcctaacacatgctgccatttctggcttatggtttggcagcagaagaccaaagcagttgtcatgctgaaccgcattgtggagaaagaatcggttaaatgtgcacagtactggccaacagatgaccaagagatgctgtttaaagaaacaggattcagtgtgaagctcttgtcagaagatgtgaagtcgtattatacagtacatctactacaattagaaaatatcaatagtggtgaaaccagaacaatatctcactttcattatactacctggccagattttggagtccctgaatcaccagcttcatttctcaatttcttgtttaaagtgagagaatctggctccttgaaccctgaccatgggcctgcggtgatccactgtagtgcaggcattgggcgctctggcaccttctctctggtagacacttgtcttgttttgatggaaaaaggagatgatattaacataaaacaagtgttactgaacatgagaaaataccgaatgggtcttattcagaccccagatcaactgagattctcatacatggctataatagaaggagcaaaatgtataaagggagattctagtatacagaaacgatggaaagaactttctaaggaagacttatctcctgcctttgatcattcaccaaacaaaataatgactgaaaaatacaatgggaacagaataggtctagaagaagaaaaactgacaggtgaccgatgtacaggactttcctctaaaatgcaagatacaatggaggagaacagtgagagtgctctacggaaacgtattcgagaggacagaaaggccaccacagctcagaaggtgcagcagatgaaacagaggctaaatgagaatgaacgaaaaagaaaaaggtggttatattggcaacctattctcactaagatggggtttatgtcagtcattttggttggcgcttttgttggctggacactgttttttcagcaaaatgccctataaacaattaattttgcccagcaagcttctgcactagtaactgacagtgctacattaatcataggggtttgtctgcagcaaacgcctcatatcccaaaaacggtgcagtagaatagacatcaaccagataagtgatatttacagtcacaagcccaacatctcaggactcttgactgcaggttcctctgaaccccaaactgtaaatggctgtctaaaataaagacattcatgtttgttaaaaactggtaaattttgcaactgtattcatacatgtcaaacacagtatttcacctgaccaacattgagatatcctttatcacaggatttgtttttggaggctatctggattttaacctgcacttgatataagcaataaatattgtggttttatctacgttattggaaagaaaatgacatttaaataatgtgtgtaatgtataatgtactattgacatgggcatcaacacttttattcttaagcatttcagggtaaatatattttataagtatctatttaatcttttgtagttaactgtactttttaagagctcaatttgaaaaatctgttactaaaaaaataaattgtatgtcgattgaattgtactggatacattttccatttttctaaagagaagtttgatatgagcagttagaagttggaataagcaatttctactatatattgcatttcttttatgttttacagttttccccattttaaaaagaaaagcaaacaaagaaacaaaagtttttcctaaaaatatctttgaaggaaaattctccttactgggatagtcaggtaaacagttggtcaagactttgtaaagaaattggtttctgtaaatcccattattgatatgtttatttttcatgaaaatttcaatgtagttggggtagattatgatttaggaagcaaaagtaagaagcagcattttatgattcataatttcagtttactagactgaagttttgaagtaaacacttttcagtttctttctacttcaataaatagtatgattatatgcaaaccttacattgtcattttaacttaatgaatattttttaaagcaaactgtttaatgaatttaactgc

SEQ ID NO: 27895 - DNA, 848 bp, Homo sapiens
  misc_feature (747)..(747): n is a, c, g, or t
  misc_feature (752)..(752): n is a, c, g, or t
  misc_feature (764)..(765): n is a, c, g, or t
cccttaggctaggtacgaggccggtgcttaatcggccgagggtagaagatgtgaagtcgtattatacagtacatctactacaattagaaaatatcaatagtggtgaaaccagaacaatatctcactttcattatactacctggccagattttggagtccctgaatcaccagcttcatttctcaatttcttgtttaaagtgagagaatctggctccttgaaccctgaccatgggcctgcggtgatccactgtagtgcaggcattgggcgctctggcaccttctctctggtagacacttgtcttgttttgatggaaaaaggagatgatattaacataaaacaagtgttactgaacatgagaaaataccgaatgggtcttattcagaccccagatcaactgagattctcatacatggctataatagaaggagcaaaatgtataaagggagattctagtatacagaaacgatggaaagaactttctaaggaagacttatctcctgcctttgatcattcaccaaacaaaataatgactgaaaaatacaatgggaacagaataggtctagaagaagaaaaactgacaggtgaccgatgtacaggactttcctctaaaatgcaagatacaatggaggagaacagtgagagtgctctacggaaacgtattcgagaggacagaaaggccaccacagctcagaaggtgcagcagatgaaacagaggctaaatgagaatgaacgaaaaagaaaaaggncaagnttgacagacacnnatattcatgacttgagtaatatggcaacgagactgagcccatcgactataaggagactgctcatctatgagctggatgtgtgc

SEQ ID NO: 27896 - DNA, 741 bp, Homo sapiens
cttagatttggaggttttgcggtactgaggggagttgggggaagaatggaaataccattgacctcctaaaaagttgttacttgcaaagtttgggaggtgacatcaaaaactcaactgcccttacaatagtcattccatccatctgttgcttatttgaattctcatttatttttactttatggcattaaaatacaataaatctgtcaattatgtattttatattagtagtagcttaagattgggtcacttcatttcggtagatataattgttagtattatccttcaggacaaaaagcatctgctaacaacctgtggtttaaaaatataggccaactttatgttcaaacattatgttgataatatttttagcagtattacacagtggaggtccaaattggattagacttttgcattgaattccaaagtattggtaagtctagcacatactataaagtcttgctaaattcttgtgggtacattatttttaaaacctgtctgtctgtcggtatcacacagaggtcacttcttgagtaaaataagatgaccttaagaattcacataattcttgaagaagaatataagtcacgatgcttccacatgaggccgcgtcacaccaccatcgtttggaaatccagcaccccagccgttttaccctaagataacagtgcagcacttagtgtggttgaataagctgactgatgggaagtgcagggcaggtcacctcgttaataatcgagtaat

SEQ ID NO: 27897 - DNA, 231 bp, Homo sapiens
atatcgtcgacccacgcgtccggtaaactttacatccaggggatgaagagcacccaccagcagaagactttgcagaacctttaattggatgtgttaagtgtttttaatgagtgtatgaaatgtagaaagatgtacaagaaataaattaggagagattactttgtattgtactgccattcctactgtatttttatactttttggcagcattaaatatttttgttaaatagtc

SEQ ID NO: 27898 - DNA, 1778 bp, Homo sapiens
cgccgcgctcgggcgccgagtctgcgcgctgacgtccgacgctccaggtactttccccacggccgacagggcttggcgtgggggcggggcgcggcgcgcagcgcgcatgcgccgcagcgccagcgctctccccggatcgtgcggggcctgagcctctccgccggcgcaggctctgctcgcgccagctcgctcccgcagccatgcccaccaccatcgagcgggagttcgaagagttggatactcagcgtcgctggcagccgctgtacttggaaattcgaaatgagtcccatgactatcctcatagagtggccaagtttccagaaaacagaaatcgaaacagatacagagatgtaagcccatatgatcacagtcgtgttaaactgcaaaatgctgagaatgattatattaatgccagtttagttgacatagaagaggcacaaaggagttacatcttaacacagggtccacttcctaacacatgctgccatttctggcttatggtttggcagcagaagaccaaagcagttgtcatgctgaaccgcattgtggagaaagaatcggttaaatgtgcacagtactggccaacagatgaccaagagatgctgtttaaagaaacaggattcagtgtgaagctcttgtcagaagatgtgaagtcgtattatacagtacatctactacaattagaaaatatcaattatattgagaacttgtggatcacactgtatttgaaattattaatgctggatgttaaaaggtcactaaaaagtggtgaaaccagaacaatatctcactttcattatactacctggccagattttggagtccctgaatcaccagcttcatttctcaatttcttgtttaaagtgagagaatctggctccttgaaccctgaccatgggcctgcggtgatccactgtagtgcaggcattgggcgctctggcaccttctctctggtagacacttgtcttgttttgatggaaaaaggagatgatattaacataaaacaagtgttactgaacatgagaaaataccgaatgggtcttattcagaccccagatcaactgagattctcatacatggctataatagaaggagcaaaatgtataaagggagattctagtatacagaaacgatggaaagaactttctaaggaagacttatctcctgcctttgatcattcaccaaacaaaataatgactgaaaaatacaatgggaacagaataggtctagaagaagaaaaactgacaggtgaccgatgtacaggactttcctctaaaatgcaagatacaatggaggagaacagtgagagtgctctacggaaacgtattcgagaggacagaaaggccaccacagctcagaaggtgcagcagatgaaacagaggctaaatgagaatgaacgaaaaagaaaaaggccaagattgacagacacctaatattcatgacttgagaatattctgcagctataaattttgaaccattgatgtgcaaagcaagacctgaagcccactccggaaactaaagtgaggctcgctaaccctctagattgcctcacagttgtttgtttacaaagtaaactttacatccaggggatgaagagcacccaccagcagaagactttgcagaacctttaattggatgtgttaagtgtttttaatgagtgtatgaaatgtagaaagatgtacaagaaataaattaggagagattactttgtattgtactgccattcctactgtatttttatactttttggcagcattaaatatttttgttaaatagtc

SEQ ID NO: 27899 - DNA, 817 bp, Homo sapiens
ttgggaagcagaatgggtctgggaatagtgccatagccatcctcatggcaaggagctctgaggatggctatggcactattcccagccccattctgtcataggttcgcaggcatacatggctataatagaaggagcaaaatgtataaagggagattctagtatacagaaacgatggaaagaactttctaaggaagacttatctcctgcctttgatcattcaccaaacaaaataatgactgaaaaatacaatgggaacagaataggtctagaagaagaaaaactgacaggtgaccgatgtacaggactttcctctaaaatgcaagatacaatggaggagaacagtgagagtgctctacggaaacgtattcgagaggacagaaaggccaccacagctcagaaggtgcagcagatgaaacagaggctaaatgagaatgaacgaaaaagaaaaaggccaagattgacagacacctaatattcatgacttgagaatattctgcagctataaattttgaaccattgatgtgcaaagcaagacctgaagcccactccggaaactaaagtgaggctcgctaaccctctagattgcctcacagttgtttgtttacaaagtaaactttacatccaggggatgaagagcacccaccagcagaagactttgcagaacctttaattggatgtgttaagtgtttttaatgagtgtatgaaatgtagaaagatgtacaagaaataaattaggagagattactttgtattgtactgccattcctactgtatttttatactttttggcagcattaaatatttttgttaaatagtc

SEQ ID NO: 27900 - DNA, 2221 bp, Homo sapiens
cgccgcgctcgggcgccgagtctgcgcgctgacgtccgacgctccaggtactttccccacggccgacagggcttggcgtgggggcggggcgcggcgcgcagcgcgcatgcgccgcagcgccagcgctctccccggatcgtgcggggcctgagcctctccgccggcgcaggctctgctcgcgccagctcgctcccgcagccatgcccaccaccatcgagcgggagttcgaagagttggatactcagcgtcgctggcagccgctgtacttggaaattcgaaatgagtcccatgactatcctcatagagtggccaagtttccagaaaacagaaatcgaaacagatacagagatgtaagcccatatgatcacagtcgtgttaaactgcaaaatgctgagaatgattatattaatgccagtttagttgacatagaagaggcacaaaggagttacatcttaacacagggtccacttcctaacacatgctgccatttctggcttatggtttggcagcagaagaccaaagcagttgtcatgctgaaccgcattgtggagaaagaatcggttaaatgtgcacagtactggccaacagatgaccaagagatgctgtttaaagaaacaggattcagtgtgaagctcttgtcagaagatgtgaagtcgtattatacagtacatctactacaattagaaaatatcaatagtggtgaaaccagaacaatatctcactttcattatactacctggccagattttggagtccctgaatcaccagcttcatttctcaatttcttgtttaaagtgagagaatctggctccttgaaccctgaccatgggcctgcggtgatccactgtagtgcaggcattgggcgctctggcaccttctctctggtagacacttgtcttgttttgatggaaaaaggagatgatattaacataaaacaagtgttactgaacatgagaaaataccgaatgggtcttattcagaccccagatcaactgagattctcatacatggctataatagaaggagcaaaatgtataaagggagattctagtatacagaaacgatggaaagaactttctaaggaagacttatctcctgcctttgatcattcaccaaacaaaataatgactgaaaaatacaatgggaacagaataggtctagaagaagaaaaactgacaggtgaccgatgtacaggactttcctctaaaatgcaagatacaatggaggagaacagtgagagtgctctacggaaacgtattcgagaggacagaaaggccaccacagctcagaaggtgcagcagatgaaacagaggctaaatgagaatgaacgaaaaagaaaaaggccaagattgacagacacctaatattcatgacttgagaatattctgcagctataaattttgaaccattgatgtgcaaagcaagacctgaagcccactccggaaactaaagtgaggctcgctaaccctctagattgcctcacagttgtttgtttacaaagtaaactttacatccaggggatgaagagcacccaccagcagaagactttgcagaacctttaattggatgtgttaagtgtttttaatgagtgtatgaaatgtagaaagatgtacaagaaataaattaggagagattactttgtattgtactgccattcctactgtatttttatactttttggcagcattaaatatttttgttaaatagtcaaaaaaaaaaaaaaaaaaaaaaaaaaaaaagaaaagaaaaaaaaagaaaaaaaaatgaaacaaaaaaaaaaaaaaagaaggaggagggcgcgcgagccgagagaggaacctcgcccgagagggaggaccgcaatcaagagcgacacaccacgcatttgttgtgaaacaaaggggggccccacataagagggccgtcaattataaatcaacaatcagagagcggcgagggcgccggtattacaaacaaccgcggtcgtgaggagggagacaaaagaatgcggcaaacgcaggacggagcgaacactcatgggagagaagaaaagaacaccctatctctcgttggggggggggcgaggagcacaaccatatcaggggaggaacacaacacccccacgaagagagagagattaacagccccgccgggggagaataatgaacaaccactgagcaggtggtaatagagtgggttacacacaacgccgcggacaagatgctgcagcggccgtgcagag

SEQ ID NO: 27901 - DNA, 753 bp, Homo sapiens
cacgcctgcagtctcagttacttgggaggctgaggcacgagaatcacttgagcgtgggaggcagaggttgcagtgaaccaagattgtaccactgcactccaggctgggtgacagagcaagacgctgtctcaaaagaatattgaggcttttcccctcattattccagtgttcaaatagggtgaaaactatgtggatggttttatttgcgcctaggtcctctgtgttagagtactcaagtcctgctctgtgtgcacttcctttcacttgtttttatttcctcatagtgctctacggaaacgtattcgagaggacagaaaggccaccacagctcagaaggtgcagcagatgaaacagaggctaaatgagaatgaacgaaaaagaaaaaggccaagattgacagacacctaatattcatgacttgagaatattctgcagctataaattttgaaccattgatgtgcaaagcaagacctgaagcccactccggaaactaaagtgaggctcgctaaccctctagattgcctcacagttgtttgtttacaaagtaaactttacatccaggggatgaagagcacccaccagcagaagactttgcagaacctttaattggatgtgttaagtgtttttaatgagtgtatgaaatgtagaaagatgtacaagaaataaattaggagagattactttgtattgtactgccattcctactgtatttttatactttttggcagcattaaatatttttgttaaatagtc

SEQ ID NO: 27902 - DNA, 1361 bp, Homo sapiens
cgccgcgctcgggcgccgagtctgcgcgctgacgtccgacgctccaggtactttccccacggccgacagggcttggcgtgggggcggggcgcggcgcgcagcgcgcatgcgccgcagcgccagcgctctccccggatcgtgcggggcctgagcctctccgccggcgcaggctctgctcgcgccagctcgctcccgcagccatgcccaccaccatcgagcgggagttcgaagagttggatactcagcgtcgctggcagccgctgtacttggaaattcgaaatgagtcccatgactatcctcatagagtggccaagtttccagaaaacagaaatcgaaacagatacagagatgtaagcccatatgatcacagtcgtgttaaactgcaaaatgctgagaatgattatattaatgccagtttagttgacatagaagaggcacaaaggagttacatcttaacacagggtccacttcctaacacatgctgccatttctggcttatggtttggcagcagaagaccaaagcagttgtcatgctgaaccgcattgtggagaaagaatcggttaaatgtgcacagtactggccaacagatgaccaagagatgctgtttaaagaaacaggattcagtgtgaagctcttgtcagaagatgtgaagtcgtattatacagtacatctactacaattagaaaatatcaatagtggtgaaaccagaacaatatctcactttcattatactacctggccagattttggagtccctgaatcaccagcttcatttctcaatttcttgtttaaagtgagagaatctggctccttgaaccctgaccatgggcctgcggtgatccactgtagtgcaggcattgggcgctctggcaccttctctctggtagacacttgtcttgttttgatggaaaaaggagatgatattaacataaaacaagtgttactgaacatgagaaaataccgaatgggtcttattcagaccccagatcaactgagattctcatacatggctataatagaaggagcaaaatgtataaagggagattctagtatacaggtaaacttcatacaggttttaaatcatatctatttgttaaatacacatagcatcaaataactgcactccacttgagcccttgtctttgtttcaaagagtgtatttgaatttttgtggtaaatccagctggctgtcttaaaattgtaaaattttagctagcttcctcatatatactcagcctcaggttaaatcctgtgtgttacttaaaagcccttgtagaaacaagatttcattaaagaaactgaatttttcattttgggggtggttaatcttttaattattaaagtaactggaaacttgaga

SEQ ID NO: 27903 - DNA, 1699 bp, Homo sapiens
cttagatttggaggttttgcggtactgaggggagttgggggaagaatggaaataccattgacctcctaaaaagttgttacttgcaaagtttgggaggtgacatcaaaaactcaactgcccttacaatagtcattccatccatctgttgcttatttgaattctcatttatttttactttatggcattaaaatacaataaatctgtcaattatgtattttatattagtagtagcttaagattgggtcacttcatttcggtagatataattgttagtattatccttcaggacaaaaagcatctgctaacaacctgtggtttaaaaatataggccaactttatgttcaaacattatgttgataatatttttagcagtattacacagtggaggtccaaattggattagacttttgcattgaattccaaagtattggtaagtctagcacatactataaagtcttgctaaattcttgtgggtacattatttttaaaacctgtctgtctgtcggtatcacacagaggtcacttcttgagtaaaataagatgaccttaagaattcacataattcttgaagaagaatataagtcacgatgcttccacatgaggccgcgtcacaccaccatcgtttggaaatccagcaccccagccgttttaccctaagataacagtgcagcacttagtgtggttgaatgtgtcatgtgggaatgatttttggtcaccttttcagttcattgttagtccttttatgtttgtgtgcatctatgttcgtctgtgtgtttggtaaatatgaattgaatagatgacttcttattttatgttttaggccaagattgacagacacctaatattcatgacttgagaatattctgcagctataaattttgaaccattgatgtgcaaagcaagacctgaagcccactccggaaactaaagtgaggctcgctaaccctctagattgcctcacagttgtttgtttacaaagtaaactttacatccaggggatgaagagcacccaccagcagaagactttgcagaacctttaattggatgtgttaagtgtttttaatgagtgtatgaaatgtagaaagatgtacaagaaataaattaggagagattactttgtattgtactgccattcctactgtatttttatactttttggcagcattaaatatttttgttaaatagtcaaaaaaaaaaaaaaaaaaaaaaaaaaaaaagaaaagaaaaaaaaagaaaaaaaaatgaaacaaaaaaaaaaaaaaagaaggaggagggcgcgcgagccgagagaggaacctcgcccgagagggaggaccgcaatcaagagcgacacaccacgcatttgttgtgaaacaaaggggggccccacataagagggccgtcaattataaatcaacaatcagagagcggcgagggcgccggtattacaaacaaccgcggtcgtgaggagggagacaaaagaatgcggcaaacgcaggacggagcgaacactcatgggagagaagaaaagaacaccctatctctcgttggggggggggcgaggagcacaaccatatcaggggaggaacacaacacccccacgaagagagagagattaacagccccgccgggggagaataatgaacaaccactgagcaggtggtaatagagtgggttacacacaacgccgcggacaagatgctgcagcggccgtgcagag

SEQ ID NO: 27904 - DNA, 1133 bp, Homo sapiens
cttagatttggaggttttgcggtactgaggggagttgggggaagaatggaaataccattgacctcctaaaaagttgttacttgcaaagtttgggaggtgacatcaaaaactcaactgcccttacaatagtcattccatccatctgttgcttatttgaattctcatttatttttactttatggcattaaaatacaataaatctgtcaattatgtattttatattagtagtagcttaagattgggtcacttcatttcggtagatataattgttagtattatccttcaggacaaaaagcatctgctaacaacctgtggtttaaaaatataggccaactttatgttcaaacattatgttgataatatttttagcagtattacacagtggaggtccaaattggattagacttttgcattgaattccaaagtattggtaagtctagcacatactataaagtcttgctaaattcttgtgggtacattatttttaaaacctgtctgtctgtcggtatcacacagaggtcacttcttgagtgatgcttccacatgaggccgcgtcacaccaccatcgtttggaaatccagcaccccagccgttttaccctaagataacagtgcagcacttagtgtggttgaatgtgtcatgtgggaatgatttttggtcaccttttcagttcattgttagtccttttatgtttgtgtgcatctatgttcgtctgtgtgtttggtaaatatgaattgaatagatgacttcttattttatgttttaggccaagattgacagacacctaatattcatgacttgagaatattctgcagctataaattttgaaccattgatgtgcaaagcaagacctgaagcccactccggaaactaaagtgaggctcgctaaccctctagattgcctcacagttgtttgtttacaaagtaaactttacatccaggggatgaagagcacccaccagcagaagactttgcagaacctttaattggatgtgttaagtgtttttaatgagtgtatgaaatgtagaaagatgtacaagaaataaattaggagagattactttgtattgtactgccattcctactgtatttttatactttttggcagcattaaatatttttgttaaatagtc

SEQ ID NO: 27905 - DNA, 710 bp, Homo sapiens
gatcacgctcggcactacttaatggtgtggtatacacagaggtcacttcttgagtaaaataagatgaccttaagaattcacataattcttgaagaagaatataagtcacgatgcttccacatgaggccgcgtcacaccaccatcgtttggaaatccagcaccccagccgttttaccctaagataacagtgcagcacttagtgtggttgaatgtgtcatgtgggaatgatttttggtcaccttttcagttcattgttagtccttttatgtttgtgtgcatctatgttcgtctgtgtgtttggtaaatatgaattgaatagatgacttcttattttatgttttaggccaagattgacagacacctaatattcatgacttgagaatattctgcagctataaattttgaaccattgatgtgcaaagcaagacctgaagcccactccggaaactaaagtgaggctcgctaaccctctagattgcctcacagttgtttgtttacaaagtaaactttacatccaggggatgaagagcacccaccagcagaagactttgcagaacctttaattggatgtgttaagtgtttttaatgagtgtatgaaatgtagaaagatgtacaagaaataaattaggagagattactttgtattgtactgccattcctactgtatttttatactttttggcagcattaaatatttttgttaaatagtc

SEQ ID NO: 27906 - DNA, 1335 bp, Homo sapiens
catagcggaacgactctcttaagctccaccgctacactgctctacggaaacgtattcgagaggacagaaaggccaccacagctcagaaggtgcagcagatgaaacagaggctaaatgagaatgaacgaaaaagaaaaaggtggttatattggcaacctattctcactaagatggggtttatgtcagtcattttggttggcgcttttgttggctggacactgttttttcagcaaaatgccctataaacaattaattttgcccagcaagcttctgcactagtaactgacagtgctacattaatcataggggtttgtctgcagcaaacgcctcatatcccaaaaacggtgcagtagaatagacatcaaccagataagtgatatttacagtcacaagcccaacatctcaggactcttgactgcaggttcctctgaaccccaaactgtaaatggctgtctaaaataaagacattcatgtttgttaaaaactggtaaattttgcaactgtattcatacatgtcaaacacagtatttcacctgaccaacattgagatatcctttatcacaggatttgtttttggaggctatctggattttaacctgcacttgatataagcaataaatattgtggttttatctacgttattggaaagaaaatgacatttaaataatgtgtgtaatgtataatgtactattgacatgggcatcaacacttttattcttaagcatttcagggtaaatatattttataagtatctatttaatcttttgtagttaactgtactttttaagagctcaatttgaaaaatctgttactaaaaaaataaattgtatgtcgattgaattgtactggatacattttccatttttctaaagagaagtttgatatgagcagttagaagttggaataagcaatttctactatatattgcatttcttttatgttttacagttttccccattttaaaaagaaaagcaaacaaagaaacaaaagtttttcctaaaaatatctttgaaggaaaattctccttactgggatagtcaggtaaacagttggtcaagactttgtaaagaaattggtttctgtaaatcccattattgatatgtttatttttcatgaaaatttcaatgtagttggggtagattatgatttaggaagcaaaagtaagaagcagcattttatgattcataatttcagtttactagactgaagttttgaagtaaacacttttcagtttctttctacttcaataaatagtatgattatatgcaaaccttacattgtcattttaacttaatgaatattttttaaagcaaactgtttaatgaatttaactgc

SEQ ID NO: 27907 - DNA, 1489 bp, Homo sapiens
aaggatgccttatgggtgctccatcccccgctggcagccggtatacttggaaattcgaaatgagtcccatgactatcctcatagagtggccaagtttccagaaaacagaaatcgaaacagatacagagatgtaagcccatatgatcacagtcgtgttaaactgcaaaatgctgagaatgattatattaatgccagtttagttgacatagaagaggcacaaaggagttacatcttaacacagggtccacttcctaacacatgctgccatttctggcttatggtttggcagcagaagaccaaagcagttgtcatgctgaaccgcattgtggagaaagaatcggttaaatgtgcacagtactggccaacagatgaccaagagatgctgtttaaagaaacaggattcagtgtgaagctcttgtcagaagatgtgaagtcgtattatacagtacatctactacaattagaaaatatcaatagtggtgaaaccagaacaatatctcactttcattatactacctggccagattttggagtccctgaatcaccagcttcatttctcaatttcttgtttaaagtgagagaatctggctccttgaaccctgaccatgggcctgcggtgatccactgtagtgcaggcattgggcgctctggcaccttctctctggtagacacttgtcttgttttgatggaaaaaggagatgatattaacataaaacaagtgttactgaacatgagaaaataccgaatgggtcttattcagaccccagatcaactgagattctcatacatggctataatagaaggagcaaaatgtataaagggagattctagtatacagaaacgatggaaagaactttctaaggaagacttatctcctgcctttgatcattcaccaaacaaaataatgactgaaaaatacaatgggaacagaataggtctagaagaagaaaaactgacaggtgaccgatgtacaggactttcctctaaaatgcaagatacaatggaggagaacagtgagagtgctctacggaaacgtattcgagaggacagaaaggccaccacagctcagaaggtgcagcagatgaaacagaggctaaatgagaatgaacgaaaaagaaaaaggccaagattgacagacacctaatattcatgacttgagaatattctgcagctataaattttgaaccattgatgtgcaaagcaagacctgaagcccactccggaaactaaagtgaggctcgctaaccctctagattgcctcacagttgtttgtttacaaagtaaactttacatccaggggatgaagagcacccaccagcagaagactttgcagaacctttaattggatgtgttaagtgtttttaatgagtgtatgaaatgtagaaagatgtacaagaaataaattaggagagattactttgtattgtactgccattcctactgtatttttatactttttggcagcattaaatatttttgttaaatagtc

SEQ ID NO: 27908 - DNA, 1091 bp, Homo sapiens
ctcccgggttcaaacgttgacacttcagcctcccaagtagctgggattacaggcatgcacctctatgcccagataagagtggtgaaaccagaacaatatctcactttcattatactacctggccagattttggagtccctgaatcaccagcttcatttctcaatttcttgtttaaagtgagagaatctggctccttgaaccctgaccatgggcctgcggtgatccactgtagtgcaggcattgggcgctctggcaccttctctctggtagacacttgtcttgttttgatggaaaaaggagatgatattaacataaaacaagtgttactgaacatgagaaaataccgaatgggtcttattcagaccccagatcaactgagattctcatacatggctataatagaaggagcaaaatgtataaagggagattctagtatacagaaacgatggaaagaactttctaaggaagacttatctcctgcctttgatcattcaccaaacaaaataatgactgaaaaatacaatgggaacagaataggtctagaagaagaaaaactgacaggtgaccgatgtacaggactttcctctaaaatgcaagatacaatggaggagaacagtgagagtgctctacggaaacgtattcgagaggacagaaaggccaccacagctcagaaggtgcagcagatgaaacagaggctaaatgagaatgaacgaaaaagaaaaaggccaagattgacagacacctaatattcatgacttgagaatattctgcagctataaattttgaaccattgatgtgcaaagcaagacctgaagcccactccggaaactaaagtgaggctcgctaaccctctagattgcctcacagttgtttgtttacaaagtaaactttacatccaggggatgaagagcacccaccagcagaagactttgcagaacctttaattggatgtgttaagtgtttttaatgagtgtatgaaatgtagaaagatgtacaagaaataaattaggagagattactttgtattgtactgccattcctactgtatttttatactttttggcagcattaaatatttttgttaaatagtc

SEQ ID NO: 27909 - DNA, 1445 bp, Homo sapiens
  misc_feature (1344)..(1344): n is a, c, g, or t
  misc_feature (1349)..(1349): n is a, c, g, or t
  misc_feature (1361)..(1362): n is a, c, g, or t
cgccgcgctcgggcgccgagtctgcgcgctgacgtccgacgctccaggtactttccccacggccgacagggcttggcgtgggggcggggcgcggcgcgcagcgcgcatgcgccgcagcgccagcgctctccccggatcgtgcggggcctgagcctctccgccggcgcaggctctgctcgcgccagctcgctcccgcagccatgcccaccaccatcgagcgggagttcgaagagttggatactcagcgtcgctggcagccgctgtacttggaaattcgaaatgagtcccatgactatcctcatagagtggccaagtttccagaaaacagaaatcgaaacagatacagagatgtaagcccatatgatcacagtcgtgttaaactgcaaaatgctgagaatgattatattaatgccagtttagttgacatagaagaggcacaaaggagttacatcttaacacagggtccacttcctaacacatgctgccatttctggcttatggtttggcagcagaagaccaaagcagttgtcatgctgaaccgcattgtggagaaagaatcggttaaatgtgcacagtactggccaacagatgaccaagagatgctgtttaaagaaacaggattcagtgtgaagctcttgtcagaagatgtgaagtcgtattatacagtacatctactacaattagaaaatatcaatagtggtgaaaccagaacaatatctcactttcattatactacctggccagattttggagtccctgaatcaccagcttcatttctcaatttcttgtttaaagtgagagaatctggctccttgaaccctgaccatgggcctgcggtgatccactgtagtgcaggcattgggcgctctggcaccttctctctggtagacacttgtcttgttttgatggaaaaaggagatgatattaacataaaacaagtgttactgaacatgagaaaataccgaatgggtcttattcagaccccagatcaactgagattctcatacatggctataatagaaggagcaaaatgtataaagggagattctagtatacagaaacgatggaaagaactttctaaggaagacttatctcctgcctttgatcattcaccaaacaaaataatgactgaaaaatacaatgggaacagaataggtctagaagaagaaaaactgacaggtgaccgatgtacaggactttcctctaaaatgcaagatacaatggaggagaacagtgagagtgctctacggaaacgtattcgagaggacagaaaggccaccacagctcagaaggtgcagcagatgaaacagaggctaaatgagaatgaacgaaaaagaaaaaggncaagnttgacagacacnnatattcatgacttgagtaatatggcaacgagactgagcccatcgactataaggagactgctcatctatgagctggatgtgtgc

SEQ ID NO: 27910 - DNA, 505 bp, Homo sapiens
  misc_feature (405)..(405): n is a, c, g, or t
tgacaccccgcggggcggcaacgggcagggcctccagtgcaccttctgcgccgtggagccgcgggggctcagctgggcggtggtcgggtcctgaggccggagggcgggagcaggggaggggaaaagcaaaagcggggaaagaagccggggagcggtggaccagacgtccagacctcctgaaaggctggcggggaggcacaggcgggatcttccggaggtgagaatttttttttattatagcagaatggggaggaattgaggggaaaatggagatagaacctgaaagagccccaaacgccagaacctgtagctccccaagaataagatcttccagaagaactagacccaaaactagccgttggggaacaccgaaatccttggaggagcaacatccgcatgaccctntgtgttcctttaggcaaaaggacttgcttccattgtttgttcaattgtttgtgtttgttaaataaataaaacgattttcatgtatctttgaaattaaaaa

SEQ ID NO: 27911 - DNA, 373 bp, Homo sapiens
tcctcagcccacccccaccacctcattcccaaaacattttatggtgatggcaatacaaggaaacagtgaaacagtagacaagtatggcacagtaagaacaaactaagtttatatgagcgttaatattatcatggcccttccttgtttcaataatcataataattatatgttaacaaaatacttaaaactctgtgtatatatacagaattcacactgagcaattccctaatcctgtagaaaatactcatttgctaaagagcagccactcatcttgatgagaagtattatggctctccatcttcatgaggaaatcacagggaataggccgggcgtggtggctcatgcctgtaatcccagtactttgggaggctga

SEQ ID NO: 27912 - DNA, 509 bp, Homo sapiens
gtgatgaattttcccccgacttgtatactcatgtaaccatcactcagctcaaatccttgcactgtgttttaatcttttttttttttcccagtagtctattttttttggtcattttccctgccagcctgggaatccttcaagggcaggagcacctgctgttgggccctgtgcggtgtgggacacagtgtgagagagtattggtgcctgtgagctggtggctgtgtccccacccctgtgattgtccccacgtgtgtgtgtgacggaggctgtggccgtgggaacatgtggatctgtgagcctggccaggggccccagtgcaggggcaagcgccccctcctccactggaagagagccttgtccgatcccccagccaagggcctttgcagggagccgtggccctgctggagagtccccgccggctgacagcccggagattagtctccaaggccacaacgccagtttccataggcacgcaggcccgcgtcaggactgcgatttctcatcctggt

SEQ ID NO: 27913 - DNA, 804 bp, Homo sapiens
cccactgaaagctctactaaggctttgacatttcttgtccaccaatttctagataatgttcatctttgtccctcttcactagtggacacctaagtcagcttgtgctcttccaaatggggaagaaaaccatttggaagggtgtccatccagaagtagtagaaaactaataataatcagggagattatttaactaaattgtcaaatgattccagcactgttgattttgccataaatcttcttaattataaataataaaaccaagatgcaaaaaataaaacaagtattcatcaaactgactctgaagaaaagcaaagacacttaaataaaagggaacgacaagatttttaaagcaacctcagaaactctcaaaactgccctagaagtccgtgatgaattattcaagttggatgtgagttctgtgtggggaaaggtcaaaaggatagtttttgttaaagcctatccccagactgactttgacagctgctggcaaagctccgctgtcggctgggagttaactcaccaggacccacctgctgctgtggcccatttagcaatgaggaataaggcgggctggatgcagcctcaaacatcaaaggtgtgaaaagacttgactcccttacctggacactagggttgggcatgtgatgtggagataacagatgttatgatgctgtgccgccgtaaggaatacagaagatattcaaacccttgaaaatgaaaaggtctatgcaattctaagtattcctttaattagattattataacttgttaaagttattttccatgtggtaatcttactagtaa

SEQ ID NO: 27914 - DNA, 649 bp, Homo sapiens
cgcttgcgatctctcgccgccggcagaggctcctcgaagagcgacacggggctgaccaggcacggtggtcaaagccgcagagggagagcgggagcggtcgtgaggtcgtctggggagaagggcggaggcaaagccgaggaggtgcgggttgtggtccattctggaggacgctgatcgaatgccccaaacttcccggaatgtgtgtggacccttctagcctgaggagtcctgcaggtgtgaagctccacacctgcctccatagcactttgcctgtccctaagagggctcatcggagaagaaagaatggctgtcagccacctgccaaccatggtccaggaatcggtgaccttcaaggatgtggctatactgttcacccaggaagagtgggggcagctgagccccgcccagagggccctgtacagggacgtgatgctggagaactacagcaacctggtctcactgggactcttaggacccaaaccagatacgttttcccagctagaaaaaagggaagtgtggatgccagaggacacccctggaggcttctgtcttgatggagtctcgctctgttaccaagccggagcttgcagtgagccgagatcgcgccattgcactccagcctgggcgacagagcaagacttcatctcaa

SEQ ID NO: 27915 - DNA, 694 bp, Homo sapiens
cgcttgcgatctctcgccgccggcagaggctcctcgaagagcgacacggggctgaccaggcacggtggtcaaagccgcagagggagagcgggagcggtcgtgaggtcgtctggggagaagggcggaggcaaagccgaggaggtgcgggttgtggtccattctggaggacgctgatcgaatgccccaaacttcccggaatgtgtgtggacccttctagcctgaggagtcctgcaggtgtgaagctccacacctgcctccatagcactttgcctgtccctaagagggctcatcggagaagaaagaatggctgtcagccacctgccaaccatggtccaggaatcggtgaccttcaaggatgtggctatactgttcacccaggaagagtgggggcagctgagccccgcccagagggccctgtacagggacgtgatgctggagaactacagcaacctggtctcactgggactcttaggacccaaaccagatacgttttcccagctagaaaaaagggaagtgtggatgccagaggacacccctggaggcttctgtcttgactggatgactatgcctgccagtaagaaatctactgtcaaggcagagattcctgaagaagaattggatcaatggacaataaaggaaagattcagtagcagtagtcactggaagtgtgctagcctgctggagtggcaatgtg

SEQ ID NO: 27916 - DNA, 5477 bp, Homo sapiens
  misc_feature (2778)..(2778): n is a, c, g, or t
  misc_feature (2799)..(2799): n is a, c, g, or t
acagcttgcaacactcggcatcttttctggaggcgcctccttcagcagccgcagatggcatccggctgcgggctcggggctcgcaattgattctcccccttgcccacctcgagtccacggacgcacctctcccttcccctcctcccttcgcgcttctgggtctgagcccagctcgcgaccgccgggcagaggatcagtcgcggcggccgaggctgagcagcagcgctctcgctccctgacctggggagaagcgcccacccgggagagctgatccccggctgcctccagcgccccccaccttttgcactccaagccgggggctccagagaccccgctccccaggcgccactatgctggacccttcgtccagcgaagaagaatcggatgagatcgtggaggaggagagcggcaaggaggtgctcggctcggccccgtccggcgcgcgcctgtctcccagccgtaccagcgagggctcggccggcagcgccgggctggggggcggcggcgccggcgccggagccggggtgggtgcaggcggcggcgggggcagcggcgcgagcagcggcggcggggccggggggctgcaacccagcagccgcgctggcggcggccggccctccagccccagcccgtcggtggtgagcgagaaggagaaggaagagttggagcggctgcagaaagaggaggaggagaggaagaagaggctgcagctgtatgtgttcgtgatgcgctgcatcgcctacccctttaatgccaagcagcccaccgacatggctcgccggcagcagaagatcagcaaacagcagctgcagacagtcaaggaccggtttcaggctttcctcaatggggaaacccagatcatggctgacgaagccttcatgaacgctgtgcagagttactatgaggtgttcctgaagagcgaccgtgtggcccgcatggttcagagtggaggctgttccgccaacgactcccgggaggtcttcaagaagcacattgagaagagagtgcgcagcctgcctgagattgacggcctcagcaaggagactgtgctgagctcctggatggccaaatttgatgccatctaccgtggagaagaggacccgcggaagcagcaggcccggatgacagccagcgcagcctccgagctgattctgagcaaggagcaactctatgagatgttccagaacattcttgggatcaagaagttcgaacatcagctcctttacaatgcctgccagctggacaatccagatgagcaagcagcccagatcagacgagagctggatggacgtctacaaatggcagaccaaatagccagggaacgcaaatttcccaagtttgtatccaaagaaatggaaaacatgtacattgaggagctgaagtcatctgtcaacctgctcatggccaacttggagagcatgccggtatccaaaggcggggagttcaagctccagaaactcaaacgcagccacaatgcttccatcatcgacatgggcgaggagagtgagaaccagctctccaagtcagatgtcgtgctgtctttctcattggaggtggtaattatggaagtccaaggcctcaaatctttggctccaaatcgcatcgtatattgcacaatggaggtggaaggaggagagaaactacagactgatcaggccgaggcttctaaaccaacctggggcacccagggtgacttctccacaacccatgcactgccagctgtgaaggtgaagctgttcacagagagcacaggcgtcctggcgttggaggacaaggagcttgggcgggttattctccatcccaccccgaacagccccaaacagtcagagtggcacaaaatgacagtctccaaaaactgccccgaccaagatctcaaaatcaaacttgctgtccgaatggataagcctcaaaacatgaagcattctgggtatttatgggccatcggtaagaatgtctggaagagatggaagaaaaggttttttgtattggtgcaggtcagtcagtacacgtttgccatgtgcagttatcgggagaagaaagcggagcctcaggaacttctacaattggatggctacactgtggattacaccgacccccagccaggtttggagggtggccgagccttcttcaatgctgtcaaggagggagacaccgtgatatttgccagtgacgatgaacaagaccgcatcctgtgggtccaggccatgtatcgggccacggggcagtcacacaagcctgtgcccccgacccaagtccagaaactcaacgccaagggaggaaatgtacctcagctggatgcccctatctctcaattttacgcagatagagctcaaaaacatggcatggatgaatttatctcttccaacccctgtaactttgaccacgcttccctctttgagatggtacaacgccttactttggatcacagacttaatgattcctattcttgcctgggctggttcagtcctggccaggtgtttgtactagacgagtattgcgcccgaaatggagtccgggggtgtcaccgacatctctgctacctcagagacttgcttgaacgggcagaaaatggcgccatgatcgaccccacccttcttcactacagctttgccttctgtgcatcccatgtccatgggaacaggcctgatggaattggaactgtgactgttgaagaaaaggaacgttttgaagaaatcaaagagaggctccgagttctgctagaaaatcagattacacattttaggtattgctttccatttggtcgacctgaaggtgctntgaaagctactctctcactcntggaaagggttttgatgaaagatattgttaccccagtgccacaagaggaggtaaaaacagttatccgtaaatgtctggaacaggctgcgttagtcaactattctcggctctcagagtatgccaaaatcgaagagaatcaaaaggatgcagaaaatgtaggccggttaatcactcctgccaaaaagcttgaagatacaatacgtcttgctgaactagtcattgaagttcttcagcaaaatgaggagcaccacgcagagccacatgttgataaaggagaagcctttgcgtggtggtcagatttaatggtggagcatgcggagacgttcctgtcactctttgcagtagacatggatgcagccttagaggtgcaacctccagacacatgggacagttttccactatttcagctgctgaatgattttctccgtactgactataatttgtgcaatggaaaatttcacaaacacctgcaagacctgtttgccccacttgttgttagatatgtggatctgatggagtcctcaattgcacaatccattcacaggggctttgagcgggagtcatgggaaccagtcaagagtttaaccagtaacctacccaatgtgaacctacccaatgtgaaccttcccaaagtaccaaatctaccagttaacatccctctaggcatcccacaaatgcctactttttcggcaccgtcatggatggctgctatatatgatgcggataatgggtcaggcacctcagaagatctgttttggaaacttgacgcccttcagaccttcattcgggacctgcactggcctgaagaagagtttggaaagcacctggaacaacggctgaagttgatggcaagtgacatgatcgaatcttgtgtcaaaagaaccaggattgcatttgaagttaagctgcaaaaaaccagtcgatcaacagattttcgagtcccacagtcaatatgcaccatgtttaatgttatggttgatgccaaagctcaatcaacaaaactttgcagcatggaaatgggccaagagcatcaataccattcaaaaatagacgaactaattgaagaaactgttaaagaaatgataacactcttggttgcaaagttcgttactatcttggaaggagtgctggcaaaattatccagatatgacgaagggactttgttttcttcttttctgtcatttaccgtgaaggcagcttccaaatatgtggatgtacctaaacccgggatggacgtggccgacgcctacgtgactttcgtccgccattctcaggatgtcctgcgtgataaggtcaatgaggagatgtacatagaaaggttatttgatcaatggtacaacagctccatgaacgtgatctgcacctggttgacggaccggatggacttacagcttcatatttatcagttgaaaacactaattaggatggtaaagaaaacctacagagatttccgattgcaaggggtcctggactccaccttaaacagcaagacctatgaaacgatccggaaccgtctcactgtggaggaagccacagcatcagtgagtgaaggtgggggactgcagggcatcagcatgaaggacagcgatgaggaagacgaagaagacgattagaccatttggtcctagagtctgctgggacagagtcctgtaatcagtgcatgtccttagtctgttagttaaacccattaggaattttctgtcaactaccatgcccatgagatgtttatcaatacaactgccattttagctatgtggtaccaagattagcaaatgaccttcatatccactgatttcctgatgtccatgtctatatgtttacaagcaatatggagcaccattctttaaatactgttcatggagaatacatagtctaaccactaggcgtgtccctgttatcagcaaagatcaatgatgcttcattcatgtactatgtatgcattggtggtaaatggatgtgagggcaagtacatcaagtacattcactctgtttcacgtatgtggatgccagttaattaaatgagtacgtaaataaattaattaaaacacatagatctgctttgtgtttttatttttattttttgaaaaacaaaaggcaagtctccaacaattaacttttgatgctttctgttcccctaaaaccaaaaaatgaaccccttgtgtcgttgttaacccatcctttcatttactcatataattagccaaaaaaaaaaggatggctacataccaatggattgattctcttaattgccacggcaagggggcgatcctatcatgacttaacatcaagcgcgcagttcaaaactactgtcttctgtcaaagttttctcctcttaaatgttattttgcttttacgtctcaactgtgtatgtaaaaaaaacgaatatttaaattacaaccctagactaaaaatgtgtttataataagatgtggatatttccttcagtagattgtaaccataatttaaattattttgttccacactgttttttatatctgtcatgtacattgcattttgatctgtaactgcacaaccctggggtttgctgcagagctatttctttccatgtaaagtagtggatccatcttgcttttgccttatataaagcctacagttatggaagtgtggaaaactgtggcttctcaataaatattcagatgtcctaagaataaacgatt

SEQ ID NO: 27917 - DNA, 430 bp, Homo sapiens
taaagatttatccattagataaatttgccaggaaaaaatttatcatagaaaaactatttataaaatcctacaatctcaatgcccttcttagccaggcttgatttctggaaagaggaagcagttctaatatcaattcctaccagcccaggctgtggacagcaatcccatgcctacaaagctgatccagcagaagcatctcagggtgtgtgagggcaagtagagggtacaagtgaatggtaaacaaggaagagtggctgtctgaaaattcgttttcatgttttcctgtttctttacagaatatataggactcttttccaccactaactaatctatccactcatcaattctcatgatgtccctgcgctgataatggccaaacgaagagatgtacattataaaggttattttaatcgttagtaaaatgaccttt

SEQ ID NO: 27918 - DNA, 2604 bp, Homo sapiens
tggcacgaggctactctctcactcttggaaagggttttgatgaaagatattgttaccccagtgccacaagaggaggtaaaaacagttatccgtaaatgtctggaacaggctgcgttagtcaactattctcggctctcagagtatgccaaaatcgaagggaaaaagagagaaatgtatgagcatcctgtcttctgcttggcctcccaagtgatggatttaaccattcagaatcaaaaggatgcagaaaatgtaggccggttaatcactcctgccaaaaagcttgaagatacaatacgtcttgctgaactagtcattgaagttcttcagcaaaatgaggagcaccacgcagaggcctttgcgtggtggtcagatttaatggtggagcatgcggagacgttcctgtcactctttgcagtagacatggatgcagccttagaggtgcaacctccagacacatgggacagttttccactatttcagctgctgaatgattttctccgtactgactataatttgtgcaatggaaaatttcacaaacacctgcaagacctgtttgccccacttgttgttagatatgtggatctgatggagtcctcaattgcacaatccattcacaggggctttgagcgggagtcatgggaaccagtcaataatgggtcaggcacctcagaagatctgttttggaaacttgacgcccttcagaccttcattcgggacctgcactggcctgaagaagagtttggaaagcacctggaacaacggctgaagttgatggcaagtgacatgatcgaatcttgtgtcaaaagaaccaggattgcatttgaagttaagctgcaaaaaaccagtcgatcaacagattttcgagtcccacagtcaatatgcaccatgtttaatgttatggttgatgccaaagctcaatcaacaaaactttgcagcatggaaatgggccaagagcatcaataccattcaaaaatagacgaactaattgaagaaactgttaaagaaatgataacactcttggttgcaaagttcgttactatcttggaaggagtgctggcaaaattatccagatatgacgaagggactttgttttcttcttttctgtcatttaccgtgaaggcagcttccaaatatgtggatgtacctaaacccgggatggacgtggccgacgcctacgtgactttcgtccgccattctcaggatgtcctgcgtgataaggtcaatgaggagatgtacatagaaaggttatttgatcaatggtacaacagctccatgaacgtgatctgcacctggttgacggaccggatggacttacagcttcatatttatcagttgaaaacactaattaggatggtaaagaaaacctacagagatttccgattgcaaggggtcctggactccaccttaaacagcaagacctatgaaacgatccggaaccgtctcactgtggaggaagccacagcatcagtgagtgaaggtgggggactgcagggcatcagcatgaaggacagcgatgaggaagacgaagaagacgattagaccatttggtcctagagtctgctgggacagagtcctgtaatcagtgcatgtccttagtctgttagttaaacccattaggaattttctgtcaactaccatgcccatgagatgtttatcaatacaactgccattttagctatgtggtaccaagattagcaaatgaccttcatatccactgatttcctgatgtccatgtctatatgtttacaagcaatatggagcaccattctttaaatactgttcatggagaatacatagtctaaccactaggcgtgtccctgttatcagcaaagatcaatgatgcttcattcatgtactatgtatgcattggtggtaaatggatgtgagggcaagtacatcaagtacattcactctgtttcacgtatgtggatgccagttaattaaatgagtacgtaaataaattaattaaaacacatagatctgctttgtgtttttatttttattttttgaaaaacaaaaggcaagtctccaacaattaacttttgatgctttctgttcccctaaaaccaaaaaatgaaccccttgtgtcgttgttaacccatcctttcatttactcatataattagccaaaaaaaaaaggatggctacataccaatggattgattctcttaattgccacggcaagggggcgatcctatcatgacttaacatcaagcgcgcagttcaaaactactgtcttctgtcaaagttttctcctcttaaatgttattttgcttttacgtctcaactgtgtatgtaaaaaaaacgaatatttaaattacaaccctagactaaaaatgtgtttataataagatgtggatatttccttcagtagattgtaaccataatttaaattattttgttccacactgttttttatatctgtcatgtacattgcattttgatctgtaactgcacaaccctggggtttgctgcagagctatttctttccatgtaaagtagtggatccatcttgcttttgccttatataaagcctacagttatggaagtgtggaaaactgtggcttctcaataaatattcagatgtcctaagaataaacgatt

SEQ ID NO: 27919 - DNA, 3487 bp, Homo sapiens
  misc_feature (809)..(809): n is a, c, g, or t
  misc_feature (830)..(830): n is a, c, g, or t
atggtcctcagcggagacaggacaaggagtcaaggtcaggcatggtcccctctttctttggactatgtgacaagggggatgtggaattcatttgtgtcgaagatcagggcctcttgggagggttcgggtccctgtcagccttgtgaagcagcttgaagagcccggttccaatgttcatcgggattcccatgatgatgccaacgatggtcctcagctcaacgatggtcctcagctcaacgatggtcctcagctcaacgatggtcctcagctcaacgatggtcctcagctcaacgatggtcctcagctcaacgatggtcctcagctggatgcccctatctctcaattttacgcagatagagctcaaaaacatggcatggatgaatttatctcttccaacccctgtaactttgaccacgcttccctctttgagatggtacaacgccttactttggatcacagacttaatgattcctattcttgcctgggctggttcagtcctggccaggtgtttgtactagacgagtattgcgcccgaaatggagtccgggggtgtcaccgacatctctgctacctcagagacttgcttgaacgggcagaaaatggcgccatgatcgaccccacccttcttcactacagctttgccttctgtgcatcccatgtccatgggaacaggcctgatggaattggaactgtgactgttgaagaaaaggaacgttttgaagaaatcaaagagaggctccgagttctgctagaaaatcagattacacattttaggtattgctttccatttggtcgacctgaaggtgctntgaaagctactctctcactcntggaaagggttttgatgaaagatattgttaccccagtgccacaagaggaggtaaaaacagttatccgtaaatgtctggaacaggctgcgttagtcaactattctcggctctcagagtatgccaaaatcgaagagaatcaaaaggatgcagaaaatgtaggccggttaatcactcctgccaaaaagcttgaagatacaatacgtcttgctgaactagtcattgaagttcttcagcaaaatgaggagcaccacgcagaggcctttgcgtggtggtcagatttaatggtggagcatgcggagacgttcctgtcactctttgcagtagacatggatgcagccttagaggtgcaacctccagacacatgggacagttttccactatttcagctgctgaatgattttctccgtactgactataatttgtgcaatggaaaatttcacaaacacctgcaagacctgtttgccccacttgttgttagatatgtggatctgatggagtcctcaattgcacaatccattcacaggggctttgagcgggagtcatgggaaccagtcaagagtttaaccagtaacctacccaatgtgaacctacccaatgtgaaccttcccaaagtaccaaatctaccagttaacatccctctaggcatcccacaaatgcctactttttcggcaccgtcatggatggctgctatatatgatgcggataatgggtcaggcacctcagaagatctgttttggaaacttgacgcccttcagaccttcattcgggacctgcactggcctgaagaagagtttggaaagcacctggaacaacggctgaagttgatggcaagtgacatgatcgaatcttgtgtcaaaagaaccaggattgcatttgaagttaagctgcaaaaaaccagtcgatcaacagattttcgagtcccacagtcaatatgcaccatgtttaatgttatggttgatgccaaagctcaatcaacaaaactttgcagcatggaaatgggccaagagcatcaataccattcaaaaatagacgaactaattgaagaaactgttaaagaaatgataacactcttggttgcaaagttcgttactatcttggaaggagtgctggcaaaattatccagatatgacgaagggactttgttttcttcttttctgtcatttaccgtgaaggcagcttccaaatatgtggatgtacctaaacccgggatggacgtggccgacgcctacgtgactttcgtccgccattctcaggatgtcctgcgtgataaggtcaatgaggagatgtacatagaaaggttatttgatcaatggtacaacagctccatgaacgtgatctgcacctggttgacggaccggatggacttacagcttcatatttatcagttgaaaacactaattaggatggtaaagaaaacctacagagatttccgattgcaaggggtcctggactccaccttaaacagcaagacctatgaaacgatccggaaccgtctcactgtggaggaagccacagcatcagtgagtgaaggtgggggactgcagggcatcagcatgaaggacagcgatgaggaagacgaagaagacgattagaccatttggtcctagagtctgctgggacagagtcctgtaatcagtgcatgtccttagtctgttagttaaacccattaggaattttctgtcaactaccatgcccatgagatgtttatcaatacaactgccattttagctatgtggtaccaagattagcaaatgaccttcatatccactgatttcctgatgtccatgtctatatgtttacaagcaatatggagcaccattctttaaatactgttcatggagaatacatagtctaaccactaggcgtgtccctgttatcagcaaagatcaatgatgcttcattcatgtactatgtatgcattggtggtaaatggatgtgagggcaagtacatcaagtacattcactctgtttcacgtatgtggatgccagttaattaaatgagtacgtaaataaattaattaaaacacatagatctgctttgtgtttttatttttattttttgaaaaacaaaaggcaagtctccaacaattaacttttgatgctttctgttcccctaaaaccaaaaaatgaaccccttgtgtcgttgttaacccatcctttcatttactcatataattagccaaaaaaaaaaggatggctacataccaatggattgattctcttaattgccacggcaagggggcgatcctatcatgacttaacatcaagcgcgcagttcaaaactactgtcttctgtcaaagttttctcctcttaaatgttattttgcttttacgtctcaactgtgtatgtaaaaaaaacgaatatttaaattacaaccctagactaaaaatgtgtttataataagatgtggatatttccttcagtagattgtaaccataatttaaattattttgttccacactgttttttatatctgtcatgtacattgcattttgatctgtaactgcacaaccctggggtttgctgcagagctatttctttccatgtaaagtagtggatccatcttgcttttgccttatataaagcctacagttatggaagtgtggaaaactgtggcttctcaataaatattcagatgtcctaagaataaacgatt

SEQ ID NO: 27920 - DNA, 3643 bp, Homo sapiens
  misc_feature (233)..(233): n is a, c, g, or t
  misc_feature (874)..(874): n is a, c, g, or t
tactaaatgatgtttatttcactatatcccatgtgctctgactctgagacttcaaggtttgaagggggctaaacatgaaatacaagttcccctggaattcagactggttgaatccaagcagtttcactggccaagaaaacctttatgttttggccgggcacagtggttcacgcctgtaatgccagcactttggaaggctgaggcgggcggatctcctgaggtaaggagtttgngaccatcctggccagcaaggtgaaactctgtctctactaaaaatacaaaaatcagcccggcgtggtggcgggtgcctgtaatcccagctactcaggaggctgaggcaggaggatcacttgaacccaggaggcagaggttgcagtgagctgagatcgcaccactgccctccagcctgggcaacagaataaatgagactccgtctccaaaaaaaacaagaaaaagaaaagaaagaaagaaaacctcctttatgttttaaatattactgttttcccaaaggaaaaaagtttgtaatttttggaacataatgacattgtcaaactcatgaactcagctctaaaaagaaggcaacataagccagggttcagattcttcttgagctgggtaaaaatacaacactttcagtttaagagaaactaaaaacaaagaaaacaattaagtacattgtttcagtttaactgataaaatttcaattgtaacaaccagtagcacaaactatcacaacccattcaataatctactcctaacacccttttaagaattattattcctgactaatggcccaggcatatccaatttttcttttctatctcctccctggacaacttgaagcagacatttgaatctgcattttcaaaatgancgttccaacatacgcgagcctgcaatgaaaaattacgctgtagcatttaataactaatctaaaaaacaaatgtaacagcaatcaatattaaacttctgttaatcttcccacttcaggtagcataattacaatctagagagtggtatagtacatttatgctgtctttaaagaacatgtgtacaaaatgtcactaaatttgatatgggctgtcatagacttaatatagcttcatatgcaaatttgaagctggagcactgcttttttctaatatatattataataatggtgataataataaaatggctttatggtttgctcactactaattacatggcacttaacatttgcatgaattttttttaaaaaactgataactattctcaatttcttatccactagttctaatggccataaaagtagcctgccactttcgctgaattttaacagaatcaaaaggatgcagaaaatgtaggccggttaatcactcctgccaaaaagcttgaagatacaatacgtcttgctgaactagtcattgaagttcttcagcaaaatgaggagcaccacgcagaggcctttgcgtggtggtcagatttaatggtggagcatgcggagacgttcctgtcactctttgcagtagacatggatgcagccttagaggtgcaacctccagacacatgggacagttttccactatttcagctgctgaatgattttctccgtactgactataatttgtgcaatggaaaatttcacaaacacctgcaagacctgtttgccccacttgttgttagatatgtggatctgatggagtcctcaattgcacaatccattcacaggggctttgagcgggagtcatgggaaccagtcaataatgggtcaggcacctcagaagatctgttttggaaacttgacgcccttcagaccttcattcgggacctgcactggcctgaagaagagtttggaaagcacctggaacaacggctgaagttgatggcaagtgacatgatcgaatcttgtgtcaaaagaaccaggattgcatttgaagttaagctgcaaaaaaccagtcgatcaacagattttcgagtcccacagtcaatatgcaccatgtttaatgttatggttgatgccaaagctcaatcaacaaaactttgcagcatggaaatgggccaagagcatcaataccattcaaaaatagacgaactaattgaagaaactgttaaagaaatgataacactcttggttgcaaagttcgttactatcttggaaggagtgctggcaaaattatccagatatgacgaagggactttgttttcttcttttctgtcatttaccgtgaaggcagcttccaaatatgtggatgtacctaaacccgggatggacgtggccgacgcctacgtgactttcgtccgccattctcaggatgtcctgcgtgataaggtcaatgaggagatgtacatagaaaggttatttgatcaatggtacaacagctccatgaacgtgatctgcacctggttgacggaccggatggacttacagcttcatatttatcagttgaaaacactaattaggatggtaaagaaaacctacagagatttccgattgcaaggggtcctggactccaccttaaacagcaagacctatgaaacgatccggaaccgtctcactgtggaggaagccacagcatcagtgagtgaaggtgggggactgcagggcatcagcatgaaggacagcgatgaggaagacgaagaagacgattagaccatttggtcctagagtctgctgggacagagtcctgtaatcagtgcatgtccttagtctgttagttaaacccattaggaattttctgtcaactaccatgcccatgagatgtttatcaatacaactgccattttagctatgtggtaccaagattagcaaatgaccttcatatccactgatttcctgatgtccatgtctatatgtttacaagcaatatggagcaccattctttaaatactgttcatggagaatacatagtctaaccactaggcgtgtccctgttatcagcaaagatcaatgatgcttcattcatgtactatgtatgcattggtggtaaatggatgtgagggcaagtacatcaagtacattcactctgtttcacgtatgtggatgccagttaattaaatgagtacgtaaataaattaattaaaacacatagatctgctttgtgtttttatttttattttttgaaaaacaaaaggcaagtctccaacaattaacttttgatgctttctgttcccctaaaaccaaaaaatgaaccccttgtgtcgttgttaacccatcctttcatttactcatataattagccaaaaaaaaaaggatggctacataccaatggattgattctcttaattgccacggcaagggggcgatcttttctcctcttaaatgttattttgcttttacgtctcaactgtgtatgtaaaaaaaacgaatatttaaattacaaccctagactaaaaatgtgtttataataagatgtggatatttccttcagtagattgtaaccataatttaaattattttgttccacactgttttttatatctgtcatgtacattgcattttgatctgtaactgcacaaccctggggtttgctgcagagctatttctttccatgtaaagtagtggatccatcttgcttttgccttatataaagcctacagttatggaagtgtggaaaactgtggcttctcaataaatattcagatgtcctaagaataaacgatt

SEQ ID NO: 27921 - DNA, 1756 bp, Homo sapiens
taaagatttatccattagataaatttgccaggaaaaaatttatcatagaaaaactatttataaaatcctacaatctcaatgcccttcttagccaggcttgatttctggaaagaggaagcagttctaatatcaattcctaccagcccaggctgtggacagcaatcccatgcctacaaagctgatccagcagaagcatctcagggtgtgtgagggcaagtagagggtacaagtgaatggtaaacaaggaagagtggctgtctgaaaattcgttttcatgttttcctgtttctttacagaaaaacccgggatggacgtggccgacgcctacgtgactttcgtccgccattctcaggatgtcctgcgtgataaggtcaatgaggagatgtacatagaaaggttatttgatcaatggtacaacagctccatgaacgtgatctgcacctggttgacggaccggatggacttacagcttcatatttatcagttgaaaacactaattaggatggtaaagaaaacctacagagatttccgattgcaaggggtcctggactccaccttaaacagcaagacctatgaaacgatccggaaccgtctcactgtggaggaagccacagcatcagtgagtgaaggtgggggactgcagggcatcagcatgaaggacagcgatgaggaagacgaagaagacgattagaccatttggtcctagagtctgctgggacagagtcctgtaatcagtgcatgtccttagtctgttagttaaacccattaggaattttctgtcaactaccatgcccatgagatgtttatcaatacaactgccattttagctatgtggtaccaagattagcaaatgaccttcatatccactgatttcctgatgtccatgtctatatgtttacaagcaatatggagcaccattctttaaatactgttcatggagaatacatagtctaaccactaggcgtgtccctgttatcagcaaagatcaatgatgcttcattcatgtactatgtatgcattggtggtaaatggatgtgagggcaagtacatcaagtacattcactctgtttcacgtatgtggatgccagttaattaaatgagtacgtaaataaattaattaaaacacatagatctgctttgtgtttttatttttattttttgaaaaacaaaaggcaagtctccaacaattaacttttgatgctttctgttcccctaaaaccaaaaaatgaaccccttgtgtcgttgttaacccatcctttcatttactcatataattagccaaaaaaaaaaggatggctacataccaatggattgattctcttaattgccacggcaagggggcgatcctatcatgacttaacatcaagcgcgcagttcaaaactactgtcttctgtcaaagttttctcctcttaaatgttattttgcttttacgtctcaactgtgtatgtaaaaaaaacgaatatttaaattacaaccctagactaaaaatgtgtttataataagatgtggatatttccttcagtagattgtaaccataatttaaattattttgttccacactgttttttatatctgtcatgtacattgcattttgatctgtaactgcacaaccctggggtttgctgcagagctatttctttccatgtaaagtagtggatccatcttgcttttgccttatataaagcctacagttatggaagtgtggaaaactgtggcttctcaataaatattcagatgtcctaagaataaacgatt

SEQ ID NO: 27922 - DNA, 2518 bp, Homo sapiens
  misc_feature (233)..(233): n is a, c, g, or t
  misc_feature (874)..(874): n is a, c, g, or t
tactaaatgatgtttatttcactatatcccatgtgctctgactctgagacttcaaggtttgaagggggctaaacatgaaatacaagttcccctggaattcagactggttgaatccaagcagtttcactggccaagaaaacctttatgttttggccgggcacagtggttcacgcctgtaatgccagcactttggaaggctgaggcgggcggatctcctgaggtaaggagtttgngaccatcctggccagcaaggtgaaactctgtctctactaaaaatacaaaaatcagcccggcgtggtggcgggtgcctgtaatcccagctactcaggaggctgaggcaggaggatcacttgaacccaggaggcagaggttgcagtgagctgagatcgcaccactgccctccagcctgggcaacagaataaatgagactccgtctccaaaaaaaacaagaaaaagaaaagaaagaaagaaaacctcctttatgttttaaatattactgttttcccaaaggaaaaaagtttgtaatttttggaacataatgacattgtcaaactcatgaactcagctctaaaaagaaggcaacataagccagggttcagattcttcttgagctgggtaaaaatacaacactttcagtttaagagaaactaaaaacaaagaaaacaattaagtacattgtttcagtttaactgataaaatttcaattgtaacaaccagtagcacaaactatcacaacccattcaataatctactcctaacacccttttaagaattattattcctgactaatggcccaggcatatccaatttttcttttctatctcctccctggacaacttgaagcagacatttgaatctgcattttcaaaatgancgttccaacatacgcgagcctgcaatgaaaaattacgctgtagcatttaataactaatctaaaaaacaaatgtaacagcaatcaatattaaacttctgttaatcttcccacttcaggtagcataattacaatctagagagtggtatagtacatttatgctgtctttaaagaacatgtgtacaaaatgtcactaaatttgatatgggctgtcatagacttaatatagcttcatatgcaaatttgaagctggagcactgcttttttctaatatatattataataatggtgataataataaaatggctttatggtttgctcactactaattacatggcacttaacatttgcatgaattttttttaaaaaactgataactattctcaatttcttatccactagttctaatggccataaaagtagcctgccactttcgctgaattttaacagaatcaaaaggatgcagaaaatgtaggccggttaatcactcctgccaaaaagcttgaagatacaatacgtcttgctgaactagtcattgaagttcttcagcaaaatgaggagcaccacgcagaggcctttgcgtggtggtcagatttaatggtggagcatgcggagacgttcctgtcactctttgcagtagacatggatgcagccttagaggtgcaacctccagacacatgggacagttttccactatttcagctgctgaatgattttctccgtactgactataatttgtgcaatggaaaatttcacaaacacctgcaagacctgtttgccccacttgttgttagatatgtggatctgatggagtcctcaattgcacaatccattcacaggggctttgagcgggagtcatgggaaccagtcaataatgggtcaggcacctcagaagatctgttttggaaacttgacgcccttcagaccttcattcgggacctgcactggcctgaagaagagtttggaaagcacctggaacaacggctgaagttgatggcaagtgacatgatcgaatcttgtgtcaaaagaaccaggattgcatttgaagttaagctgcaaaaaaccagtcgatcaacagattttcgagtcccacagtcaatatgcaccatgtttaatgttatggttgatgccaaagctcaatcaacaaaactttgcagcatggaaatgggccaagaggtaaaaaaaaaaaaaaaaaatacagatttttttttccctcttcattgatcatgtagaagaaaacttcacaaattccttccatctaccctagtctgctagtttcagaaatacactctaacatttgtggattaagccatggatgagtgttcagtatctgtttgtcaagtagatttctaaggcatgtgctgatgagaatgtcagtcacttggaagtgattcttggctggagttggggtggccatatagttctctaagctaaatgaagtttgacgaccttatttattaggctggtgtctcgaacagatctgtgtttgccagaatgaaagtcattttcacatttgaagtgcattttatcactttgaacatctggacagcaagagaggcctttcttgcatcaaacaacttccaggatgtataatgttagatcaccctgctacccaatccccagccagcaggttctgaatttccaaaa

SEQ ID NO: 27923 - DNA, 3770 bp, Homo sapiens
  misc_feature (1)..(1): n is a, c, g, or t
  misc_feature (629)..(629): n is a, c, g, or t
  misc_feature (1050)..(1050): n is a, c, g, or t
  misc_feature (1253)..(1253): n is a, c, g, or t
  misc_feature (2782)..(2782): n is a, c, g, or t
  misc_feature (2803)..(2803): n is a, c, g, or t
ntttggccacacagaattggcataccaattcatgttccatgggatctaggtggggttctactcccagccacaaggacagaggacataagctatgcctatgcacatcagcacagcatattactggccatagaaattggccagtaatatggccaattggacatgtacttaagttagactttgggtgagaatttggggatgaaagactgtctccatcttccttgcatattacaagaggaaatattcacttttccgttagatagcatgatgtgatgttgtgcagtccacatctttagcaacatttctgtgaagataggggagccaaactgagcatgaagccaccccagaggaaccaaagccaagattttaacaaaaatctcagttgtggtgatatcacctgagccctgattccagcctttcctgaagctgggtctaccccaggatattttcttttgttgttttaagccagtttgaggtggatttttctgtcacttgcaaaaaaaaataaaaatgtcaaactgacttggcttgcttctcactccatcagttatggaatagggcttggggagggcaagtttatgtttcaagtggtaaatgactgtttgggaaggtgattgatccaaagcacattncaggtgacttagaagtatgaagaaacaaatagcatggttagcacgtgttgcaattacaactaaatgtataagcaagaaaggaaaaaatagaggtcagttatgataccaaattgctctatcttctaaagaattttaatcacatttttcatcacttcattaatttggttcaatttttcttgaaaacagtaactattattcttagaaatagacacagactatgtttgaaacctctcaaatgagctccttttgaattattcatgtgagaaaatctctgtagatatccagaaatagggtctctttctgtttccctcacttaaaaacaaatgactgcattttactaaaaagaaaaactaaactgaaaccatatttgaaaaataacaccccatttttcttcctacaaatcaaatttgctgaaggaaantggggaaaaatagaactgtaataaagcatttcaatgtttcttactatatgtttatgtacgtgtttcttacctgttacaatgtataaataactagcaggcaggcagctgtctactcaaataggctgaacatttttctagcacaaggccatgagatctgggtgaatttcactagtagtagatgtgattctaactctgggccatgngacaaagaccttctttataaatcagctttctattttctcctctgctcatacttttctttttcttcccaaggaacgcaaatttcccaagtttgtatccaaagaaatggaaaacatgtacattgaggagctgaagtcatctgtcaacctgctcatggccaacttggagagcatgccggtatccaaaggcggggagttcaagctccagaaactcaaacgcagccacaatgcttccatcatcgacatgggcgaggagagtgagaaccagctctccaagtcagatgtcgtgctgtctttctcattggaggtggtaattatggaagtccaaggcctcaaatctttggctccaaatcgcatcgtatattgcacaatggaggtggaaggaggagagaaactacagactgatcaggccgaggcttctaaaccaacctggggcacccagggtgacttctccacaacccatgcactgccagctgtgaaggtgaagctgttcacagagagcacaggcgtcctggcgttggaggacaaggagcttgggcgggttattctccatcccaccccgaacagccccaaacagtcagagtggcacaaaatgacagtctccaaaaactgccccgaccaagatctcaaaatcaaacttgctgtccgaatggataagcctcaaaacatgaagcattctgggtatttatgggccatcggtaagaatgtctggaagagatggaagaaaaggttttttgtattggtgcaggtcagtcagtacacgtttgccatgtgcagttatcgggagaagaaagcggagcctcaggaacttctacaattggatggctacactgtggattacaccgacccccagccaggtttggagggtggccgagccttcttcaatgctgtcaaggagggagacaccgtgatatttgccagtgacgatgaacaagaccgcatcctgtgggtccaggccatgtatcgggccacggggcagtcacacaagcctgtgcccccgacccaagtccagaaactcaacgccaagggaggaaatgtacctcagctggatgcccctatctctcaattttacgcagatagagctcaaaaacatggcatggatgaatttatctcttccaacccctgtaactttgaccacgcttccctctttgagatggtacaacgccttactttggatcacagacttaatgattcctattcttgcctgggctggttcagtcctggccaggtgtttgtactagacgagtattgcgcccgaaatggagtccgggggtgtcaccgacatctctgctacctcagagacttgcttgaacgggcagaaaatggcgccatgatcgaccccacccttcttcactacagctttgccttctgtgcatcccatgtccatgggaacaggcctgatggaattggaactgtgactgttgaagaaaaggaacgttttgaagaaatcaaagagaggctccgagttctgctagaaaatcagattacacattttaggtattgctttccatttggtcgacctgaaggtgctntgaaagctactctctcactcntggaaagggttttgatgaaagatattgttaccccagtgccacaagaggaggtaaaaacagttatccgtaaatgtctggaacaggctgcgttagtcaactattctcggctctcagagtatgccaaaatcgaagagaatcaaaaggatgcagaaaatgtaggccggttaatcactcctgccaaaaagcttgaagatacaatacgtcttgctgaactagtcattgaagttcttcagcaaaatgaggagcaccacgcagaggcctttgcgtggtggtcagatttaatggtggagcatgcggagacgttcctgtcactctttgcagtagacatggatgcagccttagaggtgcaacctccagacacatgggacagttttccactatttcagctgctgaatgattttctccgtactgactataatttgtgcaatggaaaatttcacaaacacctgcaagacctgtttgccccacttgttgttagatatgtggatctgatggagtcctcaattgcacaatccattcacaggggctttgagcgggagtcatgggaaccagtcaataatgggtcaggcacctcagaagatctgttttggaaacttgacgcccttcagaccttcattcgggacctgcactggcctgaagaagagtttggaaagcacctggaacaacggctgaagttgatggcaagtgacatgatcgaatcttgtgtcaaaaggtaagtataggtggctggacaggttctgcacaccctccccaccatacacagactcagggaagggtagatggctgctctttcaattggctgtagtttgaaactaattggagaaggggattgcttgtcaaagtcagctggagtagtggctgtcaacgtctaacttccattcacctgccctccatctgtcccaaacccaaaataatctggctgccaattttttcatggttgttggctttaagaggaaaagatccctgt

SEQ ID NO: 27924 - DNA, 2947 bp, Homo sapiens
  misc_feature (1)..(1): n is a, c, g, or t
  misc_feature (629)..(629): n is a, c, g, or t
  misc_feature (1050)..(1050): n is a, c, g, or t
  misc_feature (1253)..(1253): n is a, c, g, or t
ntttggccacacagaattggcataccaattcatgttccatgggatctaggtggggttctactcccagccacaaggacagaggacataagctatgcctatgcacatcagcacagcatattactggccatagaaattggccagtaatatggccaattggacatgtacttaagttagactttgggtgagaatttggggatgaaagactgtctccatcttccttgcatattacaagaggaaatattcacttttccgttagatagcatgatgtgatgttgtgcagtccacatctttagcaacatttctgtgaagataggggagccaaactgagcatgaagccaccccagaggaaccaaagccaagattttaacaaaaatctcagttgtggtgatatcacctgagccctgattccagcctttcctgaagctgggtctaccccaggatattttcttttgttgttttaagccagtttgaggtggatttttctgtcacttgcaaaaaaaaataaaaatgtcaaactgacttggcttgcttctcactccatcagttatggaatagggcttggggagggcaagtttatgtttcaagtggtaaatgactgtttgggaaggtgattgatccaaagcacattncaggtgacttagaagtatgaagaaacaaatagcatggttagcacgtgttgcaattacaactaaatgtataagcaagaaaggaaaaaatagaggtcagttatgataccaaattgctctatcttctaaagaattttaatcacatttttcatcacttcattaatttggttcaatttttcttgaaaacagtaactattattcttagaaatagacacagactatgtttgaaacctctcaaatgagctccttttgaattattcatgtgagaaaatctctgtagatatccagaaatagggtctctttctgtttccctcacttaaaaacaaatgactgcattttactaaaaagaaaaactaaactgaaaccatatttgaaaaataacaccccatttttcttcctacaaatcaaatttgctgaaggaaantggggaaaaatagaactgtaataaagcatttcaatgtttcttactatatgtttatgtacgtgtttcttacctgttacaatgtataaataactagcaggcaggcagctgtctactcaaataggctgaacatttttctagcacaaggccatgagatctgggtgaatttcactagtagtagatgtgattctaactctgggccatgngacaaagaccttctttataaatcagctttctattttctcctctgctcatacttttctttttcttcccaaggaacgcaaatttcccaagtttgtatccaaagaaatggaaaacatgtacattgaggagctgaagtcatctgtcaacctgctcatggccaacttggagagcatgccggtatccaaaggcggggagttcaagctccagaaactcaaacgcagccacaatgcttccatcatcgacatgggcgaggagagtgagaaccagctctccaagtcagatgtcgtgctgtctttctcattggaggtggtaattatggaagtccaaggcctcaaatctttggctccaaatcgcatcgtatattgcacaatggaggtggaaggaggagagaaactacagactgatcaggccgaggcttctaaaccaacctggggcacccagggtgacttctccacaacccatgcactgccagctgtgaaggtgaagctgttcacagagagcacaggcgtcctggcgttggaggacaaggagcttgggcgggttattctccatcccaccccgaacagccccaaacagtcagagtggcacaaaatgacagtctccaaaaactgccccgaccaagatctcaaaatcaaacttgctgtccgaatggataagcctcaaaacatgaagcattctgggtatttatgggccatcggtaagaatgtctggaagagatggaagaaaaggttttttgtattggtgcaggtcagtcagtacacgtttgccatgtgcagttatcgggagaagaaagcggagcctcaggaacttctacaattggatggctacactgtggattacaccgacccccagccaggtttggagggtggccgagccttcttcaatgctgtcaaggagggagacaccgtgatatttgccagtgacgatgaacaagaccgcatcctgtgggtccaggccatgtatcgggccacggggcagtcacacaagcctgtgcccccgacccaagtccagaaactcaacgccaagggaggaaatgtacctcagctggatgcccctatctctcaattttacgcagatagagctcaaaaacatggcatggatgaatttatctcttccaacccctgtaactttgaccacgcttccctctttgagatggtacaacgccttactttggatcacagacttaatgattcctattcttgcctgggctggttcagtcctggccaggtgtttgtactagacgagtattgcgcccgaaatggagtccgggggtgtcaccgacatctctgctacctcagagacttgcttgaacgggcagaaaatggcgccatgatcgaccccacccttcttcactacagctttgccttctgtgcatcccatgtccatgggaacagtcaacaaatgcatgtgtaccttagtgggctgccaccaaatacagaccctgaagggagcaaaactccctccccacctgaaccagaagctaaaaaagataccaaaaaggaatccaaaaaaagaaaagattccaaaacccaggcaaatcaagagctgaaaaggtaagaagttatgtgtgtattggcttgtgtttgtaatatctttaccctttccccaagcctccatccatgccatcacttccacttttgcaagctttgagtattcctaaagtctctctttaagcattttcaaaggtgcaatttta

SEQ ID NO: 27925 - DNA, 1915 bp, Homo sapiens
acagcttgcaacactcggcatcttttctggaggcgcctccttcagcagccgcagatggcatccggctgcgggctcggggctcgcaattgattctcccccttgcccacctcgagtccacggacgcacctctcccttcccctcctcccttcgcgcttctgggtctgagcccagctcgcgaccgccgggcagaggatcagtcgcggcggccgaggctgagcagcagcgctctcgctccctgacctggggagaagcgcccacccgggagagctgatccccggctgcctccagcgccccccaccttttgcactccaagccgggggctccagagaccccgctccccaggcgccactatgctggacccttcgtccagcgaagaagaatcggatgagatcgtggaggaggagagcggcaaggaggtgctcggctcggccccgtccggcgcgcgcctgtctcccagccgtaccagcgagggctcggccggcagcgccgggctggggggcggcggcgccggcgccggagccggggtgggtgcaggcggcggcgggggcagcggcgcgagcagcggcggcggggccggggggctgcaacccagcagccgcgctggcggcggccggccctccagccccagcccgtcggtggtgagcgagaaggagaaggaagagttggagcggctgcagaaagaggaggaggagaggaagaagaggctgcagctgtatgtgttcgtgatgcgctgcatcgcctacccctttaatgccaagcagcccaccgacatggctcgccggcagcagaagatcagcaaacagcagctgcagacagtcaaggaccggtttcaggctttcctcaatggggaaacccagatcatggctgacgaagccttcatgaacgctgtgcagagttactatgaggtgttcctgaagagcgaccgtgtggcccgcatggttcagagtggaggctgttccgccaacgactcccgggaggtcttcaagaagcacattgagaagagagtgcgcagcctgcctgagattgacggcctcagcaaggagactgtgctgagctcctggatggccaaatttgatgccatctaccgtggagaagaggacccgcggaagcagcaggcccggatgacagccagcgcagcctccgagctgattctgagcaaggagcaactctatgagatgttccagaacattcttgggatcaagaagttcgaacatcagctcctttacaatgcctgccagctggacaatccagatgagcaagcagcccagatcagacgagagctggatggacgtctacaaatggcagaccaaatagccagggaacgcaaatttcccaagtttgtatccaaagaaatggaaaacatgtacattgaggagctgaagtcatctgtcaacctgctcatggccaacttggagagcatgccggtatccaaaggcggggagttcaagctccagaaactcaaacgcagccacaatgcttccatcatcgacatgggcgaggagagtgagaaccagctctccaagtcagatgtcgtgctgtctttctcattggaggtggtaattatggaagtccaaggcctcaaatctttggctccaaatcgcatcgtatattgcacaatggaggtggaaggaggagagaaactacagactgatcaggccgaggcttctaaaccaacggtaatcaggagaaacagaagagaacaactgcctcacagtgccatttgatgtcccgtctttgtgccatgtcaaatcatctccaggggtacaagatttgtgcttgaagagtcacagtacccaatctctgtttactgaataatttcactatagtctgtgtatttccctggtttacactcatccttttgggtgtttttcctagagcattccatggtttcttttctgtttagtaaatccgtgcc

SEQ ID NO: 27926 - DNA, 588 bp, Homo sapiens
agagctcaaaaacatggcatggatgaatttatctcttccaacccctgtaactttgaccacgcttccctctttgagatggtacaacgccttactttggatcacagacttaatgattcctattcttgcctggcaagtatattctttggtctacagcaatttaaacataacattttttttcatttaaatatttctctacctttatgtcagaagctcttttctccattacagaatccctttaacaattataaatgtgttcccgatttcctgggttgagatagttttacttaccaaagaaacaagactgagcaggaggaagttatcagtagaaacagatccaattccccagcctccctatcttagcttcccccttttcagctgctacatgagaaatattcccaagagggtaatcgagtttggcacctgcttgtggagaacttgtaaaaattgcctcagtagcttagagtttaagatgcccttccctccccatcccagatctggtaatcctatctcattacatgaatgtattctctttgtgtattttcttaaaggttaaaatgatttgtaaataaactttatttttcataagct

SEQ ID NO: 27927 - DNA, 3697 bp, Homo sapiens
  misc_feature (233)..(233): n is a, c, g, or t
  misc_feature (874)..(874): n is a, c, g, or t
tactaaatgatgtttatttcactatatcccatgtgctctgactctgagacttcaaggtttgaagggggctaaacatgaaatacaagttcccctggaattcagactggttgaatccaagcagtttcactggccaagaaaacctttatgttttggccgggcacagtggttcacgcctgtaatgccagcactttggaaggctgaggcgggcggatctcctgaggtaaggagtttgngaccatcctggccagcaaggtgaaactctgtctctactaaaaatacaaaaatcagcccggcgtggtggcgggtgcctgtaatcccagctactcaggaggctgaggcaggaggatcacttgaacccaggaggcagaggttgcagtgagctgagatcgcaccactgccctccagcctgggcaacagaataaatgagactccgtctccaaaaaaaacaagaaaaagaaaagaaagaaagaaaacctcctttatgttttaaatattactgttttcccaaaggaaaaaagtttgtaatttttggaacataatgacattgtcaaactcatgaactcagctctaaaaagaaggcaacataagccagggttcagattcttcttgagctgggtaaaaatacaacactttcagtttaagagaaactaaaaacaaagaaaacaattaagtacattgtttcagtttaactgataaaatttcaattgtaacaaccagtagcacaaactatcacaacccattcaataatctactcctaacacccttttaagaattattattcctgactaatggcccaggcatatccaatttttcttttctatctcctccctggacaacttgaagcagacatttgaatctgcattttcaaaatgancgttccaacatacgcgagcctgcaatgaaaaattacgctgtagcatttaataactaatctaaaaaacaaatgtaacagcaatcaatattaaacttctgttaatcttcccacttcaggtagcataattacaatctagagagtggtatagtacatttatgctgtctttaaagaacatgtgtacaaaatgtcactaaatttgatatgggctgtcatagacttaatatagcttcatatgcaaatttgaagctggagcactgcttttttctaatatatattataataatggtgataataataaaatggctttatggtttgctcactactaattacatggcacttaacatttgcatgaattttttttaaaaaactgataactattctcaatttcttatccactagttctaatggccataaaagtagcctgccactttcgctgaattttaacagaatcaaaaggatgcagaaaatgtaggccggttaatcactcctgccaaaaagcttgaagatacaatacgtcttgctgaactagtcattgaagttcttcagcaaaatgaggagcaccacgcagaggcctttgcgtggtggtcagatttaatggtggagcatgcggagacgttcctgtcactctttgcagtagacatggatgcagccttagaggtgcaacctccagacacatgggacagttttccactatttcagctgctgaatgattttctccgtactgactataatttgtgcaatggaaaatttcacaaacacctgcaagacctgtttgccccacttgttgttagatatgtggatctgatggagtcctcaattgcacaatccattcacaggggctttgagcgggagtcatgggaaccagtcaataatgggtcaggcacctcagaagatctgttttggaaacttgacgcccttcagaccttcattcgggacctgcactggcctgaagaagagtttggaaagcacctggaacaacggctgaagttgatggcaagtgacatgatcgaatcttgtgtcaaaagaaccaggattgcatttgaagttaagctgcaaaaaaccagtcgatcaacagattttcgagtcccacagtcaatatgcaccatgtttaatgttatggttgatgccaaagctcaatcaacaaaactttgcagcatggaaatgggccaagagcatcaataccattcaaaaatagacgaactaattgaagaaactgttaaagaaatgataacactcttggttgcaaagttcgttactatcttggaaggagtgctggcaaaattatccagatatgacgaagggactttgttttcttcttttctgtcatttaccgtgaaggcagcttccaaatatgtggatgtacctaaacccgggatggacgtggccgacgcctacgtgactttcgtccgccattctcaggatgtcctgcgtgataaggtcaatgaggagatgtacatagaaaggttatttgatcaatggtacaacagctccatgaacgtgatctgcacctggttgacggaccggatggacttacagcttcatatttatcagttgaaaacactaattaggatggtaaagaaaacctacagagatttccgattgcaaggggtcctggactccaccttaaacagcaagacctatgaaacgatccggaaccgtctcactgtggaggaagccacagcatcagtgagtgaaggtgggggactgcagggcatcagcatgaaggacagcgatgaggaagacgaagaagacgattagaccatttggtcctagagtctgctgggacagagtcctgtaatcagtgcatgtccttagtctgttagttaaacccattaggaattttctgtcaactaccatgcccatgagatgtttatcaatacaactgccattttagctatgtggtaccaagattagcaaatgaccttcatatccactgatttcctgatgtccatgtctatatgtttacaagcaatatggagcaccattctttaaatactgttcatggagaatacatagtctaaccactaggcgtgtccctgttatcagcaaagatcaatgatgcttcattcatgtactatgtatgcattggtggtaaatggatgtgagggcaagtacatcaagtacattcactctgtttcacgtatgtggatgccagttaattaaatgagtacgtaaataaattaattaaaacacatagatctgctttgtgtttttatttttattttttgaaaaacaaaaggcaagtctccaacaattaacttttgatgctttctgttcccctaaaaccaaaaaatgaaccccttgtgtcgttgttaacccatcctttcatttactcatataattagccaaaaaaaaaaggatggctacataccaatggattgattctcttaattgccacggcaagggggcgatcctatcatgacttaacatcaagcgcgcagttcaaaactactgtcttctgtcaaagttttctcctcttaaatgttattttgcttttacgtctcaactgtgtatgtaaaaaaaacgaatatttaaattacaaccctagactaaaaatgtgtttataataagatgtggatatttccttcagtagattgtaaccataatttaaattattttgttccacactgttttttatatctgtcatgtacattgcattttgatctgtaactgcacaaccctggggtttgctgcagagctatttctttccatgtaaagtagtggatccatcttgcttttgccttatataaagcctacagttatggaagtgtggaaaactgtggcttctcaataaatattcagatgtcctaagaataaacgatt

SEQ ID NO: 27928 - DNA, 5460 bp, Homo sapiens
  misc_feature (1)..(1): n is a, c, g, or t
  misc_feature (629)..(629): n is a, c, g, or t
  misc_feature (1050)..(1050): n is a, c, g, or t
  misc_feature (1253)..(1253): n is a, c, g, or t
  misc_feature (2782)..(2782): n is a, c, g, or t
  misc_feature (2803)..(2803): n is a, c, g, or t
ntttggccacacagaattggcataccaattcatgttccatgggatctaggtggggttctactcccagccacaaggacagaggacataagctatgcctatgcacatcagcacagcatattactggccatagaaattggccagtaatatggccaattggacatgtacttaagttagactttgggtgagaatttggggatgaaagactgtctccatcttccttgcatattacaagaggaaatattcacttttccgttagatagcatgatgtgatgttgtgcagtccacatctttagcaacatttctgtgaagataggggagccaaactgagcatgaagccaccccagaggaaccaaagccaagattttaacaaaaatctcagttgtggtgatatcacctgagccctgattccagcctttcctgaagctgggtctaccccaggatattttcttttgttgttttaagccagtttgaggtggatttttctgtcacttgcaaaaaaaaataaaaatgtcaaactgacttggcttgcttctcactccatcagttatggaatagggcttggggagggcaagtttatgtttcaagtggtaaatgactgtttgggaaggtgattgatccaaagcacattncaggtgacttagaagtatgaagaaacaaatagcatggttagcacgtgttgcaattacaactaaatgtataagcaagaaaggaaaaaatagaggtcagttatgataccaaattgctctatcttctaaagaattttaatcacatttttcatcacttcattaatttggttcaatttttcttgaaaacagtaactattattcttagaaatagacacagactatgtttgaaacctctcaaatgagctccttttgaattattcatgtgagaaaatctctgtagatatccagaaatagggtctctttctgtttccctcacttaaaaacaaatgactgcattttactaaaaagaaaaactaaactgaaaccatatttgaaaaataacaccccatttttcttcctacaaatcaaatttgctgaaggaaantggggaaaaatagaactgtaataaagcatttcaatgtttcttactatatgtttatgtacgtgtttcttacctgttacaatgtataaataactagcaggcaggcagctgtctactcaaataggctgaacatttttctagcacaaggccatgagatctgggtgaatttcactagtagtagatgtgattctaactctgggccatgngacaaagaccttctttataaatcagctttctattttctcctctgctcatacttttctttttcttcccaaggaacgcaaatttcccaagtttgtatccaaagaaatggaaaacatgtacattgaggagctgaagtcatctgtcaacctgctcatggccaacttggagagcatgccggtatccaaaggcggggagttcaagctccagaaactcaaacgcagccacaatgcttccatcatcgacatgggcgaggagagtgagaaccagctctccaagtcagatgtcgtgctgtctttctcattggaggtggtaattatggaagtccaaggcctcaaatctttggctccaaatcgcatcgtatattgcacaatggaggtggaaggaggagagaaactacagactgatcaggccgaggcttctaaaccaacctggggcacccagggtgacttctccacaacccatgcactgccagctgtgaaggtgaagctgttcacagagagcacaggcgtcctggcgttggaggacaaggagcttgggcgggttattctccatcccaccccgaacagccccaaacagtcagagtggcacaaaatgacagtctccaaaaactgccccgaccaagatctcaaaatcaaacttgctgtccgaatggataagcctcaaaacatgaagcattctgggtatttatgggccatcggtaagaatgtctggaagagatggaagaaaaggttttttgtattggtgcaggtcagtcagtacacgtttgccatgtgcagttatcgggagaagaaagcggagcctcaggaacttctacaattggatggctacactgtggattacaccgacccccagccaggtttggagggtggccgagccttcttcaatgctgtcaaggagggagacaccgtgatatttgccagtgacgatgaacaagaccgcatcctgtgggtccaggccatgtatcgggccacggggcagtcacacaagcctgtgcccccgacccaagtccagaaactcaacgccaagggaggaaatgtacctcagctggatgcccctatctctcaattttacgcagatagagctcaaaaacatggcatggatgaatttatctcttccaacccctgtaactttgaccacgcttccctctttgagatggtacaacgccttactttggatcacagacttaatgattcctattcttgcctgggctggttcagtcctggccaggtgtttgtactagacgagtattgcgcccgaaatggagtccgggggtgtcaccgacatctctgctacctcagagacttgcttgaacgggcagaaaatggcgccatgatcgaccccacccttcttcactacagctttgccttctgtgcatcccatgtccatgggaacaggcctgatggaattggaactgtgactgttgaagaaaaggaacgttttgaagaaatcaaagagaggctccgagttctgctagaaaatcagattacacattttaggtattgctttccatttggtcgacctgaaggtgctntgaaagctactctctcactcntggaaagggttttgatgaaagatattgttaccccagtgccacaagaggaggtaaaaacagttatccgtaaatgtctggaacaggctgcgttagtcaactattctcggctctcagagtatgccaaaatcgaagagaatcaaaaggatgcagaaaatgtaggccggttaatcactcctgccaaaaagcttgaagatacaatacgtcttgctgaactagtcattgaagttcttcagcaaaatgaggagcaccacgcagaggcctttgcgtggtggtcagatttaatggtggagcatgcggagacgttcctgtcactctttgcagtagacatggatgcagccttagaggtgcaacctccagacacatgggacagttttccactatttcagctgctgaatgattttctccgtactgactataatttgtgcaatggaaaatttcacaaacacctgcaagacctgtttgccccacttgttgttagatatgtggatctgatggagtcctcaattgcacaatccattcacaggggctttgagcgggagtcatgggaaccagtcaagagtttaaccagtaacctacccaatgtgaacctacccaatgtgaaccttcccaaagtaccaaatctaccagttaacatccctctaggcatcccacaaatgcctactttttcggcaccgtcatggatggctgctatatatgatgcggataatgggtcaggcacctcagaagatctgttttggaaacttgacgcccttcagaccttcattcgggacctgcactggcctgaagaagagtttggaaagcacctggaacaacggctgaagttgatggcaagtgacatgatcgaatcttgtgtcaaaagaaccaggattgcatttgaagttaagctgcaaaaaaccagtcgatcaacagattttcgagtcccacagtcaatatgcaccatgtttaatgttatggttgatgccaaagctcaatcaacaaaactttgcagcatggaaatgggccaagagcatcaataccattcaaaaatagacgaactaattgaagaaactgttaaagaaatgataacactcttggttgcaaagttcgttactatcttggaaggagtgctggcaaaattatccagatatgacgaagggactttgttttcttcttttctgtcatttaccgtgaaggcagcttccaaatatgtggatgtacctaaacccgggatggacgtggccgacgcctacgtgactttcgtccgccattctcaggatgtcctgcgtgataaggtcaatgaggagatgtacatagaaaggttatttgatcaatggtacaacagctccatgaacgtgatctgcacctggttgacggaccggatggacttacagcttcatatttatcagttgaaaacactaattaggatggtaaagaaaacctacagagatttccgattgcaaggggtcctggactccaccttaaacagcaagacctatgaaacgatccggaaccgtctcactgtggaggaagccacagcatcagtgagtgaaggtgggggactgcagggcatcagcatgaaggacagcgatgaggaagacgaagaagacgattagaccatttggtcctagagtctgctgggacagagtcctgtaatcagtgcatgtccttagtctgttagttaaacccattaggaattttctgtcaactaccatgcccatgagatgtttatcaatacaactgccattttagctatgtggtaccaagattagcaaatgaccttcatatccactgatttcctgatgtccatgtctatatgtttacaagcaatatggagcaccattctttaaatactgttcatggagaatacatagtctaaccactaggcgtgtccctgttatcagcaaagatcaatgatgcttcattcatgtactatgtatgcattggtggtaaatggatgtgagggcaagtacatcaagtacattcactctgtttcacgtatgtggatgccagttaattaaatgagtacgtaaataaattaattaaaacacatagatctgctttgtgtttttatttttattttttgaaaaacaaaaggcaagtctccaacaattaacttttgatgctttctgttcccctaaaaccaaaaaatgaaccccttgtgtcgttgttaacccatcctttcatttactcatataattagccaaaaaaaaaaggatggctacataccaatggattgattctcttaattgccacggcaagggggcgatcctatcatgacttaacatcaagcgcgcagttcaaaactactgtcttctgtcaaagttttctcctcttaaatgttattttgcttttacgtctcaactgtgtatgtaaaaaaaacgaatatttaaattacaaccctagactaaaaatgtgtttataataagatgtggatatttccttcagtagattgtaaccataatttaaattattttgttccacactgttttttatatctgtcatgtacattgcattttgatctgtaactgcacaaccctggggtttgctgcagagctatttctttccatgtaaagtagtggatccatcttgcttttgccttatataaagcctacagttatggaagtgtggaaaactgtggcttctcaataaatattcagatgtcctaagaataaacgatt

SEQ ID NO: 27929 - DNA, 3643 bp, Homo sapiens
  misc_feature (233)..(233): n is a, c, g, or t
  misc_feature (874)..(874): n is a, c, g, or t
tactaaatgatgtttatttcactatatcccatgtgctctgactctgagacttcaaggtttgaagggggctaaacatgaaatacaagttcccctggaattcagactggttgaatccaagcagtttcactggccaagaaaacctttatgttttggccgggcacagtggttcacgcctgtaatgccagcactttggaaggctgaggcgggcggatctcctgaggtaaggagtttgngaccatcctggccagcaaggtgaaactctgtctctactaaaaatacaaaaatcagcccggcgtggtggcgggtgcctgtaatcccagctactcaggaggctgaggcaggaggatcacttgaacccaggaggcagaggttgcagtgagctgagatcgcaccactgccctccagcctgggcaacagaataaatgagactccgtctccaaaaaaaacaagaaaaagaaaagaaagaaagaaaacctcctttatgttttaaatattactgttttcccaaaggaaaaaagtttgtaatttttggaacataatgacattgtcaaactcatgaactcagctctaaaaagaaggcaacataagccagggttcagattcttcttgagctgggtaaaaatacaacactttcagtttaagagaaactaaaaacaaagaaaacaattaagtacattgtttcagtttaactgataaaatttcaattgtaacaaccagtagcacaaactatcacaacccattcaataatctactcctaacacccttttaagaattattattcctgactaatggcccaggcatatccaatttttcttttctatctcctccctggacaacttgaagcagacatttgaatctgcattttcaaaatgancgttccaacatacgcgagcctgcaatgaaaaattacgctgtagcatttaataactaatctaaaaaacaaatgtaacagcaatcaatattaaacttctgttaatcttcccacttcaggtagcataattacaatctagagagtggtatagtacatttatgctgtctttaaagaacatgtgtacaaaatgtcactaaatttgatatgggctgtcatagacttaatatagcttcatatgcaaatttgaagctggagcactgcttttttctaatatatattataataatggtgataataataaaatggctttatggtttgctcactactaattacatggcacttaacatttgcatgaattttttttaaaaaactgataactattctcaatttcttatccactagttctaatggccataaaagtagcctgccactttcgctgaattttaacagaatcaaaaggatgcagaaaatgtaggccggttaatcactcctgccaaaaagcttgaagatacaatacgtcttgctgaactagtcattgaagttcttcagcaaaatgaggagcaccacgcagaggcctttgcgtggtggtcagatttaatggtggagcatgcggagacgttcctgtcactctttgcagtagacatggatgcagccttagaggtgcaacctccagacacatgggacagttttccactatttcagctgctgaatgattttctccgtactgactataatttgtgcaatggaaaatttcacaaacacctgcaagacctgtttgccccacttgttgttagatatgtggatctgatggagtcctcaattgcacaatccattcacaggggctttgagcgggagtcatgggaaccagtcaataatgggtcaggcacctcagaagatctgttttggaaacttgacgcccttcagaccttcattcgggacctgcactggcctgaagaagagtttggaaagcacctggaacaacggctgaagttgatggcaagtgacatgatcgaatcttgtgtcaaaagaaccaggattgcatttgaagttaagctgcaaaaaaccagtcgatcaacagattttcgagtcccacagtcaatatgcaccatgtttaatgttatggttgatgccaaagctcaatcaacaaaactttgcagcatggaaatgggccaagagcatcaataccattcaaaaatagacgaactaattgaagaaactgttaaagaaatgataacactcttggttgcaaagttcgttactatcttggaaggagtgctggcaaaattatccagatatgacgaagggactttgttttcttcttttctgtcatttaccgtgaaggcagcttccaaatatgtggatgtacctaaacccgggatggacgtggccgacgcctacgtgactttcgtccgccattctcaggatgtcctgcgtgataaggtcaatgaggagatgtacatagaaaggttatttgatcaatggtacaacagctccatgaacgtgatctgcacctggttgacggaccggatggacttacagcttcatatttatcagttgaaaacactaattaggatggtaaagaagacctatgaaacgatccggaaccgtctcactgtggaggaagccacagcatcagtgagtgaaggtgggggactgcagggcatcagcatgaaggacagcgatgaggaagacgaagaagacgattagaccatttggtcctagagtctgctgggacagagtcctgtaatcagtgcatgtccttagtctgttagttaaacccattaggaattttctgtcaactaccatgcccatgagatgtttatcaatacaactgccattttagctatgtggtaccaagattagcaaatgaccttcatatccactgatttcctgatgtccatgtctatatgtttacaagcaatatggagcaccattctttaaatactgttcatggagaatacatagtctaaccactaggcgtgtccctgttatcagcaaagatcaatgatgcttcattcatgtactatgtatgcattggtggtaaatggatgtgagggcaagtacatcaagtacattcactctgtttcacgtatgtggatgccagttaattaaatgagtacgtaaataaattaattaaaacacatagatctgctttgtgtttttatttttattttttgaaaaacaaaaggcaagtctccaacaattaacttttgatgctttctgttcccctaaaaccaaaaaatgaaccccttgtgtcgttgttaacccatcctttcatttactcatataattagccaaaaaaaaaaggatggctacataccaatggattgattctcttaattgccacggcaagggggcgatcctatcatgacttaacatcaagcgcgcagttcaaaactactgtcttctgtcaaagttttctcctcttaaatgttattttgcttttacgtctcaactgtgtatgtaaaaaaaacgaatatttaaattacaaccctagactaaaaatgtgtttataataagatgtggatatttccttcagtagattgtaaccataatttaaattattttgttccacactgttttttatatctgtcatgtacattgcattttgatctgtaactgcacaaccctggggtttgctgcagagctatttctttccatgtaaagtagtggatccatcttgcttttgccttatataaagcctacagttatggaagtgtggaaaactgtggcttctcaataaatattcagatgtcctaagaataaacgatt

SEQ ID NO: 27930 - DNA, 1938 bp, Homo sapiens
ttaagtcattcatgtgtgctatttgtaaaagtgtttaagtgtctacacacattagaagcatcgaaagccttgagtaaggaacaatgaacttggtaatatttttaagagcttcagatctctctctatcaaagaactggagtcaggatcttataaatatttctgggactaaggaaataaacggggtccgcagccaggctttatttataaattaagttgtctaaaaattactgacggatgcagtgccatcacctcccaaacatgctaatatttgtctttctgtgttcttagcatcaataccattcaaaaatagacgaactaattgaagaaactgttaaagaaatgataacactcttggttgcaaagttcgttactatcttggaaggagtgctggcaaaattatccagatatgacgaagggactttgttttcttcttttctgtcatttaccgtgaaggcagcttccaaatatgtggatgtacctaaacccgggatggacgtggccgacgcctacgtgactttcgtccgccattctcaggatgtcctgcgtgataaggtcaatgaggagatgtacatagaaaggttatttgatcaatggtacaacagctccatgaacgtgatctgcacctggttgacggaccggatggacttacagcttcatatttatcagttgaaaacactaattaggatggtaaagaaaacctacagagatttccgattgcaaggggtcctggactccaccttaaacagcaagacctatgaaacgatccggaaccgtctcactgtggaggaagccacagcatcagtgagtgaaggtgggggactgcagggcatcagcatgaaggacagcgatgaggaagacgaagaagacgattagaccatttggtcctagagtctgctgggacagagtcctgtaatcagtgcatgtccttagtctgttagttaaacccattaggaattttctgtcaactaccatgcccatgagatgtttatcaatacaactgccattttagctatgtggtaccaagattagcaaatgaccttcatatccactgatttcctgatgtccatgtctatatgtttacaagcaatatggagcaccattctttaaatactgttcatggagaatacatagtctaaccactaggcgtgtccctgttatcagcaaagatcaatgatgcttcattcatgtactatgtatgcattggtggtaaatggatgtgagggcaagtacatcaagtacattcactctgtttcacgtatgtggatgccagttaattaaatgagtacgtaaataaattaattaaaacacatagatctgctttgtgtttttatttttattttttgaaaaacaaaaggcaagtctccaacaattaacttttgatgctttctgttcccctaaaaccaaaaaatgaaccccttgtgtcgttgttaacccatcctttcatttactcatataattagccaaaaaaaaaaggatggctacataccaatggattgattctcttaattgccacggcaagggggcgatcctatcatgacttaacatcaagcgcgcagttcaaaactactgtcttctgtcaaagttttctcctcttaaatgttattttgcttttacgtctcaactgtgtatgtaaaaaaaacgaatatttaaattacaaccctagactaaaaatgtgtttataataagatgtggatatttccttcagtagattgtaaccataatttaaattattttgttccacactgttttttatatctgtcatgtacattgcattttgatctgtaactgcacaaccctggggtttgctgcagagctatttctttccatgtaaagtagtggatccatcttgcttttgccttatataaagcctacagttatggaagtgtggaaaactgtggcttctcaataaatattcagatgtcctaagaataaacgatt

SEQ ID NO: 27931 - DNA, 3066 bp, Homo sapiens
  misc_feature (1)..(1): n is a, c, g, or t
  misc_feature (629)..(629): n is a, c, g, or t
  misc_feature (1050)..(1050): n is a, c, g, or t
  misc_feature (1253)..(1253): n is a, c, g, or t
ntttggccacacagaattggcataccaattcatgttccatgggatctaggtggggttctactcccagccacaaggacagaggacataagctatgcctatgcacatcagcacagcatattactggccatagaaattggccagtaatatggccaattggacatgtacttaagttagactttgggtgagaatttggggatgaaagactgtctccatcttccttgcatattacaagaggaaatattcacttttccgttagatagcatgatgtgatgttgtgcagtccacatctttagcaacatttctgtgaagataggggagccaaactgagcatgaagccaccccagaggaaccaaagccaagattttaacaaaaatctcagttgtggtgatatcacctgagccctgattccagcctttcctgaagctgggtctaccccaggatattttcttttgttgttttaagccagtttgaggtggatttttctgtcacttgcaaaaaaaaataaaaatgtcaaactgacttggcttgcttctcactccatcagttatggaatagggcttggggagggcaagtttatgtttcaagtggtaaatgactgtttgggaaggtgattgatccaaagcacattncaggtgacttagaagtatgaagaaacaaatagcatggttagcacgtgttgcaattacaactaaatgtataagcaagaaaggaaaaaatagaggtcagttatgataccaaattgctctatcttctaaagaattttaatcacatttttcatcacttcattaatttggttcaatttttcttgaaaacagtaactattattcttagaaatagacacagactatgtttgaaacctctcaaatgagctccttttgaattattcatgtgagaaaatctctgtagatatccagaaatagggtctctttctgtttccctcacttaaaaacaaatgactgcattttactaaaaagaaaaactaaactgaaaccatatttgaaaaataacaccccatttttcttcctacaaatcaaatttgctgaaggaaantggggaaaaatagaactgtaataaagcatttcaatgtttcttactatatgtttatgtacgtgtttcttacctgttacaatgtataaataactagcaggcaggcagctgtctactcaaataggctgaacatttttctagcacaaggccatgagatctgggtgaatttcactagtagtagatgtgattctaactctgggccatgngacaaagaccttctttataaatcagctttctattttctcctctgctcatacttttctttttcttcccaaggaacgcaaatttcccaagtttgtatccaaagaaatggaaaacatgtacattgaggagctgaagtcatctgtcaacctgctcatggccaacttggagagcatgccggtatccaaaggcggggagttcaagctccagaaactcaaacgcagccacaatgcttccatcatcgacatgggcgaggagagtgagaaccagctctccaagtcagatgtcgtgctgtctttctcattggaggtggtaattatggaagtccaaggcctcaaatctttggctccaaatcgcatcgtatattgcacaatggaggtggaaggaggagagaaactacagactgatcaggccgaggcttctaaaccaacctggggcacccagggtgacttctccacaacccatgcactgccagctgtgaaggtgaagctgttcacagagagcacaggcgtcctggcgttggaggacaaggagcttgggcgggttattctccatcccaccccgaacagccccaaacagtcagagtggcacaaaatgacagtctccaaaaactgccccgaccaagatctcaaaatcaaacttgctgtccgaatggataagcctcaaaacatgaagcattctgggtatttatgggccatcggtaagaatgtctggaagagatggaagaaaaggttttttgtattggtgcaggtcagtcagtacacgtttgccatgtgcagttatcgggagaagaaagcggagcctcaggaacttctacaattggatggctacactgtggattacaccgacccccagccaggtttggagggtggccgagccttcttcaatgctgtcaaggagggagacaccgtgatatttgccagtgacgatgaacaagaccgcatcctgtgggtccaggccatgtatcgggccacggggcagtcacacaagcctgtgcccccgacccaagtccagaaactcaacgccaagggaggaaatgtacctcagctggatgcccctatctctcaattttacgcagatagagctcaaaaacatggcatggatgaatttatctcttccaacccctgtaactttgaccacgcttccctctttgagatggtacaacgccttactttggatcacagacttaatgattcctattcttgcctgggctggttcagtcctggccaggtgtttgtactagacgagtattgcgcccgaaatggagtccgggggtgtcaccgacatctctgctacctcagagacttgcttgaacgggcagaaaatggcgccatgatcgaccccacccttcttcactacagctttgccttctgtgcatcccatgtccatgggaacagtcaacaaatgcatgtgtaccttagtgggctgccaccaaatacagaccctgaagggagcaaaactccctccccacctgaaccagaagctaaaaaagataccaaaaaggaatccaaaaaaagaaaagattccaaaacccaggcaaatcaagagctgaaaaggcctgatggaattggaactgtgactgttgaagaaaaggaacgttttgaagaaatcaaagagaggctccgagttctgctagaaaatcagattacacattttaggtatcggctttccatatggtcgacctgaatgtgcttttgaaagctactctttcacttttggaaggggtttgatggatattgttatctcaagtgccacagtaggcgttccgttattctgtaatgtctggaacacgcttgcgaggcaactttcttggctttg

SEQ ID NO: 27932 - DNA, 559 bp, Homo sapiens
aggagttcaagaccagcctggccaatatggtgaaaccgcgtctctactaaaaatacaaaaaattcgtcggtcatggtggcggtcgcctgtgatcccagctatcaccactgaaactcctttcagttttcagaaacaaactgtaggtgaccagaagcgttatccgctaagcgcaccactttaagtccctgacttagagccacaagtgttctgtttacctattgttactactcttttcactctggcaaacagattaattcacacaaaattttatttgaatggcttttcaatttatcataacaatggttactaaaaagtgagagaatatgtactaagggttgagtacaagttagtgctagtagaaaataagagccttaatagagaaaaaactagttctaatcaaagactggatttagtcaatgatgtttatatttttagcttacatttatagcttcagaaacattttgttactgatattcctatcataattattgtttcaaaaattctctagtccctaaccttccttttttcattaaacaactgttttaaaattaaactgtta

SEQ ID NO: 27933 - DNA, 397 bp, Homo sapiens
ttctaactggaatgaccagggatttttatcatttgcctgagtttcaacatctgtaatagttaggagagttcatgtagaactctacactcatgaacataagaaaactgtttgcctttttaaaagtaaggctagtatcttcagaatggaccataactagtttcatatcaaagaaaagttggaaactgcctagaggatgctaatccattagttattttattttatcatttatttttccaatgtatgaaattatatattttgtgggctgggtgtggtggctcacgcatgtaatcccagcactttgggaggccgaggggggtggatcacgaggtcaggagatcgagaccatcctggctaacacagtgaaaccccgtctctattaaaaattaaaaaaaaaaaa

SEQ ID NO: 27934 - DNA, 2420 bp, Homo sapiens
atttcacagccagctttgacatgcccgtgaggacaggagccgccgcttcagttgtcactgcagagccatcgtatgtcagttgcaatttccatctgaagctatgtctttgacttcactttaagcagaaaattttgtaccctggtggtcgagtcttcccttaaaaattgttaaatcatttggctttaatggttcaataatttggggtggcttcatggtgtttcttttcttcccagtttaaaaaaaaaactttttaagcgtaaaatctttaaggggtacacatttataagtctggctaatttctaatatgctaattaaacatttcccattttaaggttatatacagtgaggctcttcaggacaattattttctgggttgattgggcatatgtttgccgtgtaaacacggatatgataaagtgtcagtaacaatggaaaaggtcccagaggcattaggcatctaagaggatgccctcagaaacgtattctggcttgatttgtgttattaacttcagaagaaccttttcaaatgtcccagtatcgttcttagtgctttgggaaaaaatatttaacacactgttaataaatttgttatcagaagtttacaagacgaagggcttctctcgtctgaatttctagatttaagtcatgaagtgtaaaactgtttcacccagaagtgtaactaagcagaactaggagttttctctggcttcacctttttcagagccagcagtgctgttttctcaagcacagcgtttgctcttagactctgatctgcttgtgcctaagcattgcacaggtttccgaagacgggcagcttcagagaagaggattattcgggagattgctggtgtggcccatagactctttggcatagactctttcgcaggcagccactctgagtgtggccagttctataaccatccccaaactagctggagcctgatggataggaacgggtagtctgtcctcttccccataaaaatgttccaaaaagttatctccagagagagtcccttatgaagacagttgccaagctgtattctcattctttaaaccaatacccaggtcagggctagttcacactagcactgttagggacatggtgtggctagaaatgaattgagtgtgacttctccctacaaccccaggcccagggataggaggaggcagaggggtgcctggagtttctgcactctcatcagtgatgttcatgttacacttgcacaagggctgatttccacgtatgtgtgtgttaatttattcacttagtttcaaaagattttctctccccagccattcagaggtttccaaactaagccactgagtttgagtcagggaattccacgtaaaaagatcagattaaggtaaattctttgttctgtattgctgctgtgacttcagaaaaaaaaaattatgagagctcttcctggaattttgaaatttctatttaatgaagaagtgtataattccattatttattgtttgaggtttgatttatctggaagcttaaaaagaatgttttatttttgttgttaataaaatcccaatcacatttcacaataactaaaatgtctccaggtgggttactggtagatgatagtggtgacacctgcaggtctgcatttgaattggattcacagagaagcattccatggtcacataatgaatagggagaacagatattttcagaaaaatcaaccgattgttttttccagaaacagaacagaaaatgttcagaatattttcaaatttgtcagattcttttatgtttcctttgaaatttattatttaagcctattactaaacctttataaaaatatatttggcaaatacaccaaagaaaccagcttacaaaagattatgatcattaatgaactgcaaacctcatctttcgaaaacaaggttttgtgtttttttttttttgtaaatatttgtgtttataaatgtacagcagagtaagagtgttttttagattatttaattcccatatttctaaactatttactacacagtaatccatgcctgttagtttggaggacttgactgtctcattttttaattcattgtcagtcatgcttggaacagcatttccactagagaatccagcgttctggcagtagcaagagtacacatctggagcatgagggactctagcatgactcgtcagatgcacaccccaagagacaagaatgtgtagtttaatgaccggcgtggaccatacgaaattgagattctaactttcctgcaggagtgctcatgagcccagaatgtgattgggataaggccatttgcccacaaatttagctttcatgtaactcctagtgtgttatatcataatgtattttgttcttcctttttaatgtaagttttgctttgggtcaatttgaattaaaaaaatcaaatctgatttaaaacatgtt

SEQ ID NO: 27935 - DNA, 1700 bp, Homo sapiens
ggagggggcgggggtggcccagtgcaaagtgcatcccgaaagccccctgtccggagaccccacggctggcacttcgggccccgtatgacctgggacctcgccgtcccgagacctcctgggtccctccgtagctggaagcctccggcccggagcgcggcagccccctgctccgagccctggaccgggactgcccccccacccgagccaggacttcctccctgcctccctgcacctctgccccaaggctgcccggcggccgggatcgccacctcctgccttctcggctgttcggatgttcgccgggctggggccgtgaggcaccgaggaggatcaggaacaccagggtccggccctgcctggggtatttcttcaatggagaagttggtgagtgtagaggaggctgaaaggaggaagagaagcagcagctgaggagacaggtttgagctggctgaagaagacgcgaaagcaggaagaggtctgcccacctatcagagaagcagaaggcacagtgcctctgaccagcatcgtctgtaaaggttaagaaggcttttttgctctgtagcctggacgtactttgaagcccctccccacgatgctgtacgtgcacaatggttactaggcaatccgtacatcaggagaagggacactcttccataaggctgatccccgtaacctaatgaatcctttgtaaaaagtggactcagctaggatgttacaccatcattgtcgaaggaaccctgagctccaggaagagttgcagattcaggccgcggtggctgctggggatgtccacacagtgcgaaagatgctagaacaaggctattccccgaatggccgagatgcgaatggctggactctgcttcatttctctgcagcaagaggaaaggaaagatgtgttcgggtttttctagaacacggagctgatcctacagttaaagacttaatcggaggcttcacggctcttcactatgcagccatgcatggccgggcccgcattgcacgcttgatgttagaatctgaatacaggagcgacatcattaatgcaaaaagcaatgacggctggactcccctccatgtggctgcccactacggcagggactcatttgtccggctcctcctggagttcaaggctgaggttgacccactcagtgataaaggtaccacaccgcttcagctcgccattatccgagagaggtcaagctgtgtgaaaatcctcctggaccacaatgccaacatcgacattcagaatggtttcctgttgcgatacgccgtgatcaaaagcaatcactcttattgccgaatgttccttcagagaggggcagacacaaacttgggtcgcttagaagacggacagactcctttacacttatctgcccttagggatgatgtgctgtgtgcacggatgttatataattacggagcagacacgaacacacggaactatgaaggacagaccccattggctgtttcaataagtatttctggaagtagtcgaccatgtttggatttcttacaagaagtcacaagtatgtaatataattattactttattgcattttttaaaaatttgcatcttctgaggagcttaatgtgtttttgcaacttaagatgactagatattaatcattcctataaccactgcttggtaagcgatgcctcattcttctgaaataaaaaaaaaactttgactgtaaaaaaga

SEQ ID NO: 27936 - DNA, 2294 bp, Homo sapiens
ggagggggcgggggtggcccagtgcaaagtgcatcccgaaagccccctgtccggagaccccacggctggcacttcgggccccgtatgacctgggacctcgccgtcccgagacctcctgggtccctccgtagctggaagcctccggcccggagcgcggcagccccctgctccgagccctggaccgggactgcccccccacccgagccaggacttcctccctgcctccctgcacctctgccccaaggctgcccggcggccgggatcgccacctcctgccttctcggctgttcggatgttcgccgggctggggccgtgaggcaccgaggaggatcaggaacaccagggtccggccctgcctggggtatttcttcaatggagaagttggtgagtgtagaggaggctgaaaggaggaagagaagcagcagctgaggagacaggtttgagctggctgaagaagacgcgaaagcaggaagaggtctgcccacctatcagagaagcagaaggcacagtgcctctgaccagcatcgtctgtaaaggttaagaaggcttttttgctctgtagcctggacgtactttgaagcccctccccacgatgctgtacgtgcacaatggttactaggcaatccgtacatcaggagaagggacactcttccataaggctgatccccgtaacctaatgaatcctttgtaaaaagtggactcagctaggatgttacaccatcattgtcgaaggaaccctgagctccaggaagagttgcagattcaggccgcggtggctgctggggatgtccacacagtgcgaaagatgctagaacaaggctattccccgaatggccgagatgcgaatggctggactctgcttcatttctctgcagcaagaggaaaggaaagatgtgttcgggtttttctagaacacggagctgatcctacagttaaagacttaatcggaggcttcacggctcttcactatgcagccatgcatggccgggcccgcattgcacgcttgatgttagaatctgaatacaggagcgacatcattaatgcaaaaagcaatgacggctggactcccctccatgtggctgcccactacggcagggactcatttgtccggctcctcctggagttcaaggctgaggttgacccactcagtgataaaggtaccacaccgcttcagctcgccattatccgagagaggtcaagctgtgtgaaaatcctcctggaccacaatgccaacatcgacattcagaatggtttcctgttgcgatacgccgtgatcaaaagcaatcactcttattgccgaatgttccttcagagaggggcagacacaaacttgggtcgcttagaagacggacagactcctttacacttatctgcccttagggatgatgtgctgtgtgcacggatgttatataattacggagcagacacgaacacacggaactatgaaggacagaccccattggctgtttcaataagtatttctggaagtagtcgaccatgtttggatttcttacaagaagtcacaagacagcccagaaacttgcaggacctgtgccgaattaaaattcgacaatgtataggccttcaaaacctaaagctacttgatgaactaccaattgccaaggtcatgaaagactacttaaaacacaaatttgatgatatctgatatgccagaactgtgagcaagattaggagttctattctagatacttaaaaggctttttgccttgcacaaagtatatcctatgcaatttctgatttgctgtgaaatcagaaagcaggtatacacttttgggttttctgtttgtttggttggttttcattgtaggggagggattttttatatatatataaaaacacacaccacatgcttgaaggtcttaatttggtttcttggtccaagtttaagaggtccaagctttgtatacaatactgcatttagaaaaattgtcttttcttaaatgacacaagcaggtttagagtggagaatttaccctttccaaatttatggttccttggtaagcacggtattctaaaccagcagagcacttgttaacgtttggaggcacagtttcacccagggcgaccctgggttcttttggaaaatgccctaagaaatgtttgaagtaacgctgtcacctcattcatttttaatgagtacaaactggccgtttcaaactgttctttttcctaattaatgtagctttcggatgacataaatccagtatctctgcttatgacataaatccagtacctctgcttttcttttgctgtgctcttgtttttaacttatt

SEQ ID NO: 27937 - DNA, 2131 bp, Homo sapiens
ggagggggcgggggtggcccagtgcaaagtgcatcccgaaagccccctgtccggagaccccacggctggcacttcgggccccgtatgacctgggacctcgccgtcccgagacctcctgggtccctccgtagctggaagcctccggcccggagcgcggcagccccctgctccgagccctggaccgggactgcccccccacccgagccaggacttcctccctgcctccctgcacctctgccccaaggctgcccggcggccgggatcgccacctcctgccttctcggctgttcggatgttcgccgggctggggccgtgaggcaccgaggaggatcaggaacaccagggtccggccctgcctggggtatttcttcaatggagaagttggtgagtgtagaggaggctgaaaggaggaagagaagcagcagctgaggagacaggtttgagctggctgaagaagacgcgaaagcaggaagaggtctgcccacctatcagagaagcagaaggcacagtgcctctgaccagcatcgtctgtaaaggttaagaaggcttttttgctctgtagcctggacgtactttgaagcccctccccacgatgctgtacgtgcacaatggttactaggcaatccgtacatcaggagaagggacactcttccataaggctgatccccgtaacctaatgaatcctttgtaaaaagtggactcagctaggatgttacaccatcattgtcgaaggaaccctgagctccaggaagagttgcagattcaggccgcggtggctgctggggatgtccacacagtgcgaaagatgctagaacaaggctattccccgaatggccgagatgcgaatggctggactctgcttcatttctctgcagcaagaggaaaggaaagatgtgttcgggtttttctagaacacggagctgatcctacagttaaagacttaatcggaggcttcacggctcttcactatgcagccatgcatggccgggcccgcattgcacgcttgatgttagaatctgaatacaggagcgacatcattaatgcaaaaagcaatgacggctggactcccctccatgtggctgcccactacggcagggactcatttgtccggctcctcctggagttcaaggctgaggttgacccactcagtgataaaggtaccacaccgcttcagctcgccattatccgagagaggtcaagctgtgtgaaaatcctcctggaccacaatgccaacatcgacattcagaatggtttcctgttgcgatacgccgtgatcaaaagcaatcactcttattgccgaatgttccttcagagaggggcagacacaaacttgggtcgcttagaagacggacagactcctttacacttatctgcccttagggatgatgtgctgtgtgcacggatgttatataattacggagcagacacgaacacacggaactatgaaggacagaccccattggctgtttcaataagtatttctggaagtagtcgaccatgtttggatttcttacaagaagtcacaagacagcccagaaacttgcaggacctgtgccgaattaaaattcgacaatgtataggccttcaaaacctaaagctacttgatgaactaccaattgccaaggtcatgaaagactacttaaaacacaaatttgatgatatctgatatgccagaactgtgagcaagattaggagttctattctagatacttaaaaggctttttgccttgcacaaagtatatcctatgcaatttctgatttgctgtgaaatcagaaagcagtcatgcttggaacagcatttccactagagaatccagcgttctggcagtagcaagagtacacatctggagcatgagggactctagcatgactcgtcagatgcacaccccaagagacaagaatgtgtagtttaatgaccggcgtggaccatacgaaattgagattctaactttcctgcaggagtgctcatgagcccagaatgtgattgggataaggccatttgcccacaaatttagctttcatgtaactcctagtgtgttatatcataatgtattttgttcttcctttttaatgtaagttttgctttgggtcaatttgaattaaaaaaatcaaatctgatttaaaacatgtt

SEQ ID NO: 27938 - DNA, 323 bp, Homo sapiens
ttcagtaaggcacccagttagtggttagtgttgtaaaccttggcctttttaaaaagtacatttaaaatcaagaatgtataagtcatactgctttaattttcagcctttgagaaatgctagctaatataatgtggggagatatcttatacatgcatacctatacacaatagtgtacaaccatatagagacatgtatgtatatatatgcaaacatgcatttatatatataaacatatacacaaacacacattgtgtatgtatgtgtatacatatgtgtcacacaattaagtcaaattgctacactgaggaaaacttaacaatatt

SEQ ID NO: 27939 - DNA, 664 bp, Homo sapiens
gacacaatatggattgaagttttgtggtaataggaagcttatacagtgttgaagactcatgtatcctagctgttgtggacacagacccataaatcattgatttactgcatgcaatttattctggaggacagtatctcatgtttgcagggtatcatcctccaaatatcactttagctgaaactttaataggctattccaattgtctatcagactagctgtttgtggagattatatatatatatacatatgaccagctaaagctactgtataaaccaacatttccctttccacctgttcctcatcttaacccatcacaggtaagagtcttaatcctaatactacagcacaccaagggttaccatcaccccacttaccactagaaatgaggtccttgttactatttggtgggtgaatgatcccgtaccggaattctatcctgaggtttgtaggttcagacctacaagtagctacaggtagcttctattttctagggccactctctacatgctttcttagtttggatttccctaaatgcaatggctaagacaggcctaggatgcagataatttgagggctgactgcaggaagcaggtctaagggagcaaggagagtaatggaagaaacgtatgtcaaaataaagaggctttgcttttctaactataaa

SEQ ID NO: 27940 - DNA, 287 bp, Homo sapiens
gcaataagttgttcggaagtgtatttcctaacttccaaacctatttgaattttctagttatcctcttactcttgagttccagcataattataacatgatcagaaaaactagactatatgaattcaatctcgtggaagtgttgaagcttgttttatggcctagcatgtggtcaactttggtaactgcttcatgtgtgcttgaaaaaaatgtctgttcaggggtggtaaggtaaagtgctcttcctgtgttattcatgttgctcaaatgatctggataatttgtcgatt

SEQ ID NO: 27941 - DNA, 2076 bp, Homo sapiens
taatgaaaaccacctgggactacacacgcatgccaccacgcccggtcagaagctgtgtttttaagtggacataccatcttgtcctgctgaagtatctccatgtaatcacaatatctatgtcacccaaatctcctccttcctcctccctcccccaaaacacccccacaggcatgcataccctcccatgcgctggaggcagaatctcccaaggggagctggccaggagaggtgtccctgagttcagatggaggtggaagccagagtggggctgggaccacccagtgacatgaggatggggcttgggataaagccctggggacactgacatttaaagtgtggacagaaggagctactgaaggcaatggatttagaaaagcaattgagtatgatttccttcttcaagaaaggctgtccaactagctctcacttcctctcgtgtgttcagtgtcacccggaagcagagtttaatgtgactaaagtcaacattggctcacactgtcagggagtgtgggaagatgagtaaggactcatcgcagggcgatacccacagcttaaaataggcaccttcccctcccaggtctggttagggcagttgttacatatgaggggcgtggagttttgtcttgtattttggccttgttggtaaagcattccaaagcttcgacacaccctcctttcagcccattaggaaaggctgttgattgtaatattcacacagctccctgggctatggttaagagccttgcagaaggactgggagaagccctgtgtgtttgaagtattgtagcatcagaaaaaaacaccggaagaaggcaggtggggacaaggtgcctatgtctgctccttggaattcctttccttactgtccgaggcaactacagggaaagcaaagcgtgagcccccaaatccacacctgggaggaacgttcccctttgcaaggcatgggactggctggccctgtgtctcacgggggctctgagttttgaggtcacactagcctcctgaggcctggctgagagggctgggttgggggtcaggaggccccctgtagccacgaagctcctctggggcattgttaaaggttcaccctcttttttgtgggtatcctggaagatctcaagaaactgagcttggaagaagagaggctgagagggtctcccgccgcctgcgttctctgcagctatggccccacagcctccagtgaccatggaggggaaggtgccacccgccttggctgctgaaagggtgatgctcttatgcctgagtcttggctcctgtggtcctgcagagaccctgtgggggccgcccggtcgtcacctgcactcatcttgggttttccttccttttccaccctaagctgaaggtatttttttcctgttttcttcactctaacttggggaagaaggaagatcctttatggaaaagaaaaaaaaaaaagcacctttgaacgtcctgcaacttgagtttcaagctttcagaaggattcggtgctgctggcctgctcagacctccgcctgggctgtggagttcctcctgttggcccctcctctctgtaccacaaaagctctaggcggcccagccacccctgtgaaagcggcgcccgtagccagacgccaaggctgccgtcccgagccgagggtggcaccttgcccagcgcacgtgcattctcctgtgggaactcggagggcatgtggtgagcagtctcctgtcagttgaggtggaggctcccggcccatctttgctctcctcaggctgcccagctcctggcggcacatggtggcctggcaaagctgacttggcctcctcagttccccacccatccgcggatcatcgccttccctagccacctctctctatagccaccgacatctgcggagcgtcacagactggttctgagctgtggtttacaaattcaacccaacacagagtgaattcaaatttgcttttggaacagcctttatctccaattaagtgcaagtatatttcacactatgtgatattaaaggacttctccaatgactgggaggtactgaaccaagatgtttgtaaagaaacggtggggtgaggtggttaggt

SEQ ID NO: 27942 - DNA, 3791 bp, Homo sapiens
  misc_feature (900)..(900): n is a, c, g, or t
  misc_feature (1221)..(1221): n is a, c, g, or t
cgagattactgaattttacaagcttgacattttctattggctttataagctcttctcatgtttttattaccctcacatccaatccgttcgagctacacgctaaatcaaattggtattttatatttttatttttttagaggcaggatctcgctctgtcacccaggcaggagtgcagtggcacagtcatggctcgctgcagccttgacctcgcctcagcctccccagtagctgggaccacaggctcatgccacgcacgcccggctgaagctagttttaactgaagaaaactcaaagtgttctctcgccgttaacctttattattgaggcattggctctgctataggaaaacgaggtgacgttaatatcggtggttgacattaaccactggcaagtgacagtgtggctccttgacaagtggttgctgctcataaatgtcatgaaacaaaaacactgattttagagaagtgggattctacagttaatatcgccagcaaacttttattaagctctcactctgtgccaaacacatgcttgaagttggggtgaatccgtgaccattaagatgttggctgttcatgggcacgttatcaagcaactggggtgtgagagcgaatgataagagggtgaatctggatgaggagggacttccagggcacaggtggaggagaggcattgcagccatagagaggcccaagggaacagtcaagacaaggcggggacagtggccaggaggcgagggcagcacttcctgggcagggaaggcttgccagggagaccagactcctgtctctgtttggaaagaaaaggaaccgcactgggggtcagggaggctaggcacggcaccagcctgggatgccagtcccgcctgaggggccaaggcaaaggggaagcattcacagnccccacaccaggctctgacgccaagtggaagaagagggagatagaagcagaagcctgggcttccaggcctggttcctgggcgggtgttgatgggacccagggagagtcctgtggggatactttgggtctgggctggcaggggctctggaaggagaggcatggaggtgcgaacctggtgcccaggtggaggtgcagtgggggtaaggtggccaggctgcagacccctgcatcagaatgcctgcgaagctgtgggttttttgtttgtttgtttgttttatttcgagacagggtgtcactctgtcgcccagactggagtgcagnagcgccgtctcggctcactgcaagctccgcctcccaggatcaagtgattctcctgcctcagcctcccgagtagctggatttacagatgcatgccaccacgcccagctaattttttgtatttttagtagaaacgaggtttcaccacgttggccaggctggtctcaaactcctgacctcaaatgatccacctgcctcgtcctcccaagtgctggaattacaggtgtgagccgcaccagcctgttttttaattttatttagagacagggtctcactctgttgcccagactggagtgcagtggtgtaatcttggctcactgcagcctcaacttccagcgctaaagcaatcctcccacctctgcctcccgagtaactgggactacacacgcatgccactacacccaggtaatttttaaaaattttttttagagacagagcttctccatgttgcccaggctagcctcaaactcctgggctccagtgaccctcccgccttagtgtctcaaagtgctgggattacaggtatgagccaccacgcccggtcagaagctgtgtttttaagtggacataccatcttgtcctgctgaagtatctccatgtaatcacaatatctatgtcacccaaatctcctccttcctcctccctcccccaaaacacccccacaggcatgcataccctcccatgcgctggaggcagaatctcccaaggggagctggccaggagaggtgtccctgagttcagatggaggtggaagccagagtggggctgggaccacccagtgacatgaggatggggcttgggataaagccctggggacactgacatttaaagtgtggacagaaggagctactgaaggcaatggatttagaaaagcaattgagtatgatttccttcttcaagaaaggctgtccaactagctctcacttcctctcgtgtgttcagtgtcacccggaagcagagtttaatgtgactaaagtcaacattggctcacactgtcagggagtgtgggaagatgagtaaggactcatcgcagggcgatacccacagcttaaaataggcaccttcccctcccaggtctggttagggcagttgttacatatgaggggcgtggagttttgtcttgtattttggccttgttggtaaagcattccaaagcttcgacacaccctcctttcagcccattaggaaaggctgttgattgtaatattcacacagctccctgggctatggttaagagccttgcagaaggactgggagaagccctgtgtgtttgaagtattgtagcatcagaaaaaaacaccggaagaaggcaggtggggacaaggtgcctatgtctgctccttggaattcctttccttactgtccgaggcaactacagggaaagcaaagcgtgagcccccaaatccacacctgggaggaacgttcccctttgcaaggcatgggactggctggccctgtgtctcacgggggctctgagttttgaggtcacactagcctcctgaggcctggctgagagggctgggttgggggtcaggaggccccctgtagccacgaagctcctctggggcattgttaaaggttcaccctcttttttgtgggtatcctggaagatctcaagaaactgagcttggaagaagagaggctgagagggtctcccgccgcctgcgttctctgcagctatggccccacagcctccagtgaccatggaggggaaggtgccacccgccttggctgctgaaagggtgatgctcttatgcctgagtcttggctcctgtggtcctgcagagaccctgtgggggccgcccggtcgtcacctgcactcatcttgggttttccttccttttccaccctaagctgaaggtatttttttcctgttttcttcactctaacttggggaagaaggaagatcctttatggaaaagaaaaaaaaaaaagcacctttgaacgtcctgcaacttgagtttcaagctttcagaaggattcggtgctgctggcctgctcagacctccgcctgggctgtggagttcctcctgttggcccctcctctctgtaccacaaaagctctaggcggcccagccacccctgtgaaagcggcgcccgtagccagacgccaaggctgccgtcccgagccgagggtggcaccttgcccagcgcacgtgcattctcctgtgggaactcggagggcatgtggtgagcagtctcctgtcagttgaggtggaggctcccggcccatctttgctctcctcaggctgcccagctcctggcggcacatggtggcctggcaaagctgacttggcctcctcagttccccacccatccgcggatcatcgccttccctagccacctctctctatagccaccgacatctgcggagcgtcacagactggttctgagctgtggtttacaaattcaacccaacacagagtgaattcaaatttgcttttggaacagcctttatctccaattaagtgcaagtatatttcacactatgtgatattaaaggacttctccaatgactgggaggtactgaaccaagatgtttgtaaagaaacggtggggtgaggtggttaggt

SEQ ID NO: 27943 - DNA, 346 bp, Homo sapiens
cagaagtgacttatcctatccaaagtctggtccctgtctctctcacaggcttggagaggctgatgtgaatcttatctcttgttattagaatgggagtgtctagagggcaaggtcctggttgactggaccttgctgagcaccctaagctgagcacaccatgtagtagctgtcagtaaatgactgaatgaagtcgatgcaatcatgtctttgcatatgggagttcctcttcctggaatgcgactcaccccccttcagatccttcctgtccttcaggcccagtactgttccccagcttctccaggacatcacagcaaccccctcttctgccttacctttcccagcattg

SEQ ID NO: 27944 - DNA, 950 bp, Homo sapiens
  misc_feature (5)..(5): n is a, c, g, or t
  misc_feature (65)..(65): n is a, c, g, or t
  misc_feature (83)..(83): n is a, c, g, or t
  misc_feature (88)..(88): n is a, c, g, or t
  misc_feature (151)..(151): n is a, c, g, or t
  misc_feature (242)..(242): n is a, c, g, or t
  misc_feature (337)..(337): n is a, c, g, or t
  misc_feature (341)..(341): n is a, c, g, or t
  misc_feature (458)..(458): n is a, c, g, or t
  misc_feature (684)..(684): n is a, c, g, or t
  misc_feature (687)..(687): n is a, c, g, or t
  misc_feature (689)..(689): n is a, c, g, or t
  misc_feature (692)..(694): n is a, c, g, or t
  misc_feature (699)..(699): n is a, c, g, or t
  misc_feature (702)..(702): n is a, c, g, or t
  misc_feature (705)..(705): n is a, c, g, or t
  misc_feature (789)..(789): n is a, c, g, or t
  misc_feature (800)..(800): n is a, c, g, or t
  misc_feature (859)..(859): n is a, c, g, or t
  misc_feature (883)..(883): n is a, c, g, or t
  misc_feature (887)..(889): n is a, c, g, or t
  misc_feature (891)..(891): n is a, c, g, or t
  misc_feature (895)..(895): n is a, c, g, or t
  misc_feature (903)..(903): n is a, c, g, or t
  misc_feature (906)..(906): n is a, c, g, or t
  misc_feature (909)..(909): n is a, c, g, or t
  misc_feature (921)..(921): n is a, c, g, or t
  misc_feature (923)..(923): n is a, c, g, or t
  misc_feature (928)..(930): n is a, c, g, or t
atggntaaccaaagctccacaccgggcttcctccttctgggcttctctgaacacccagggctggnaaggactctcttcgtggntgtcntcacttcctacctcctaaccctagtgggcaacacactcatcatcctgctgtctgcgctggacnccaagctccactctccaatgtactttttcctctccaacctctccttcttggacctctgtttcaccacgagttgtgttccccaaatgctggncaacctctggggcccaaagaagaccatcagcttcctggactgctctgtccagatcttcatcttcctgtccctggggacaactgagtgcatcctcntganagtgatggcttttgatcgctacgtggctgtctgccagcccctccactatgccaccatcatccacccccgcctgtgctggcagctggcatctgtggcctgggtcattgggctagtggngtcagtggtccagacaccatccaccctgcacctgcccttctgccccgatcggcaggtggatgattttgtctgtgaggtcccagctctaattcgactctcctgtgaagacacctcctacaatgagatccaggtggctgttgccagtgtcttcatcttggttgtgcctctcagcctcatccttgtctcttacggagccattacctgggcagtgctgaggattaactcngcnanagnnnggagnaangcntttgggacctgctcctcccatctcactgtggtcaccctcttctacagctcagtcattgctgtctacctccagcccaaaaatccntatgcccaagngaggggcaagttctttggtctcttctatgcagtgggcactccttcacttaaccctctcntatacaccctgaggaacaaggagntaannngngcantcaggagnttnctngggaaggaaagngnctcannnaaagctggagagctgcttaa

SEQ ID NO: 27945 - DNA, 412 bp, Homo sapiens
gccaacatggtgaaaccccgtctctactaaatatacaaaattagccaggcatggtggtgcatgcccgtaatcccagctactggggaggctgagataggagaatcacttgaacccaagaggcagaggttgcagtgagccaagattgtaccgctgcactacagcctgggtgacagagtgagagtgtctcaaaaaaaaaaaaaaaaaagaaagaaagaaaatctcacgttctctggtcaatgtgaagatacatcttcctcgtgactcagcactccatttccaggtgcaggagaaccatccacacacctgcccaggagacatggctaagatgctcgtacatttattatttttaatagcaaaattctaaaaagagtctgaggggaatgaatgaatcaatcaatcatggtgcagtcat

SEQ ID NO: 27946 - DNA, 473 bp, Homo sapiens
ggtagagatggagtcttgctatgttgcccaggctggtcttgaactcctgggctcaagcgatctgcctaactcagcctcccaaagtgccgggattacaggtgtgagccaccgtgctctggcaagaacaatgttttaagaagcatgaggatgttgagtatcaaatgccgcaaagttcgggtgagaaaactgaagagtctactcggcaatcaggagttcattggagactctggcagaagttttctatagtagaatggcaggaaatgtagccatactgaaattttgttagggacaaacaggtgatgaggaaatgaagaaaatgagaatgaagactgtttttaagaaactggagtgtgaagaaaacagtaggacaataagtaagaaacctcaacggggtgtgaggacaagttccccaggataaagtggataagatggaggttggcacttaagatttggagcaggttcaacagagagga

SEQ ID NO: 27947 - DNA, 447 bp, Homo sapiens
ggtgttgtggtgtgggaggatcacttaagccctggaagtcgaggcagcagttagctgtggtcatgccactgcactccagtctgggtgacagagtgactttgtctctaaaaaaagattccttgaaaaaaacaacaaacataaaaaaatagctgggtgtgttggctcatgactataaaatcccagcaccttgggaggctgtggtggttggatttgctttgaacccaggagttcaagaccagcctgagtaacttggtgaaaccccatctctacaaaaataccaaaaaattacccaggcatagtggcacatgcctgtagtgccagctactcgggaggctgaggtgggggaatcacctgagcccgggaagttgaggctgcagtgagctgtgattgtgccactgcactccagcccggaagacggagtaaggccctgtctcgaaaaaaaaagaa

SEQ ID NO: 27948 - DNA, 474 bp, Homo sapiens
gggaactattagaacaaatatataaaccttcctaaataccaaaaaaaaaggtaaaaactaaaatataaaaagaaaacaagtaaaatagaccacatattgaaagactacttgcataaaagacttgaatacatagacatatatataaggacattaaaaacaaacagataaatcttctacctacagctccatcagtaagaatttgttgaataagctttggtacattcacacaagaaagtattataccatgcagctataaaaatgaatgaaaacatctccatatgaagctctatatgccaccacataggcatcctcgggacaggttgatactcatttgtatctgtttatattttggaaacaaataggggaaggacaaactatagaaaaaattgttaaacagttacctataaagaaagtgaagaaattgggtaaaagtgaaagaggaatgaaactcgacttctttgaatattttttgtt

SEQ ID NO: 27949 - DNA, 375 bp, Homo sapiens
cctggtagaccagaaggaccattcctttaagctatgaagatgcacatttcttggctctgttaggtactagatgagtatctttaggcagggagcactttacattttaaagactgctatcatttgtggttgaataactggaatttgcttacatcaattttccagatggccaaaatgataaggtcactgattctgttgagtgatttttacacatgtaaactgttagaaaaacagtgcttggcagccgggcatggtggcacatgcctgtagtcctagttacctaaagggctgaagcgggaggattgcttgagtgagttcaaggagttcaaggcaagcctgggcaataagtgggaccctgtctctaaaaacaaacaaaaa

SEQ ID NO: 27950 - DNA, 381 bp, Homo sapiens
aaaaatcttcctaaattttctgtaaagcaaaatttcacatagcaaaaccaattttctcttggctcccattataaaactagaggtttatttctaggctgggtgcggtggctcacgcctgtaatcctagcactttgagaggcctaggcgggtggattacctgaggtcaggagtttgaaaccaggctgggcaacatggtgaaaccctgtctctactaaaaatacaaaaattagccgggcatgttggtgcatgcctgtaattccagctactcgggaggctgagacagtagagttacttgaacccaggaggcagaggttgcagtgagcgagattgcatcactgcactccagcctgggtgacagagatgagacaccatctcaaaaaa

SEQ ID NO: 27951 - DNA, 297 bp, Homo sapiens
ctgtggccctgcccaagtcactctcctttctaacgctcatattctcctgtgttcattggaggtaataggacctgcctccaagagttgtaaagatgaggtgagacaggctcggccaaagtgccccattgactgtgtagggctctgcagtgctgtcttcttattttcagatgtttggtacctgccccttggtacctgggtacttgccatctgtaccatatgctgtgtagagggtaaatgttcattgacaatagtgaatactccagagaaaaatattaataataaaaaagcaatgtttga

SEQ ID NO: 27952 - DNA, 378 bp, Homo sapiens
gcaggaatgtgtggggagtattaatggacagtatgacaaggagcttgtggagtgaattaaagcagcctcagagagaaggctctttacctccacgtaatcctcagacagggcccaggttccccttagtgtgcctaggacagctcattaagaattaatgcccatggctgggtgcggtggctcatgcctgtaatcccagcactttgggaggctgaggcgggaggatcacttaaggtaagaagctctagaccagcctggccaacatggtaaaaccccaaaaatacaaaaattagctgggtgtggtggcaggtacctgtaatctcagccactcgggaggctgaggcaggagaatcgcttgaacctgggaggcagaggttgtgg

SEQ ID NO: 27953 - DNA, 707 bp, Homo sapiens
tgattcggctgatctggctggctaggtgggtgtccccttcctacctcaccgctccatgtgcgtccctcccgaagctgcgcgctccgtcgaagaggacgaccaaccccgatagaggaggaccggtcttcggtcaagggtatacgagtagctgcgctcccctgctggaacctccaaacaagctctcaagattgctgatctagggccactaagtgatgaagcaaaaaggatggctaaaaaggacctcaacccttttgactttaaaaggaaaatagcttaaccttcaacctgtgtgacatttaactttttgaacccaaccgtaaaagctatcttctaaccaacaaaaagttaataattacatttggaattatacagaattagaaaattggcatttaaaaatactcaataatttgtccctggtttttaattttcaaaatattttctttttgaagagccagattccagtgatcctgcctctcagaaatttccacatttcttatttttcattaggccttaagaagctgcatttgtaaacttgtgtttcattattaaagcttaatttattttttatataaatagtatgtgctttgtgtacatagagaattaagtgaatgagtcacacagatgttggctgttgttaatgtgaaaattaaacagctgtatcacattttgaaaaataaaagtttcatctgaatgaatataaaaaaaaa

SEQ ID NO: 27954 - DNA, 457 bp, Homo sapiens
ccagctaatttttgtatttttagtagagacggggtttcaccatattggccaggctggtctcgaactcctgaccctgtgatccacccacctcagcctcccaaagtgctgggattacaggcatcagccatcacgcccggctggatttttaaattggtgaattaacatactcattcaacgttggccagttttggccagatgccatagctcacgcctgtaatctcgacatttgggaaagccaagaagggaggatcacttgaggccaagagttcgagactagcctgggcaacataacaagaccccaactctatgaaaaacaaaaataaataaaattagtcaggcatagaggcctatacctgtagtaccacctatgcaggtagatcatttgagcccaagaattcgaggctgcagtgagttatgatcatgccattgcatgctagcctgggtgacagagtgagac

SEQ ID NO: 27955 - DNA, 1781 bp, Homo sapiens
aaaaaaaagaaagctgacagatagtatctgtaaaagtataggccacaaaggaatgacaagttgttaattagaacacaactggaaatctcaagattacccttacctgctttggttttctacttagagttatttaatgcagctaagggcacttttttcctcatttgctaaaatttccacagttttgaatacgaatcatttctacatttcttgattattcgtttaggcacatagtcaggtgcaacaaaatttcctgatcaagtggagcttgctaactgatttaccaacacaaattagaccaaaattcatgaaggtgaggccattaaacagatcacttttgtctggaatgtatttcagaaaacagggattatgttttacttttatagctatgctctgcactggcaagagattttgcaacaattttttattgtttgcctaaaaccttagaaccttagctcatattagacttgagtgaactgagatgtacaggaaagataaaaagaaagttactattggtctcagaatgtaaaagtctgggattaggttgcttcatcacaaagtattcagccttttaccaaaactacctttcaaaaagcacttaaaagttgaggccactgacaaaaggaaggaaaaatctcctacagtgattgttgttggaagaatgggaatgatagctcaattaatttagttaattcatactgccccagatgtccttgtcagcttgtcctctagtcttcagactttgtgaataaatcaggtggagtaagtaatttacatgttgtgtctcatttactttttgcaacaaacaaccgccctttactgataatggagattaaggctaaggggaactaaaagaatgttgtctacaatcacacagcaagtgatggaactgaaattcctgttggggtctttctggtttaaagtttattttaaagatcatttctactatatcccaattttaaaatatgcattagaaagaaaacagcaaaaacttcttttttctatttaaaaacaagcaaaaagaaggacataaaagttgcctatattcctgccatctagagagacttaattctgtcaagactgtaggacacattgaccatctttatttgttcctctgccccaaaagaaacaaaacttaaagtcagagaagcttaatgaaacagtaggataaaggctccctatcttgtgtctagaagtaagaattgacagtgattccgttttcaaagcatttattgaatagtatcttccaaacagtatgctggcttttagacaggttatacaggtgaatgtaggggtctatccttaaaaagcctataaggcagttgttctcaactctggctcatttaaaactctattgggaagtttttagaaaatatctgtggctgggcattttttttttttaaagagacagagtcttgctctgtcatacagactggagtgtagtggtgtgatcataagtcactgcagccccaaactcctgggctcaagcaattctcccacctcagcctcctgagtagcagccataggcatgtgccacaacgcttggctaacacatttttttaaagcttcttaggagatgcagccatggtgaagagccagtattatgaattaattggggaaactgatgcatatagatcagtattaggagagtttgaggctaggccagatggctcacatgtctgtaatcccagcagtttgggaggctgaggctggtggattgctttgagcccaggagtttgagaccagcctgggtaacgtggtgaaaccctatctctaccaaaaaa

SEQ ID NO: 27956 - DNA, 480 bp, Homo sapiens
attccagatttatttttatgttgggggaagggagagtctacgaaattttttttttttacatgatttttggaaggaaggagattttttttcaactttctatatagattattagttttaaaaacaaatcttcagagaaggcaaatcattaacagtcaagaacaactttgataatatatagagatgaataaatcagtatttttattttcttaaaataagtatataatttatcttggctggatctggtggctcatgcctgtaatcccagcactttgggaggctaggcaggtggatcctttgaggtcgggagttcaagaccagcctggccaacatggtgaaaccccatctctactaaaaatacagaaaattagccgggtttggtggcgggtgcctgtaatcccagctactctggaggctgaggcacaagaattatttgaacccgggaggcagaggttgtagtgagctgagatcgcaccactgtac

SEQ ID NO: 27957 - DNA, 1616 bp, Homo sapiens
gtatattctgcagagataaccaagtaaatgacatacagatagtcaatggctctgagtggctctactagctacatctttttatgttaataggttttttacttttttcagagaaaattatatccagcatttttaatctttagactaataacaccaggtagacacaaagctattcctggaacattgctttattatagataggaattccataaccaattacctcctatttgctagaacacactaacacaaatacataaaaaatacagactaaactataatagaaggcagttttctctggtgtttgtagcacctctcttctactaatttaaaatatcttcatcactgaggatgcctcctattaaaatgttatatctgagttatactaataactatgaaattaccaggtgtctctgcttgagtagttggaattaatttttttgcctcataactctggagacttctcagaaagtgtagctaaaggtttattcatcaaaatccccttctaatgaatcgactctgatgattctgctgttgtcagaatggatgttctaggaagttgtcatcacacttgaccgtaatgaaaatgctgccctggaccatctccccaaactatgtgtcctcagtattgtgggaagaacccacttcatgatttctaaccagggtagcctctggaagtacaaatgattgctgtaaaattatgaacagagcagcatcaggctttgctctgatgtatcttatgaagcctttctacttccaaatgaagactatgaagagaaccttgaaacaatgcccttctgggagctcattcagcaagcatattctgagggcatattctgttccactctctacgcatggaggattcttgtggtgaggaagacattcttcattggttttaaagagctcaccatttagcacagtcagccgctgagacaggactgctagataactacagaggttatgcattgcaccatttgtacacctcgtacaaccctatgaggtagccctcagggttcaaatggaatgcatctatattttgaatacagagtgatatataataacaagaaatcctggatgtctaattgactgtcttcccaaacagcatagcagattacctttttagtctcatcatttatgtgcagattatgaaacacatttattagtcaatagagtcccttcctgcatttatacattctcctcataactcagttgttctacttcacttccataaggctgacttgcaagtctgaatttatagttgtgttctctttcctaaatttagttcagttatctccctccataatttacatttaaatatcccactgtaacctaaaacatagcttcctttgttaatttccccgttgttacgaagaaaagtattattcctcagtaatttgggctcaaaatattaccctaatctttgactccttctgtcttcctcagtcccaagacacatcaaaggctgatcaaagttagccgggcatggtggtgggcacctgtaaccccagctactcaggaggctgaggcaggagactcacttgaacccgggaggcggaggttgcagtgagctgagatcacaccactacactccagcctgggtgacagagtgagactctgtctca

SEQ ID NO: 27958 - DNA, 301 bp, Homo sapiens
tatcactgatttctatctgttgcactgttgcattcactaagaattctactataaccagtaaaagcacacatttttgtcttggtccttggtgctataattaactttgacattaaatttgcttttgaaaatttttaaacagacaccctttaccaggttaaggagattccttttctattcatttagtaaaacttgcctataaaactagttctagagtcttaatttgaatgctgattcaatttcttcaatggctactgatttcatccgttttctaattcttcttgaatcaattttagtaatataa

SEQ ID NO: 27959 - DNA, 423 bp, Homo sapiens
agaaaatagagaaaagtgatagataaggggcctcatttagtgggagcttaaatttcaggcatagtgatgctggctcggttcaatggagatttacaacaacaggtgcagtggaaccttagattggggcagagagtgatttgtgtgtgtgttgggggaggggagaaagtgggggcctcatttgatctgtctgctactggaagaaaaataaactcaaattgcccttctcttcttctaagaaacaaagggatgaaaggaactttaggccactaagcttcttttattcttgcctctttctcaaatagatcagaaaataatcccatattattaaccaccttgccttccccaaaaatatgaaaaaaaagacactactattcccccgatacttacagaatcctataatacggtcagtgagtctggacctca

SEQ ID NO: 27960 - DNA, 434 bp, Homo sapiens
agtttacctcaggaaaagtgcttgtcaatctgcgggggaaacgtcccttgctgtgcttagtttttgttcttatgctgccctctaatggataccaaattatttcattaaacccagaacaaaagtaaattttcagcttctcagggctcctgcatcatcccattactgttggaaattgttatctgaccattttcccctttgcatacatgttggtgtagcacagctcgtactaattgtgcggagtcaccctgggccaaagttgcattcctgttctgggaagtagagggacagcgatgccaatttgtgcactgtcgaactttccttttttctctgccagcaattgggaaagaattgatgttctgggggacttaaaaatgagggaataaaaacagtgttaagtgctgtattaagacgatatgctgtatgttttatcagcc

SEQ ID NO: 27961 - DNA, 362 bp, Homo sapiens
gcaatccacccacttcagcctcccaaagtgctgggattacaggcataagccaccacacccagcctcataagtataagaaatatctaacctgaagcccactgggtgagccacgccccagaagtagctgacttcttctagatttctgtccaggattagccacacacagggctgtgactttttaagaaataggaagtggggtatagtggcttgcaccagctactcaggaggctgaggtgggaggatcgcttgagcccagacattgaggctgcagcgaggcatgatggtgccactgcactccagcctgggtgacagagcaagactctgtctctcaaaaaaattaaatttcttttttcttaaaattt

SEQ ID NO: 27962 - DNA, 397 bp, Homo sapiens
cagtaaagagtttaattgacacaggccagccacaacatgtgggggacggagttattactcaaatctatctcactgaaggcttggaggccctcccagcaggacgactgagcaaggccttggaagaccggagagattggagcgcagaatggggaggaattgaggggaaaatggagatagaacctgaaagagccccaaacgccagaacctgtagctccccaagaataagatcttccagaagaactagacccaaaactagccgttggggaacaccgaaatccttggaggagcaacatccgcatgaccctttgtgttcctttaggcaaaaggacttgcttccattgtttgttcaattgtttgtgtttcttaaataaataaaacgattttcatgtatctttga

SEQ ID NO: 27963 - DNA, 1162 bp, Homo sapiens
cagtaaagagtttaattgacacaggccagccacaacatgtgggggacggagttattactcaaatctatctcactgaaggcttggaggccctcccagcaggacgactgagcaaggccttggaagaccggagagattggagcggtaagtcgcgctggtcacgttggacacctgcgcgttgggagattctggagccagaaggatagccgaatggccttcgcccgccctgcccctcgcctgcttcagaaacccccggaaacgccccggttgagaccccggcccgagccgcctgggggccctagggaggctgaacgcccggtggctcccgggatggctcttcccgttctttgcgccgccttcacccagtgagggagcctgtgccctccctgcccagtcgcttttggggccgctgcggagcttccgctgccatcttcggatcctgtgttccgcacgggggctccaccagggcagggatcgtggtgagggtggctcgtgggtccccctcgcggggagcagggtctggcactcaccagggcgcaggactaggacttgtcgaatgaatccatccttttagcttttagtcctttgaagagccttgagaatggaaatcatgagagatttttccatggggaagttccttttacaaagcatttatttacgttgacttcttggcaccccgcggggcggcaacgggcagggcctccagtgcaccttctgcgccgtggagccgcgggggctcagctgggcggtggtcgggtcctgaggccggagggcgggagcaggggaggggaaaagcaaaagcggggaaagaagccggggagcggtggaccagacgtccagacctcctgaaaggctggcggggaggcacaggcgggatcttccggaggtgagaatttttttttattatagcagaatggggaggaattgaggggaaaatggagatagaacctgaaagagccccaaacgccagaacctgtagctccccaagaataagatcttccagaagaactagacccaaaactagccgttggggaacaccgaaatccttggaggagcaacatccgcatgaccctttgtgttcctttaggcaaaaggacttgcttccattgtttgttcaattgtttgtgtttcttaaataaataaaacgattttcatgtatctttga

SEQ ID NO: 27964 - DNA, 2945 bp, Homo sapiens
cgcggccacgccccgagccctcgaatgcgagccaatcgttgctcggcgcctgaaggggcagtacccaagcgagccatttaacatggcggaggatgtttcctcagcggccccgagcccgcggggctgtgcggatggtagggatgccgaccctactgaggagcagatggcagaaacagagagaaacgacgaggagcagttcgaatgccaggaactgctcgagtgccaggtgcaggtgggggcccccgaggaggaggaggaggaggaggaggacgcgggcctggtggccgaggccgaggccgtggctgccggctggatgctcgatttcctctgcctctctctttgccgagctttccgcgacggccgctccgaggacttccgcaggacccgcaacagcgcagaggctattattcatggactatccagtctaacagcttgccagttgagaacgatatacatatgtcagtttttgacaagaattgcagcaggaaaaacccttgatgcacagtttgaaaatgatgaacgaattacacccttggaatcagccctgatgatttggggttcaattgaaaaggaacatgacaaacttcatgaagaaatacagaatttaattaaaattcaggctatagctgtttgtatggaaaatggcaactttaaagaagcagaagaagtctttgaaagaatatttggtgatccaaattctcatatgcctttcaaaagcaaattgcttatgataatctctcagaaagatacatttcattccttttttcaacacttcagctacaaccacatgatggagaaaattaagagttatgtgaattatgtgctaagtgaaaaatcatcaacctttctaatgaaggcagcggcaaaagtagtagaaagcaaaaggacaagaacaataacttctcaagataaacctagtggtaatgatgttgaaatggaaactgaagctaatttggatacaagaaaaaggtctcacaagaatcttttcttatctaagttgcaacatggaacccagcaacaagaccttaataagaaagaaagaagagtaggaactcctcaaagtacaaaaaagaaaaaagaaagcagaagagccactgaaagcagaatacctgtttcaaagagtcagccggtaactcctgaaaaacatcgagctagaaaaagacaggcatggctttgggaagaagacaagaatttgagatctggcgtgaggaaatatggagagggaaactggtctaaaatactgttgcattataaattcaacaaccggacaagtgtcatgttaaaagacagatggaggaccatgaagaaactaaaactgatttcctcagacagcgaagactgattgtgtttgtaaaagcttgatgaaaggacagttaagtattttgatcactgcattttgtttgaaacttgtgtcattgatgtaatttaaaacttttgtttaaagcattacagtatttttctgtgaccatcaattaatgagggtttgtgctaccagagttaaagcatatgctatcattgtattctttaagaaccttattttgataaaatgtaaatttgttgaaccctgccacatttagtatccccacccccaaatcctgttccaatgaaaaaattaaaacctgatacgaaaaaaaaaaaattccagttaacctattttgtgtctgtaggctgacctcaaccctgtaacgtaacccattaaaatgaatttctttttttttaagacagagtttctctctgttgcccaggctggagtgcagtggcgcaatttcagctcactgcaacctctgcctcccaggttcaagtgattctcctgcctcagcctcctgagtagctgggattacaggcacacaccaccacgcccagctaatttttgtatttttagtagaggcggggtttcaccatgctggtcaggatgttctccaactcctgacttcatgatccacccacctcggcctcccaaagtgctgagattacagacgtgagccactgcgtcctgcctaaaatgaattttctagatgattgaataacagtagtcctttgatagaagataatgacttggtttatggccttaatatactacttaattacttaagatgtttattaatagaatgataaatgtacagagtaacctataagcatgacatacttttgctttcagtagtttcatgtaaagaaaaaaacttgaaaatagtaatacctgagtacccatgggaataatagacactggggaggtagggtggggagcgggagcaagagctgaaaaacttacctactggggactgtgctcactacctgggtgacaggatcatacgtaccccaaacctcaacatcacacagtatactcagctaacaaacctgcccatgtgtttcctgaatctaaaataaaaatcgaaataatttttttaaaaaagaaaaagacaatagtattacccatgggacaaaatttgtactattagcaagaatcattttgtgtctcatttagaaacaatttgacttttgttccagtgtttaaactttgacaaaaatggttttgaatagatctttataacctgatgccataaatacaagattctctgataccttcatttaatatatcaatattgggcctaaaacagtattctgtaaagcttaaattggtattaactatgatcatcttgatgtctatgatagataataaacaaggtcatacataccttactaaacaattttggtttttcaccaacattttattctttaaaagatttagactaacagaattatttagcatttcgagtcatgtgctttatttagcaagtgagtaaaaatattggaatattgaagtatttgcataaaaaatcaaatggtggtgttttgtaatctctattgtatttcctattaaggtttcatatattactttcccattgttcctgaatttgttatcctatatataaacagaaacatggatg

SEQ ID NO: 27965 - DNA, 3005 bp, Homo sapiens
cgcggccacgccccgagccctcgaatgcgagccaatcgttgctcggcgcctgaaggggcagtacccaagcgagccatttaacatggcggaggatgtttcctcagcggccccgagcccgcggggctgtgcggatggtagggatgccgaccctactgaggagcagatggcagaaacagagagaaacgacgaggagcagttcgaatgccaggaactgctcgagtgccaggtgcaggtgggggcccccgaggaggaggaggaggaggaggaggacgcgggcctggtggccgaggccgaggccgtggctgccggctggatgctcgatttcctctgcctctctctttgccgagctttccgcgacggccgctccgaggacttccgcaggacccgcaacagcgcagaggctattattcatggactatccagtctaacagcttgccagttgagaacgatatacatatgtcagtttttgacaagaattgcagcaggaaaaacccttgatgcacagtttgaaaatgatgaacgaattacacccttggaatcagccctgatgatttggggttcaattgaaaaggaacatgacaaacttcatgaagaaatacagaatttaattaaaattcaggctatagctgtttgtatggaaaatggcaactttaaagaagcagaagaagtctttgaaagaatatttggtgatccaaattctcatatgcctttcaaaagcaaattgcttatgataatctctcagaaagatacatttcattccttttttcaacacttcagctacaaccacatgatggagaaaattaagagttatgtgaattatgtgctaagtgaaaaatcatcaacctttctaatgaaggcagcggcaaaagtagtagaaagcaaaaggacaagaacaataacttctcaagataaacctagtggtaatgatgttgaaatggaaactgaagctaatttggatacaagaaaaagtgttagtgacaaacagtctgcggtaactgaatcctcagagggtacagtatccttattgaggtctcacaagaatcttttcttatctaagttgcaacatggaacccagcaacaagaccttaataagaaagaaagaagagtaggaactcctcaaagtacaaaaaagaaaaaagaaagcagaagagccactgaaagcagaatacctgtttcaaagagtcagccggtaactcctgaaaaacatcgagctagaaaaagacaggcatggctttgggaagaagacaagaatttgagatctggcgtgaggaaatatggagagggaaactggtctaaaatactgttgcattataaattcaacaaccggacaagtgtcatgttaaaagacagatggaggaccatgaagaaactaaaactgatttcctcagacagcgaagactgattgtgtttgtaaaagcttgatgaaaggacagttaagtattttgatcactgcattttgtttgaaacttgtgtcattgatgtaatttaaaacttttgtttaaagcattacagtatttttctgtgaccatcaattaatgagggtttgtgctaccagagttaaagcatatgctatcattgtattctttaagaaccttattttgataaaatgtaaatttgttgaaccctgccacatttagtatccccacccccaaatcctgttccaatgaaaaaattaaaacctgatacgaaaaaaaaaaaattccagttaacctattttgtgtctgtaggctgacctcaaccctgtaacgtaacccattaaaatgaatttctttttttttaagacagagtttctctctgttgcccaggctggagtgcagtggcgcaatttcagctcactgcaacctctgcctcccaggttcaagtgattctcctgcctcagcctcctgagtagctgggattacaggcacacaccaccacgcccagctaatttttgtatttttagtagaggcggggtttcaccatgctggtcaggatgttctccaactcctgacttcatgatccacccacctcggcctcccaaagtgctgagattacagacgtgagccactgcgtcctgcctaaaatgaattttctagatgattgaataacagtagtcctttgatagaagataatgacttggtttatggccttaatatactacttaattacttaagatgtttattaatagaatgataaatgtacagagtaacctataagcatgacatacttttgctttcagtagtttcatgtaaagaaaaaaacttgaaaatagtaatacctgagtacccatgggaataatagacactggggaggtagggtggggagcgggagcaagagctgaaaaacttacctactggggactgtgctcactacctgggtgacaggatcatacgtaccccaaacctcaacatcacacagtatactcagctaacaaacctgcccatgtgtttcctgaatctaaaataaaaatcgaaataatttttttaaaaaagaaaaagacaatagtattacccatgggacaaaatttgtactattagcaagaatcattttgtgtctcatttagaaacaatttgacttttgttccagtgtttaaactttgacaaaaatggttttgaatagatctttataacctgatgccataaatacaagattctctgataccttcatttaatatatcaatattgggcctaaaacagtattctgtaaagcttaaattggtattaactatgatcatcttgatgtctatgatagataataaacaaggtcatacataccttactaaacaattttggtttttcaccaacattttattctttaaaagatttagactaacagaattatttagcatttcgagtcatgtgctttatttagcaagtgagtaaaaatattggaatattgaagtatttgcataaaaaatcaaatggtggtgttttgtaatctctattgtatttcctattaaggtttcatatattactttcccattgttcctgaatttgttatcctatatataaacagaaacatggatg

SEQ ID NO: 27966 - DNA, 3021 bp, Homo sapiens
cgcggccacgccccgagccctcgaatgcgagccaatcgttgctcggcgcctgaaggggcagtacccaagcgagccatttaacatggcggaggatgtttcctcagcggccccgagcccgcggggctgtgcggatggtagggatgccgaccctactgaggagcagatggcagaaacagagagaaacgacgaggagcagttcgaatgccaggaactgctcgagtgccaggtgcaggtgggggcccccgaggaggaggaggaggaggaggaggacgcgggcctggtggccgaggccgaggccgtggctgccggctggatgctcgatttcctctgcctctctctttgccgagctttccgcgacggccgctccgaggacttccgcaggacccgcaacagcgcagaggattaaaaccttcatgggggcagagactggctatctgaagtcatcacctcctaacacaggctggcagtagatgttcactattattcatggactatccagtctaacagcttgccagttgagaacgatatacatatgtcagtttttgacaagaattgcagcaggaaaaacccttgatgcacagtttgaaaatgatgaacgaattacacccttggaatcagccctgatgatttggggttcaattgaaaaggaacatgacaaacttcatgaagaaatacagaatttaattaaaattcaggctatagctgtttgtatggaaaatggcaactttaaagaagcagaagaagtctttgaaagaatatttggtgatccaaattctcatatgcctttcaaaagcaaattgcttatgataatctctcagaaagatacatttcattccttttttcaacacttcagctacaaccacatgatggagaaaattaagagttatgtgaattatgtgctaagtgaaaaatcatcaacctttctaatgaaggcagcggcaaaagtagtagaaagcaaaaggacaagaacaataacttctcaagataaacctagtggtaatgatgttgaaatggaaactgaagctaatttggatacaagaaaaaggtctcacaagaatcttttcttatctaagttgcaacatggaacccagcaacaagaccttaataagaaagaaagaagagtaggaactcctcaaagtacaaaaaagaaaaaagaaagcagaagagccactgaaagcagaatacctgtttcaaagagtcagccggtaactcctgaaaaacatcgagctagaaaaagacaggcatggctttgggaagaagacaagaatttgagatctggcgtgaggaaatatggagagggaaactggtctaaaatactgttgcattataaattcaacaaccggacaagtgtcatgttaaaagacagatggaggaccatgaagaaactaaaactgatttcctcagacagcgaagactgattgtgtttgtaaaagcttgatgaaaggacagttaagtattttgatcactgcattttgtttgaaacttgtgtcattgatgtaatttaaaacttttgtttaaagcattacagtatttttctgtgaccatcaattaatgagggtttgtgctaccagagttaaagcatatgctatcattgtattctttaagaaccttattttgataaaatgtaaatttgttgaaccctgccacatttagtatccccacccccaaatcctgttccaatgaaaaaattaaaacctgatacgaaaaaaaaaaaattccagttaacctattttgtgtctgtaggctgacctcaaccctgtaacgtaacccattaaaatgaatttctttttttttaagacagagtttctctctgttgcccaggctggagtgcagtggcgcaatttcagctcactgcaacctctgcctcccaggttcaagtgattctcctgcctcagcctcctgagtagctgggattacaggcacacaccaccacgcccagctaatttttgtatttttagtagaggcggggtttcaccatgctggtcaggatgttctccaactcctgacttcatgatccacccacctcggcctcccaaagtgctgagattacagacgtgagccactgcgtcctgcctaaaatgaattttctagatgattgaataacagtagtcctttgatagaagataatgacttggtttatggccttaatatactacttaattacttaagatgtttattaatagaatgataaatgtacagagtaacctataagcatgacatacttttgctttcagtagtttcatgtaaagaaaaaaacttgaaaatagtaatacctgagtacccatgggaataatagacactggggaggtagggtggggagcgggagcaagagctgaaaaacttacctactggggactgtgctcactacctgggtgacaggatcatacgtaccccaaacctcaacatcacacagtatactcagctaacaaacctgcccatgtgtttcctgaatctaaaataaaaatcgaaataatttttttaaaaaagaaaaagacaatagtattacccatgggacaaaatttgtactattagcaagaatcattttgtgtctcatttagaaacaatttgacttttgttccagtgtttaaactttgacaaaaatggttttgaatagatctttataacctgatgccataaatacaagattctctgataccttcatttaatatatcaatattgggcctaaaacagtattctgtaaagcttaaattggtattaactatgatcatcttgatgtctatgatagataataaacaaggtcatacataccttactaaacaattttggtttttcaccaacattttattctttaaaagatttagactaacagaattatttagcatttcgagtcatgtgctttatttagcaagtgagtaaaaatattggaatattgaagtatttgcataaaaaatcaaatggtggtgttttgtaatctctattgtatttcctattaaggtttcatatattactttcccattgttcctgaatttgttatcctatatataaacagaaacatggatg

SEQ ID NO: 27967 - DNA, 2791 bp, Homo sapiens
tgagaaggctaccaaggagagaaacattgtccccaggggaaagctagattttagacaaggcaaagagcggagaggaatgggtgaagagattgagaatgacattctagaaaggacaatagaaagtcttaggaaggagggacagaggggaagagagaaaggatggctggtcacctagagtatctatagggataaaagtatagctaaaataacctacattttaggtggagataatacagctgcctaagcttaggtgaactgctttttgaatcttagtttgctccttcataaaattggattaatataataccaatttggcagagttttcaaaaaaaatgatgccacatcctgtgtttccaaacagccttacctttcaaaactctttttggaagctgtaaagataatcaagtgatacctgccattatgtaaaggaattttggaatccgtctttggggaaataaaagccataagagagaatgaaagctaatactttgtagtttaaggatttttttccttgatgtatctaattggaaggccgaaagagtcttgtcttttcttttttttgcctgcttcttctgagacatcaaaaaacatcttgatttctgcggagtagatgagatggagaaagatgagacaggcaacagaaatcttaagaggccacaggttaagatggggtactaagcagggagagcaccaaaggaagtaggccaaagtattaatagaagatcctagaacagattaaggcaaatcatttacctgttttccattgccttactatctttctggagccaattacaaactttcctgttttattttaggtctcacaagaatcttttcttatctaagttgcaacatggaacccagcaacaagaccttaataagaaagaaagaagagtaggaactcctcaaagtacaaaaaagaaaaaagaaagcagaagagccactgaaagcagaatacctgtttcaaagagtcagccggtaactcctgaaaaacatcgagctagaaaaagacaggcatggctttgggaagaagacaagaatttgagatctggcgtgaggaaatatggagagggaaactggtctaaaatactgttgcattataaattcaacaaccggacaagtgtcatgttaaaagacagatggaggaccatgaagaaactaaaactgatttcctcagacagcgaagactgattgtgtttgtaaaagcttgatgaaaggacagttaagtattttgatcactgcattttgtttgaaacttgtgtcattgatgtaatttaaaacttttgtttaaagcattacagtatttttctgtgaccatcaattaatgagggtttgtgctaccagagttaaagcatatgctatcattgtattctttaagaaccttattttgataaaatgtaaatttgttgaaccctgccacatttagtatccccacccccaaatcctgttccaatgaaaaaattaaaacctgatacgaaaaaaaaaaaattccagttaacctattttgtgtctgtaggctgacctcaaccctgtaacgtaacccattaaaatgaatttctttttttttaagacagagtttctctctgttgcccaggctggagtgcagtggcgcaatttcagctcactgcaacctctgcctcccaggttcaagtgattctcctgcctcagcctcctgagtagctgggattacaggcacacaccaccacgcccagctaatttttgtatttttagtagaggcggggtttcaccatgctggtcaggatgttctccaactcctgacttcatgatccacccacctcggcctcccaaagtgctgagattacagacgtgagccactgcgtcctgcctaaaatgaattttctagatgattgaataacagtagtcctttgatagaagataatgacttggtttatggccttaatatactacttaattacttaagatgtttattaatagaatgataaatgtacagagtaacctataagcatgacatacttttgctttcagtagtttcatgtaaagaaaaaaacttgaaaatagtaatacctgagtacccatgggaataatagacactggggaggtagggtggggagcgggagcaagagctgaaaaacttacctactggggactgtgctcactacctgggtgacaggatcatacgtaccccaaacctcaacatcacacagtatactcagctaacaaacctgcccatgtgtttcctgaatctaaaataaaaatcgaaataatttttttaaaaaagaaaaagacaatagtattacccatgggacaaaatttgtactattagcaagaatcattttgtgtctcatttagaaacaatttgacttttgttccagtgtttaaactttgacaaaaatggttttgaatagatctttataacctgatgccataaatacaagattctctgataccttcatttaatatatcaatattgggcctaaaacagtattctgtaaagcttaaattggtattaactatgatcatcttgatgtctatgatagataataaacaaggtcatacataccttactaaacaattttggtttttcaccaacattttattctttaaaagatttagactaacagaattatttagcatttcgagtcatgtgctttatttagcaagtgagtaaaaatattggaatattgaagtatttgcataaaaaatcaaatggtggtgttttgtaatctctattgtatttcctattaaggtttcatatattactttcccattgttcctgaatttgttatcctatatataaacagaaacatggatg

SEQ ID NO: 27968 - DNA, 1851 bp, Homo sapiens
  misc_feature (29)..(29): n is a, c, g, or t
  misc_feature (85)..(85): n is a, c, g, or t
aaaaaaaaaaaaaaggggaaaaccccaanggggggccccaaattgggggcccccttttttggggggggaaaaaaaggaaaaaggncccaaaaggaaatttgagatctggcgtgaggaaatatggagagggaaactggtctaaaatactgttgcattataaattcaacaaccggacaagtgtcatgttaaaagacagatggaggaccatgaagaaactaaaactgatttcctcagacagcgaagactgattgtgtttgtaaaagcttgatgaaaggacagttaagtattttgatcactgcattttgtttgaaacttgtgtcattgatgtaatttaaaacttttgtttaaagcattacagtatttttctgtgaccatcaattaatgagggtttgtgctaccagagttaaagcatatgctatcattgtattctttaagaaccttattttgataaaatgtaaatttgttgaaccctgccacatttagtatccccacccccaaatcctgttccaatgaaaaaattaaaacctgatacgaaaaaaaaaaaattccagttaacctattttgtgtctgtaggctgacctcaaccctgtaacgtaacccattaaaatgaatttctttttttttaagacagagtttctctctgttgcccaggctggagtgcagtggcgcaatttcagctcactgcaacctctgcctcccaggttcaagtgattctcctgcctcagcctcctgagtagctgggattacaggcacacaccaccacgcccagctaatttttgtatttttagtagaggcggggtttcaccatgctggtcaggatgttctccaactcctgacttcatgatccacccacctcggcctcccaaagtgctgagattacagacgtgagccactgcgtcctgcctaaaatgaattttctagatgattgaataacagtagtcctttgatagaagataatgacttggtttatggccttaatatactacttaattacttaagatgtttattaatagaatgataaatgtacagagtaacctataagcatgacatacttttgctttcagtagtttcatgtaaagaaaaaaacttgaaaatagtaatacctgagtacccatgggaataatagacactggggaggtagggtggggagcgggagcaagagctgaaaaacttacctactggggactgtgctcactacctgggtgacaggatcatacgtaccccaaacctcaacatcacacagtatactcagctaacaaacctgcccatgtgtttcctgaatctaaaataaaaatcgaaataatttttttaaaaaagaaaaagacaatagtattacccatgggacaaaatttgtactattagcaagaatcattttgtgtctcatttagaaacaatttgacttttgttccagtgtttaaactttgacaaaaatggttttgaatagatctttataacctgatgccataaatacaagattctctgataccttcatttaatatatcaatattgggcctaaaacagtattctgtaaagcttaaattggtattaactatgatcatcttgatgtctatgatagataataaacaaggtcatacataccttactaaacaattttggtttttcaccaacattttattctttaaaagatttagactaacagaattatttagcatttcgagtcatgtgctttatttagcaagtgagtaaaaatattggaatattgaagtatttgcataaaaaatcaaatggtggtgttttgtaatctctattgtatttcctattaaggtttcatatattactttcccattgttcctgaatttgttatcctatatataaacagaaacatggatg

SEQ ID NO: 27969 - DNA, 809 bp, Homo sapiens
gcggcgcctactactactaaattcgcggccggtcgacaaaaaaacttgaaaatagtaatacctgagtacccatgggaataatagacactggggaggtagggtggggagcgggagcaagagctgaaaaacttacctactggggactgtgctcactacctgggtgacaggatcatacgtaccccaaacctcaacatcacacagtatactcagctaacaaacctgcccatgtgtttcctgaatctaaaataaaaatcgaaataatttttttaaaaaagaaaaagacaatagtattacccatgggacaaaatttgtactattagcaagaatcattttgtgtctcatttagaaacaatttgacttttgttccagtgtttaaactttgacaaaaatggttttgaatagatctttataacctgatgccataaatacaagattctctgataccttcatttaatatatcaatattgggcctaaaacagtattctgtaaagcttaaattggtattaactatgatcatcttgatgtctatgatagataataaacaaggtcatacataccttactaaacaattttggtttttcaccaacattttattctttaaaagatttagactaacagaattatttagcatttcgagtcatgtgctttatttagcaagtgagtaaaaatattggaatattgaagtatttgcataaaaaatcaaatggtggtgttttgtaatctctattgtatttcctattaaggtttcatatattactttcccattgttcctgaatttgttatcctatatataaacagaaacatggatg

SEQ ID NO: 27970 - DNA, 3327 bp, Homo sapiens
cgcggccacgccccgagccctcgaatgcgagccaatcgttgctcggcgcctgaaggggcagtacccaagcgagccatttaacatggcggaggatgtttcctcagcggccccgagcccgcggggctgtgcggatggtagggatgccgaccctactgaggagcagatggcagaaacagagagaaacgacgaggagcagttcgaatgccaggaactgctcgagtgccaggtgcaggtgggggcccccgaggaggaggaggaggaggaggaggacgcgggcctggtggccgaggccgaggccgtggctgccggctggatgctcgatttcctctgcctctctctttgccgagctttccgcgacggccgctccgaggacttccgcaggacccgcaacagcgcagaggctattattcatggactatccagtctaacagcttgccagttgagaacgatatacatatgtcagtttttgacaagaattgcagcaggaaaaacccttgatgcacagtttgaaaatgatgaacgaattacacccttggaatcagccctgatgatttggggttcaattgaaaaggaacatgacaaacttcatgaagaaatacagaatttaattaaaattcaggctatagctgtttgtatggaaaatggcaactttaaagaagcagaagaagtctttgaaagaatatttggtgatccaaattctcatatgcctttcaaaagcaaattgcttatgataatctctcagaaagatacatttcattccttttttcaacacttcagctacaaccacatgatggagaaaattaagagttatgtgaattatgtgctaagtgaaaaatcatcaacctttctaatgaaggcagcggcaaaagtagtagaaagcaaaaggacaagaacaataacttctcaagataaacctagtggtaatgatgttgaaatggaaactgaagctaatttggatacaagaaaaaggtctcacaagaatcttttcttatctaagttgcaacatggaacccagcaacaagaccttaataagaaagaaagaagagtaggaactcctcaaagtacaaaaaagaaaaaagaaagcagaagagccactgaaagcagaatacctgtttcaaagagtcagccggtaactcctgaaaaacatcgagctagaaaaagacaggcatggctttgggaagaagacaagaatttgagatctggcgtgaggaaatatggagagggaaactggtctaaaatactgttgcattataaattcaacaaccggacaagtgtcatgttaaaagacagatggaggaccatgaagaaactaaaactgatttcctcagacagcgaagactgattgtgtttgtaaaagcttgatgaaaggacagttaagtattttgatcactgcattttgtttgaaacttgtgtcattgatgtaatttaaaacttttgtttaaagcattacagtatttttctgtgaccatcaattaatgagggtttgtgctaccagagttaaagcatatgctatcattgtattctttaagaaccttattttgataaaatgtaaatttgttgaaccctgccacatttagtatccccacccccaaatcctgttccaatgaaaaaattaaaacctgatacgaaaaaaaaaaaattccagttaacctattttgtgtctgtaggctgacctcaaccctgtaacgtaacccattaaaatgaatttctttttttttaagacagagtttctctctgttgcccaggctggagtgcagtggcgcaatttcagctcactgcaacctctgcctcccaggttcaagtgattctcctgcctcagcctcctgagtagctgggattacaggcacacaccaccacgcccagctaatttttgtatttttagtagaggcggggtttcaccatgctggtcaggatgttctccaactcctgacttcatgatccacccacctcggcctcccaaagtgctgagattacagacgtgagccactgcgtcctgcctaaaatgaattttctagatgattgaataacagtagtcctttgatagaagataatgacttggtttatggccttaatatactacttaattacttaagatgtttattaatagaatgataaatgtacagagtaacctataagcatgacatacttttgctttcagtagtttcatgtaaagaaaaaaacttgaaaatagtaatacctgagtacccatgggaataatagacactggggaggtagggtggggagcgggagcaagagctgaaaaacttacctactggggactgtgctcactacctgggtgacaggatcatacgtaccccaaacctcaacatcacacagtatactcagctaacaaacctgcccatgtgtttcctgaatctaaaataaaaatcgaaataatttttttaaaaaagaaaaagacaatagtattacccatgggacaaaatttgtactattagcaagaatcattttgtgtctcatttagaaacaatttgacttttgttccagtgtttaaactttgacaaaaatggttttgaatagatctttataacctgatgccataaatacaagattctctgataccttcatttaatatatcaatattgggcctaaaacagtattctgtaaagcttaaattggtattaactatgatcatcttgatgtctatgatagataataaacaaggtcatacataccttactaaacaattttggtttttcaccaacattttattctttaaaagatttagactaacagaattatttagcatttcgagtcatgtgctttatttagcaagtgagtaaaaatattggaatattgaagtatttgcataaaaaatcaaatggtggtgttttgtaatctctattgtatttcctattaaggtttcatatattactttcccattgttcctgaatttgttatcctatatataaacagaaacatggatgagtaccatatacttcctgactcctttatcttgttacaccacaagatactgcactatttattggagatattttgatgattagtgccaaggctggcatcatgagccaaaatagacttgttaagtcaacctcattccaaacacctgctatagatcatcaaatctaagttgccattaattgtaagatgtcctgttatttcacacacacaactagaaaagaaaaatcggtatcaattatagtatggtgctttcttattttgaattttacttattagaagagctattttagatgtatttaaacataagatttttatcacataacttgtggatacaaaaaaagagaaattgtaagcaaaataagttgggtaatatattcctaaaacctc

SEQ ID NO: 27971 - DNA, 2422 bp, Homo sapiens
atggaacccagcaacaagaccttaataaaaattcaggctatagctgtttgtatggaaaatggcaactttaaagaagcagaagaagtctttgaaagaatatttggtgatccaaattctcatatgcctttcaaaagcaaattgcttatgataatctctcagaaagatacatttcattccttttttcaacacttcagctacaaccacatgatggagaaaattaagagttatgtgaattatgtgctaagtgaaaaatcatcaacctttctaatgaaggcagcggcaaaagtagtagaaagcaaaaggacaagaacaataacttctcaagataaacctagtggtaatgatgttgaaatggaaactgaagctaatttggatacaagaaaaagtgttagtgacaaacagtctgcggtaactgaatcctcagagggtacagtatccttattgaggtctcacaagaatcttttcttatctaagttgcaacatggaacccagcaacaagaccttaataagaaagaaagaagagtaggaactcctcaaagtacaaaaaagaaaaaagaaagcagaagagccactgaaagcagaatacctgtttcaaagagtcagccggtaactcctgaaaaacatcgagctagaaaaagacaggcatggctttgggaagaagacaagaatttgagatctggcgtgaggaaatatggagagggaaactggtctaaaatactgttgcattataaattcaacaaccggacaagtgtcatgttaaaagacagatggaggaccatgaagaaactaaaactgatttcctcagacagcgaagactgattgtgtttgtaaaagcttgatgaaaggacagttaagtattttgatcactgcattttgtttgaaacttgtgtcattgatgtaatttaaaacttttgtttaaagcattacagtatttttctgtgaccatcaattaatgagggtttgtgctaccagagttaaagcatatgctatcattgtattctttaagaaccttattttgataaaatgtaaatttgttgaaccctgccacatttagtatccccacccccaaatcctgttccaatgaaaaaattaaaacctgatacgaaaaaaaaaaaattccagttaacctattttgtgtctgtaggctgacctcaaccctgtaacgtaacccattaaaatgaatttctttttttttaagacagagtttctctctgttgcccaggctggagtgcagtggcgcaatttcagctcactgcaacctctgcctcccaggttcaagtgattctcctgcctcagcctcctgagtagctgggattacaggcacacaccaccacgcccagctaatttttgtatttttagtagaggcggggtttcaccatgctggtcaggatgttctccaactcctgacttcatgatccacccacctcggcctcccaaagtgctgagattacagacgtgagccactgcgtcctgcctaaaatgaattttctagatgattgaataacagtagtcctttgatagaagataatgacttggtttatggccttaatatactacttaattacttaagatgtttattaatagaatgataaatgtacagagtaacctataagcatgacatacttttgctttcagtagtttcatgtaaagaaaaaaacttgaaaatagtaatacctgagtacccatgggaataatagacactggggaggtagggtggggagcgggagcaagagctgaaaaacttacctactggggactgtgctcactacctgggtgacaggatcatacgtaccccaaacctcaacatcacacagtatactcagctaacaaacctgcccatgtgtttcctgaatctaaaataaaaatcgaaataatttttttaaaaaagaaaaagacaatagtattacccatgggacaaaatttgtactattagcaagaatcattttgtgtctcatttagaaacaatttgacttttgttccagtgtttaaactttgacaaaaatggttttgaatagatctttataacctgatgccataaatacaagattctctgataccttcatttaatatatcaatattgggcctaaaacagtattctgtaaagcttaaattggtattaactatgatcatcttgatgtctatgatagataataaacaaggtcatacataccttactaaacaattttggtttttcaccaacattttattctttaaaagatttagactaacagaattatttagcatttcgagtcatgtgctttatttagcaagtgagtaaaaatattggaatattgaagtatttgcataaaaaatcaaatggtggtgttttgtaatctctattgtatttcctattaaggtttcatatattactttcccattgttcctgaatttgttatcctatatataaacagaaacatggatg

SEQ ID NO: 27972 - DNA, 1155 bp, Homo sapiens
cgcggccacgccccgagccctcgaatgcgagccaatcgttgctcggcgcctgaaggggcagtacccaagcgagccatttaacatggcggaggatgtttcctcagcggccccgagcccgcggggctgtgcggatggtagggatgccgaccctactgaggagcagatggcagaaacagagagaaacgacgaggagcagttcgaatgccaggaactgctcgagtgccaggtgcaggtgggggcccccgaggaggaggaggaggaggaggaggacgcgggcctggtggccgaggccgaggccgtggctgccggctggatgctcgatttcctctgcctctctctttgccgagctttccgcgacggccgctccgaggacttccgcaggacccgcaacagcgcagaggctattattcatggactatccagtctaacagcttgccagttgagaacgatatacatatgtcagtttttgacaagaattgcagcaggaaaaacccttgatgcacagtttgaaaatgatgaacgaattacacccttggaatcagccctgatgatttggggttcaattgaaaaggaacatgacaaacttcatgaagaaatacagaatttaattaaaattcaggctatagctgtttgtatggaaaatggcaactttaaagaagcagaagaagtctttgaaagaatatttggtgatccaaattctcatatgcctttcaaaagcaaattgcttatgataatctctcagaaagatacatttcattccttttttcaacacttcagctacaaccacatgatggagaaaattaagagttatgtgaattatgtgctaagtgaaaaatcatcaacctttctaatgaaggcagcggcaaaagtagtagaaagcaaaaggacaagaacaataacttctcaagataaacctagtggtaatgatgttgaaatggaaactgaagctaatttggatacaagaaaaaggtctcacaagaatcttttcttatctaagttgcaacatggaacccagcaacaagaccttaataagaaagaaagaagagtaggaactcctcaaattacatatatttgtcttaccaaactgactatgaataagaaagaaggagtgaggaaaggattatgcttcttagtactcctaaaacattatcgtaa

SEQ ID NO: 27973 - DNA, 538 bp, Homo sapiens
atttccttgaggcaactttctagataattttcttcatacacctttggatggcctgaattcgatgttgttcaatatgaaatcatacattgaggggtcataaagccaattacataaacgtagaaggggaatgacctgccttgtcaccacagtgacaatctcaagtgacccgcagtgtgatgggaccactaatgaaactgacaccacttaaatgatattaggaagagggagatgtcaggtgtcctactttttattggtgagatcacgcttgtctccaggcatgactgtcataatgtgggagagggttggtaaacagaggaatatttaggacgagggcacaccagcatactgatgagtctcaagctatctgaggaatttttggagcagtccctgtcaatactgggtgagtgaaacctctttagaggtgggctgcgactgtgaactccctttgtgtcagctacaacgttcttgctttcgtgtatcaatttgtttgttttttaagtacaaattttgttgcattgttgcattaaaaatggatgta

SEQ ID NO: 27974 - DNA, 383 bp, Homo sapiens
acccttcctccatcattttgccaccatgcacagaagcacggaccccaccgctgcctcagtgccagtgcatactgcacacaggacctactgcctccctaccagcagtgcactaaaacacttttgacagaatgttgttgccagagaactgggaataccttggccccttcaagacaacaggtgcttaacattcatggccagagaaaaaagcttttctctagcctcaatgggacagagaaaaaatgtgggccttgtctcagcctcccagagatagaatatgcagtccgagcaggctgagctgaattttggccctctgaaataattacccagaaatgaagcaaattacaaaacccaacttgtactacagttaaacactaaagggcacc

SEQ ID NO: 27975 - DNA, 1175 bp, Homo sapiens
agtttttcattttacacttaggtctgtggtccattttaagaacatttttatgaagggtgtaaggtctgtgtctagctcccattcaaggcttattatatctcacctggagtgtcagcctgcctgcatttcttgtcccctccaattccaacttgaattgactaaattcctggtgagtgtagccaagagtcatgcctccaggcttcaggccagcacttgtggatggaacctccaggccagtacacccaggacccagctccaggataaccttggcagtctcaggcaccaggccagcacccacagccctaggacccagccatgaccttaagtacccagcttctaggcctgccccactgccaggccaggccccatagccccagactccaggcagatacccatggacctagtttccaggccctcctctgcaccagaccaacaccactataccctagctccaggctagcctttactaacctaggaaccagtccaccacagtgccaggctagccaccacatctccagactccaagccagcatctgcagacccaggctccaggcctgctctagcaccaggctggcccctgaagccccaggcttcaggctcactgtagtgctagggtggcaccaacaggcaccagcaccaagcctgctcctgcagcctcagggtccaggctggcccctggagactcaagcttcaggcccaacccagactccagattggcccagtaccagactgagattggcccagtaccacatgggcccaggcttcaggcgccccccgccccataccattgcctggtctgcctcttcagccccagactccaggccaacacttgtggacctagcctccagtctcactccagcaccaggttggcatgcatagacccaagcttgaggcccacccctgacagtcccagcagaatcaggatcccaggcctgccccaggaatctcagtaaccataacggtatgaatctagaaatcaataacaagaaaaattggagaattcacaaatatgtagaaattaaacaacatgctcctgaacaaagagtcaagaagaaatgaaaaggaattgaaaaatatcttgggacaacagaaagcggaaacaacatgccaaatgtatgggatgcagcaaaagcagttctaagaggggactttatagcaataaatgcctacatcaa

SEQ ID NO: 27976 - DNA, 478 bp, Homo sapiens
aaatagtattgaaaaattgaaaaataggcatattaaaacttgtaacactatttaagcttagatatattatttgtacctcatcaacattttttattttgttgagaaagtgtaaggttaattggcagcatatttctaatagtagatagaataatgtctgttttataaacattgacatcctacattacatgtgtgaaccctgaaaatctgagacagctctcagattttttagaaagtttattttgccaatcttgaggatgtgcgcccgtgacgcctccccaggaggtcctgacaacatgggcccaaggtggtcggggcacagcttggttttatacactttagggagacatgagacatcaatcaatacgtgtaagatgtacattggttcagtccagaaaggtgagaaggccagacagggggcttccaggtcataggtaggtaagagacaaatggtttcattcttttgcattgctgattaccc

SEQ ID NO: 27977 - DNA, 442 bp, Homo sapiens
tctgctggcactgtcactgttgccaccactgccgctgtggaatttcctggggaccagggcaccagagagacagggagaaaggaaaaaacccagggatctggcccactgtctcagaacccaggtgacccctttcctgttactagatgcttctcctggacccccgggcacactcttgctcgcctctggatatcgagttgtatttagtccaggctggggataccagggtcagggacatggcaaactcaccgcaaccttggtggcacttcaaattgtggtcttcaacccccttctacctgctactggtcaattctcagaggcctcagtagctcctttgtgtgcctgtctagccttttagccacattcagtgggcagggaagggtggcgggggtggtgcttaccctgtggagtaaccataaggaaaccagaaccataggaattcgaa

SEQ ID NO: 27978 - DNA, 295 bp, Homo sapiens
gaagaaataatgttgaaaaaaatatattgtatgaatacttgataatttagtttctaatcattggcaattacgttattttaaagtaactataactattccttataaaataaatcttagtaacatttctaaccacaattgtttattggaaaacacttgaaattgaggccgattttctctgtgatttggtgattcttaattgttgtgggatcaggaagctttgaaaagttcgtaatggccaggcatagtggctaatgcaagtaatcccagtacttagggaggctaaagtgggtgggtc

SEQ ID NO: 27979 - DNA, 440 bp, Homo sapiens
gtattttttagacctcatctttctcatttgtaaaatgaggagttggataggcagtcttttaagaaagtatttttcaaataatatgcctcagttcattttcatcagaatcagctgttaactaacaatggaaatgtctgggtttcacatgtattatcatctctggagtgaggcctggcagtttggacatgttttagacctggaggtggattcttaggaacttaaaagtttaaagtcattgcattaagttactttttatgctgtaactttctccagctctaactctacagttggtgttctaaagtaccaatacaggtaagttcttggtacctatataagaatgaggtaaatattatagataaacctcaaatttctggcacccctgaggcttaactctgaagtccatcattgacgcagtaatggctctattttctataaactgc

SEQ ID NO: 27980 - DNA, 330 bp, Homo sapiens
ttcagatagagcactaaacagctcttccttttcattaaagtataccagctaaataatatatcatcttggcttatgtttcaatcatgcagtttttcttctcctggacttgaaagaagcttcttccttaagaaccccttctcaaatataaattattattattttttagcctggaaaagttgggtggggaggtacattgtgagtcacctatgtcaatctgaacattgctgaaaacgaaatatactttaatagttccaatggtattcattcagccttattctgacctttccttgtttttactctaattaaacataaatcttgaaaaacaaagag

SEQ ID NO: 27981 - DNA, 288 bp, Homo sapiens
gcacttgtcaagaccaatacatcaaagtttaattcactaatagaatgaattagagcaaaatgaaacattctgttctctaggaaacccaacacccatcataagttctttctgaactccacagaaaagtcagtgcattaagaaattgtttttttgaataaaattacagttccaatctgatgaaatattacaagccagttttcttagaattcttacacaagtatagtgcttaagtgtctaccggaccatcagcactctatactaatcatcattggtaaatatgattatatt

SEQ ID NO: 27982 - DNA, 492 bp, Homo sapiens
ctgacttctggtgtaaggctctgttaaacagttaatgccaccaccactgccaccaataataatatattttgatcaccaactttatgtaacactgataattgttttacatagatatgtcatttaatcctctcaacaaccagtgagatagatcttgttaccatctctctaagaatagacttcaggtaagtctaaatactgggcctgccagtaggattccctaggaaattgaccttaacatttgctttctcagtaagccattagagatttagtggaactgttactagcatcatgacaacaaatctagaatgtctggaatgattggaagggtcagaagattataaaaaatctctgtgagtatgaccaggcatggtggctcacgcctataatctcagctctttgggaggccaaggcgagcagattgcttgagcccaggagttcgagaccagcctgggcaacatagtgagatcttgtcactatttcttaaattaaaaa

SEQ ID NO: 27983 - DNA, 471 bp, Homo sapiens
cccctttgtgtgttttacatatatatatctctaagtccagagccaggagagttggaccattgagggcagctctgccaacatttagtaaaagtattcattgttccaaaactgtcatctctacccttgagggagtgtgtctttgtgagaaatataaaggcttgagtcatgaaatacttaacacatgtgcacatgtacacatgtacatttatatgcagtgaattgttactcgtggtagttaggttctgtgaattttctgtgcacactgaattagtgaatgctgaatgattgttgctaggggaaatacagcgttagcttctgtgagcctctgatccaaacatttttatcaaccagtcaacacataaccttcttctatgggtatttgtttgtttgtttgtttaaagacactttatcagtgtttcttgaataattataattattctttataataaaaatattttaattatagcatgt

SEQ ID NO: 27984 - DNA, 716 bp, Homo sapiens
tcagcttttatttgcttttctttctctttcccctctccttgctccctttctctttccactttcccacttttttttttttttttttttcttaaaattagacccaaaaacctgtccttgagacagccaagttggcctttaagggcagcgtttacatgacttccagtcttttcttaattgactatctctgaaaaatgtagtaggccactttaattttcatacttttagtctttcttcccacatattgcagcatcacaccttctattcctcaatgcctcttgtcctccttgcccaacatgttcagaatctatgctaaagaaagggctgttcctatgtgagtgcatgctatgtgcataagagaatggtactttctcattgcagagaaaaatagataaataaataaaacctttttcctctcttgtgggctgaaatatgttctcccaaaatttacatattgaagccctgatccctagtacctcagaatgttactgcatttgtaggtagtacattacagaaggtaataaagttaaaattaggccatagtgtgagtcttaatggtatctcactagtgtccttacaagagaagattagggtttacagagaaacactaagatttcacaggcacacactaagaaaaaaagaccatattaagggacagtgagaagatggtcatttccaagtgaaggagagaggcctgaaaagaaaccaaaccagctgat

SEQ ID NO: 27985 - DNA, 422 bp, Homo sapiens
aaaaagtaataagtaataaagggtttatataaaattcaaagataaaatcttttgatgtaatacagaaaaatatttctaatcccttgtgtttagtaattttggaagttatgtattgtgttccttctgctcattttgcatcctcacacagccctgtaattagtctgttttcacactgctataaagatactacctgagactgggtaatttataaacaagagaggtttaattgactctcagttccacatggctgggaaggtgtcaggaaacttacaatcatggtggaaggggaagcaggcatgtcttaaatggcagcaggtgagacagagcatgtgtgagtgcaagaaaaactatcatttataaaaccatcagatctcatgagaattcactcactatcacgagaacagaatgagggaaaccaccca

SEQ ID NO: 27986 - DNA, 621 bp, Homo sapiens
aaataagaacagcttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattacaacagtgtctccaattttaataaatttttgcaatccaaaaaaagaaaaaaa

SEQ ID NO: 27987 - DNA, 733 bp, Homo sapiens
agcttgctctttctcccatagcacacatctagccttcgggagaagataccttcagaacatatccagaatccagacactattttctaactcttccctctatcacctggttcagacctcctccatctctggcctgctttactagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgatgaggattggaaatgttgggactattataattgcagaatacatgatgatctcaatccaacttgaactctctcactgatacttgaggaccagtaaagatctgatattctgcgttcccgagtagcattgtaacagaaggctgggacacgtgggtcaaagcggcgggccaaacacggaggacggcggctggcgccaccccaccaagagcagggcgccgggagacaagggggcgcccagcgggcacacagcacaccacaggagggcgccccacgcacgcgaccc

SEQ ID NO: 27988 - DNA, 709 bp, Homo sapiens
aaataagaacagcttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgatgaggattggaaatgttgggactattataattgcagaatacatgatgatctcaatccaacttgaactctctcactgatacttgaggaccagtaaagatctgatattctgcgttcccgagtagcattgtaacagaaggctgggacacgtgggtcaaagcggcgggccaaacacggaggacggcggctggcgccaccccaccaagagcagggcgccgggagacaagggggcgcccagcgggcacacagcacaccacaggagggcgccccacgcacgcgaccc

SEQ ID NO: 27989 - DNA, 493 bp, Homo sapiens
aaataagaacagcttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaccatccatggctcctggatctctgaacgttccaatcacatcctggtgtttgtgaccatcactca

SEQ ID NO: 27990 - DNA, 532 bp, Homo sapiens
aaataagaacagcttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaccatccatggctcctggatctctgaacgttccaatcacatcctggtgtttgtgaccatcactca

SEQ ID NO: 27991 - DNA, 472 bp, Homo sapiens
ttgacatgattcgactcgagttcggtacctgaacattcgtgtccccaaggaaggtgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaccatccatggctcctggatctctgaacgttccaatcacatcctggtgtttgtgaccatcactca

SEQ ID NO: 27992 - DNA, 1887 bp, Homo sapiens
atggcgctgcgcgcccgggcgctgtacgacttcaggtcggagaacccaggagagatctcgctgcgagagcacgaggtgctgagcctgtgcagcgagcaggacatcgagggctggctcgagggggtcaacagccgcggcgaccgcggcctcttcccggcctcctatgtgcaggtgatccgcgcccccgagcctggcccggcgggagacggcggcccgggcgccccggcccgctacgccaatgtgccccccgggggcttcgagcccctgcccgtcgcgccccccgcctccttcaagccgccgcctgacgccttccaggcgctgctgcagccacagcaggcgccgcctccgagcaccttccagccgcccggcgcgggcttcccgtacggcgggggcgccctgcagccgtcgcctcagcagctctacggcggctaccaggccagccaaggcagcgatgatgactgggacgacgagtgggacgacagctccacggtggcggacgagccgggcgctctgggcagcggagcatacccggacctcgacggctcgtcttcggcgggtgtgggcgcagccggccgctaccgcctgtccacgcgctccgacctgtccctgggctcccgcggcggctcggtccccccgcagcaccacccgtcggggcccaagagctcggccaccgtgagccgcaacctcaatcgcttctccaccttcgtcaagtccggcggggaggccttcgtgctgggggaggcgtcaggcttcgtgaaggacggggacaagctgtgcgtggtgctggggccctatggccccgagtggcaggagaacccctacccgttccagtgcaccatcgacgaccccaccaagcagaccaagttcaagggcatgaagagctacatctcctacaagctggtgcccacgcacacgcaggtgccggtgcatcggcgctacaagcacttcgactggctgtacgcgcgcctggcggagaagttcccggtcatctccgtgccccacctgcccgagaagcaggccaccggccgcttcgaggaggacttcatctctaagcgcaggaagggcctgatctggtggatgaaccacatggccagccacccagtgctggcgcagtgcgacgtcttccagcacttcctgacgtgccccagcagcaccgacgagaaagcctggaagcagggcaagaggaaggccgagaaggacgagatggtgggcgccaacttcttcctgacccttagcacgccccccgccgctgcccttgacctgcaggaggtggagagcaagatagacggcttcaagtgcttcaccaagaagatggacgacagcgcgctgcagctcaaccacacggccaacgagttcgcgcgcaagcaggtgaccggcttcaaaaaggagtatcagaaggtgggccagtccttccgcggcctcagccaggcctttgagctggaccagcaggccttctcggtgggcctgaaccaggctatcgccttcaccggagatgcctatgacgccattggcgagctcttcgcggagcagcccaggcaggacctggatcccgtcatggacctattagcgctgtatcaggggcatctggctaacttcccggacatcatccacgttcagaaaggtaaagcctggcccttagagcaggtgatatggagtgtattgtgcaggctgaaaggggcgactttgacagcagtaccactgtgggtttcagactcatattctacaggtgaggaagcgagcagagacgtggacgcctgggtcttttccctagagtgtaagttggattgctcgacaggcagcttcctcctcgagtatcttgcattagggaatgagtactctttctcgaaggttcaaagagtacctttgatgacagtgctatcattttag

SEQ ID NO: 27993 - DNA, 449 bp, Homo sapiens
gataaatatttgcatttgaaaatcattctttgtcttaactacattcttactcttctttttacacaacccaactaaaacaaagaaatctttgccttatccacaaagtgtccttcctccacagaatttaaattgtttcctagtgatataattacttttctttagtaactctgtgaaagtcctgccactttgtttttcataagataattttccaaataaaatacacataactgagcacatgctctgcccacgatatggcccaggtgtcatgaggagtacaaatgaatatgagacaccccccagcttaagaagcttattgaaagagcttacttgatgaaagatgtatagtaatgaattcagtctcatacagtcaacaaatgttcacaaagatgtggaattttggttggatattgaatgttgagtatcagtttgagtaatggggtgaaggcttt

SEQ ID NO: 27994 - DNA, 471 bp, Homo sapiens
gaaacattatatgcagatttaaaatagaagagattaactaagaaccctttgatcttgaatttgaataggaagtacctgcatggacttatgcttttgttgttttaatatttatagttatgtctagtcattctacttctgtcctttgaactcattgtaacagtgaccaacccaataacagctttgagcatctgtaacaaccagatttctactaaaaggaactggggatttgtcctgcctttcaaataagatagtaacactagatgtcaaaatagtagatatggagaagttccactttagagaaatattcataattgaaaaagaaatgatagaattagaatatcactattttgcaaaccctaattagtagattcgagcattgagcattagtgactgcaaacttacgtaaagagggaaccatagattatgtttctcctgatgtagaacacaccaccatctatgaagtagtcttgc

SEQ ID NO: 27995 - DNA, 1070 bp, Homo sapiens
cgggagtgcagtgagctgagatcatgcccctgcactccagcctgggcaacagagcaagatcctacctcaaaagaaataatctcgggcgggtgctgtgggtcatgcctgtaatcctgggcttcccaaagtgctgggattacaggcgtgagccactgcgcccggctggtttgtgcttgttgtatcaaatttgggaaatccttctttgctgccaggcatgttgttttaataaatacagtagtatacctatctataatgtggtatatctcatctgacatttatttccaatatttgcttgattacaaaggcagacttcttagaagttgctttcttattatctttggagttatagggccacagggttttaaaaggaggttggattgtgccttacatgtgggtttcatacattgtccaaactgagacaccaacagatttgtgaatgagatgtgcatcttattaaatgttaatgtgatttgacaatgagacctttctttgtgtggacagtattatatacaattgatagtgtgtcattcagtctaagctgttagcactttcactaaaatatattcaaattttttttgatgtctagtttttacagtgttgggctttatcaagaatagttgtggattgtggaagagctgatatggaaacagaggaatgtattttgcttttttttttaaactctgtccggttccttggacttgtgtgtctcctatcttatcaagaataattgtagattgtggaagagttgatatggaaacatcttagaagaatgttttttgctttttttaaaaaaaaaaacaaaactgtccagttccttggacttgtgtgtctcctatctaccattaaacccttatgacttaaggtatatgtataaatacatatatacatcttggtggcattgatttttctatgttgtgtattaaagctgctaaaaaacattttttctttttttcaatgagaagactagtgattactttgactttaggaattattcttctaaggagtcaagtatttgatctgggcgaggatcacactgaaatataaaacatctgagtaatttgggttcacta

SEQ ID NO: 27996 - DNA, 1027 bp, Homo sapiens
  misc_feature (3)..(3): n is a, c, g, or t
aanaagagatgggatcttgccctggtacccaggctggtcttgaactcctgacctcaggtgatccacccgcctgggcttcccaaagtgctgggattacaggcgtgagccactgcgcccggctggtttgtgcttgttgtatcaaatttgggaaatccttctttgctgccaggcatgttgttttaataaatacagtagtatacctatctataatgtggtatatctcatctgacatttatttccaatatttgcttgattacaaaggcagacttcttagaagttgctttcttattatctttggagttatagggccacagggttttaaaaggaggttggattgtgccttacatgtgggtttcatacattgtccaaactgagacaccaacagatttgtgaatgagatgtgcatcttattaaatgttaatgtgatttgacaatgagacctttctttgtgtggacagtattatatacaattgatagtgtgtcattcagtctaagctgttagcactttcactaaaatatattcaaattttttttgatgtctagtttttacagtgttgggctttatcaagaatagttgtggattgtggaagagctgatatggaaacagaggaatgtattttgcttttttttttaaactctgtccggttccttggacttgtgtgtctcctatcttatcaagaataattgtagattgtggaagagttgatatggaaacatcttagaagaatgttttttgctttttttaaaaaaaaaaacaaaactgtccagttccttggacttgtgtgtctcctatctaccattaaacccttatgacttaaggtatatgtataaatacatatatacatcttggtggcattgatttttctatgttgtgtattaaagctgctaaaaaacattttttctttttttcaatgagaagactagtgattactttgactttaggaattattcttctaaggagtcaagtatttgatctgggcgaggatcacactgaaatataaaacatctgagtaatttgggttcacta

SEQ ID NO: 27997 - DNA, 960 bp, Homo sapiens
ggtaatacagagtgccttaaaacattaaataggcgtgagccactgcgcccggctggtttgtgcttgttgtatcaaatttgggaaatccttctttgctgccaggcatgttgttttaataaatacagtagtatacctatctataatgtggtatatctcatctgacatttatttccaatatttgcttgattacaaaggcagacttcttagaagttgctttcttattatctttggagttatagggccacagggttttaaaaggaggttggattgtgccttacatgtgggtttcatacattgtccaaactgagacaccaacagatttgtgaatgagatgtgcatcttattaaatgttaatgtgatttgacaatgagacctttctttgtgtggacagtattatatacaattgatagtgtgtcattcagtctaagctgttagcactttcactaaaatatattcaaattttttttgatgtctagtttttacagtgttgggctttatcaagaatagttgtggattgtggaagagctgatatggaaacagaggaatgtattttgcttttttttttaaactctgtccggttccttggacttgtgtgtctcctatcttatcaagaataattgtagattgtggaagagttgatatggaaacatcttagaagaatgttttttgctttttttaaaaaaaaaaacaaaactgtccagttccttggacttgtgtgtctcctatctaccattaaacccttatgacttaaggtatatgtataaatacatatatacatcttggtggcattgatttttctatgttgtgtattaaagctgctaaaaaacattttttctttttttcaatgagaagactagtgattactttgactttaggaattattcttctaaggagtcaagtatttgatctgggcgaggatcacactgaaatataaaacatctgagtaatttgggttcacta

SEQ ID NO: 27998 - DNA, 1902 bp, Homo sapiens
ctaggaggaaatgaatacctgattattttgtacttcacaaaataaactggataaactggataaatgactgaaagtttcttttttatattgctgagtcagattggatccggttcattaagggccaaaatttgtatttggcagtaatcctcatgtgttctcagaatgcttgattggtcattatcagttgcttaatgcttaccaaacacttccagtgttttgagtcactgaattggctcatggtaattgttaatcttgtggttactgagtcaagagccagcagtgtgtgttttggctgcttcacttcctcctcaacacttgatattgtcagattttaaattaattttttttttctaatctggtgggtttgaaattgtatctatagtgttttttatcagcatttcctgaagctgggcatcttttcatgtattttcgttggtcatttgtgcttctgcgaagtgtatattcaatttcgttgcctatttttttggtcttttctctttttctgatttatttttaagagttctttatatattctggatactaattatttgttaatttataggttgcaaatatcctttcccaatttgtgacttgtcttttcatctcttcatagtcttctggtgagaaaagctcctaattgtaatgaactgaatttttcagtctttcatggtttgtgttttgtgtttttttttattttttattttttattttttgagatggagtttcgctcttgttgcccatgcgggagtgcaatggcgtgatcttggctcactgcagcctccgcctcctgggttcaagcaattctcctgtctcagcctcccgagtagctgggattacaggtgcctgccaccacgcccagctaatttctgtatttttagtagagacagggtttcatcatattggtcaggctggtcttgaactcctgacctcaggtgatccacccgcctgggcttcccaaagtgctgggattacaggcgtgagccactgcgcccggctggtttgtgcttgttgtatcaaatttgggaaatccttctttgctgccaggcatgttgttttaataaatacagtagtatacctatctataatgtggtatatctcatctgacatttatttccaatatttgcttgattacaaaggcagacttcttagaagttgctttcttattatctttggagttatagggccacagggttttaaaaggaggttggattgtgccttacatgtgggtttcatacattgtccaaactgagacaccaacagatttgtgaatgagatgtgcatcttattaaatgttaatgtgatttgacaatgagacctttctttgtgtggacagtattatatacaattgatagtgtgtcattcagtctaagctgttagcactttcactaaaatatattcaaattttttttgatgtctagtttttacagtgttgggctttatcaagaatagttgtggattgtggaagagctgatatggaaacagaggaatgtattttgcttttttttttaaactctgtccggttccttggacttgtgtgtctcctatcttatcaagaataattgtagattgtggaagagttgatatggaaacatcttagaagaatgttttttgctttttttaaaaaaaaaaacaaaactgtccagttccttggacttgtgtgtctcctatctaccattaaacccttatgacttaaggtatatgtataaatacatatatacatcttggtggcattgatttttctatgttgtgtattaaagctgctaaaaaacattttttctttttttcaatgagaagactagtgattactttgactttaggaattattcttctaaggagtcaagtatttgatctgggcgaggatcacactgaaatataaaacatctgagtaatttgggttcacta

SEQ ID NO: 27999 - DNA, 1068 bp, Homo sapiens
  misc_feature (26)..(26): n is a, c, g, or t
  misc_feature (866)..(866): n is a, c, g, or t
  misc_feature (873)..(873): n is a, c, g, or t
  misc_feature (902)..(903): n is a, c, g, or t
  misc_feature (906)..(907): n is a, c, g, or t
  misc_feature (909)..(909): n is a, c, g, or t
  misc_feature (917)..(917): n is a, c, g, or t
  misc_feature (929)..(929): n is a, c, g, or t
  misc_feature (933)..(934): n is a, c, g, or t
  misc_feature (937)..(937): n is a, c, g, or t
  misc_feature (946)..(946): n is a, c, g, or t
  misc_feature (948)..(948): n is a, c, g, or t
  misc_feature (950)..(950): n is a, c, g, or t
  misc_feature (954)..(955): n is a, c, g, or t
  misc_feature (959)..(959): n is a, c, g, or t
  misc_feature (961)..(961): n is a, c, g, or t
  misc_feature (963)..(963): n is a, c, g, or t
  misc_feature (968)..(968): n is a, c, g, or t
  misc_feature (982)..(982): n is a, c, g, or t
  misc_feature (991)..(993): n is a, c, g, or t
  misc_feature (997)..(997): n is a, c, g, or t
  misc_feature (1004)..(1004): n is a, c, g, or t
ggggcgccgagacagggcgtgttcgntgttcagtgccggtgttgcagggagtgagggcagctggagtgcgttctgccgaagcttgtggttgcacgcccatcgtcttaggggctaccttccgtgaccatgtccaagtctctgaagaagttggtggaggagagccgggagaagaaccagcccgaggtggacatgagtgaccggggcatctccaacatgctggatgtcaacggcctctttaccttatcccatatcacacaactggtcctcagccataacaagctaacaatggtgccaccgaacatcgcagaactgaagaatttggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcgaaaattctcttcctggaaacttcttctacctgaccaccctgcgtgcactctatctaagtgacaacgattttgaaatcctgccgccagatattgggaagctcacaaagttgcagatactcagccttagggataacgacctgatctcgctgcctaaggaaatcggggagcttacccagcttaaagagctccacattcaggggaaccggctcaccgttctggccccagaactaggaaacttggatttaactggccagaagcaggtattcaaagcagagaacaatccctgggtgacccccattgcagaccagttccagcttgggcgtgtcccatgttttgagtatatccgttctgagacatacaaatcctctacggnagacacntgcaggccaaccagaaccaccgagcagannctnncnaatcgaanagatcagcgganaccnnggnagccagacngntnaggnngggntngnatcgntggcttccagcacnttctttctnnnacantatctcncttggccggtttcaattatcccatgtgcctgtagccgttattaccataaccacttaaggtcccc

SEQ ID NO: 28000 - DNA, 797 bp, Homo sapiens
  misc_feature (26)..(26): n is a, c, g, or t
  misc_feature (595)..(595): n is a, c, g, or t
  misc_feature (602)..(602): n is a, c, g, or t
  misc_feature (631)..(632): n is a, c, g, or t
  misc_feature (635)..(636): n is a, c, g, or t
  misc_feature (638)..(638): n is a, c, g, or t
  misc_feature (646)..(646): n is a, c, g, or t
  misc_feature (658)..(658): n is a, c, g, or t
  misc_feature (662)..(663): n is a, c, g, or t
  misc_feature (666)..(666): n is a, c, g, or t
  misc_feature (675)..(675): n is a, c, g, or t
  misc_feature (677)..(677): n is a, c, g, or t
  misc_feature (679)..(679): n is a, c, g, or t
  misc_feature (683)..(684): n is a, c, g, or t
  misc_feature (688)..(688): n is a, c, g, or t
  misc_feature (690)..(690): n is a, c, g, or t
  misc_feature (692)..(692): n is a, c, g, or t
  misc_feature (697)..(697): n is a, c, g, or t
  misc_feature (711)..(711): n is a, c, g, or t
  misc_feature (720)..(722): n is a, c, g, or t
  misc_feature (726)..(726): n is a, c, g, or t
  misc_feature (733)..(733): n is a, c, g, or t
ggggcgccgagacagggcgtgttcgntgttcagtgccggtgttgcagggagtgagggcagctggagtgcgttctgccgaagcttgtggttgcacgcccatcgtcttaggggctaccttccgtgttaccttatcccatatcacacaactggtcctcagccataacaagctaacaatggtgccaccgaacatcgcagaactgaagaatttggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcgaaaattctcttcctggaaacttcttctacctgaccaccctgcgtgcactctatctaagtgacaacgattttgaaatcctgccgccagatattgggaagcaggtattcaaagcagagaacaatccctgggtgacccccattgcagaccagttccagcttgggcgtgtcccatgttttgagtatatccgttctgagacatacaaatcctctacggnagacacntgcaggccaaccagaaccaccgagcagannctnncnaatcgaanagatcagcgganaccnnggnagccagacngntnaggnngggntngnatcgntggcttccagcacnttctttctnnnacantatctcncttggccggtttcaattatcccatgtgcctgtagccgttattaccataaccacttaaggtcccc

SEQ ID NO: 28001 - DNA, 1014 bp, Homo sapiens
  misc_feature (26)..(26): n is a, c, g, or t
  misc_feature (812)..(812): n is a, c, g, or t
  misc_feature (819)..(819): n is a, c, g, or t
  misc_feature (848)..(849): n is a, c, g, or t
  misc_feature (852)..(853): n is a, c, g, or t
  misc_feature (855)..(855): n is a, c, g, or t
  misc_feature (863)..(863): n is a, c, g, or t
  misc_feature (875)..(875): n is a, c, g, or t
  misc_feature (879)..(880): n is a, c, g, or t
  misc_feature (883)..(883): n is a, c, g, or t
  misc_feature (892)..(892): n is a, c, g, or t
  misc_feature (894)..(894): n is a, c, g, or t
  misc_feature (896)..(896): n is a, c, g, or t
  misc_feature (900)..(901): n is a, c, g, or t
  misc_feature (905)..(905): n is a, c, g, or t
  misc_feature (907)..(907): n is a, c, g, or t
  misc_feature (909)..(909): n is a, c, g, or t
  misc_feature (914)..(914): n is a, c, g, or t
  misc_feature (928)..(928): n is a, c, g, or t
  misc_feature (937)..(939): n is a, c, g, or t
  misc_feature (943)..(943): n is a, c, g, or t
  misc_feature (950)..(950): n is a, c, g, or t
ggggcgccgagacagggcgtgttcgntgttcagtgccggtgttgcagggagtgagggcagctggagtgcgttctgccgaagcttgtggttgcacgcccatcgtcttaggggctaccttccgtgaccatgtccaagtctctgaagaagttggtggaggagagccgggagaagaaccagcccgaggtggacatgagtgaccggggcatctccaacatgctggatgtcaacggcctctttaccttatcccatatcacacaactggtcctcagccataacaagctaacaatggtgccaccgaacatcgcagaactgaagaatttggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcgtaagtgacaacgattttgaaatcctgccgccagatattgggaagctcacaaagttgcagatactcagccttagggataacgacctgatctcgctgcctaaggaaatcggggagcttacccagcttaaagagctccacattcaggggaaccggctcaccgttctggccccagaactaggaaacttggatttaactggccagaagcaggtattcaaagcagagaacaatccctgggtgacccccattgcagaccagttccagcttgggcgtgtcccatgttttgagtatatccgttctgagacatacaaatcctctacggnagacacntgcaggccaaccagaaccaccgagcagannctnncnaatcgaanagatcagcgganaccnnggnagccagacngntnaggnngggntngnatcgntggcttccagcacnttctttctnnnacantatctcncttggccggtttcaattatcccatgtgcctgtagccgttattaccataaccacttaaggtcccc

SEQ ID NO: 28002 - DNA, 956 bp, Homo sapiens
  misc_feature (26)..(26): n is a, c, g, or t
  misc_feature (754)..(754): n is a, c, g, or t
  misc_feature (761)..(761): n is a, c, g, or t
  misc_feature (790)..(791): n is a, c, g, or t
  misc_feature (794)..(795): n is a, c, g, or t
  misc_feature (797)..(797): n is a, c, g, or t
  misc_feature (805)..(805): n is a, c, g, or t
  misc_feature (817)..(817): n is a, c, g, or t
  misc_feature (821)..(822): n is a, c, g, or t
  misc_feature (825)..(825): n is a, c, g, or t
  misc_feature (834)..(834): n is a, c, g, or t
  misc_feature (836)..(836): n is a, c, g, or t
  misc_feature (838)..(838): n is a, c, g, or t
  misc_feature (842)..(843): n is a, c, g, or t
  misc_feature (847)..(847): n is a, c, g, or t
  misc_feature (849)..(849): n is a, c, g, or t
  misc_feature (851)..(851): n is a, c, g, or t
  misc_feature (856)..(856): n is a, c, g, or t
  misc_feature (870)..(870): n is a, c, g, or t
  misc_feature (879)..(881): n is a, c, g, or t
  misc_feature (885)..(885): n is a, c, g, or t
  misc_feature (892)..(892): n is a, c, g, or t
ggggcgccgagacagggcgtgttcgntgttcagtgccggtgttgcagggagtgagggcagctggagtgcgttctgccgaagcttgtggttgcacgcccatcgtcttaggggctaccttccgtgttaccttatcccatatcacacaactggtcctcagccataacaagctaacaatggtgccaccgaacatcgcagaactgaagaatttggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcgaaaattctcttcctggaaacttcttctacctgaccaccctgcgtgcactctatctaagtgacaacgattttgaaatcctgccgccagatattgggaagctcacaaagttgcagatactcagccttagggataacgacctgatctcgctgcctaaggaaatcggggagcttacccagcttaaagagctccacattcaggggaaccggctcaccgttctggccccagaactaggaaacttggatttaactggccagaagcaggtattcaaagcagagaacaatccctgggtgacccccattgcagaccagttccagcttgggcgtgtcccatgttttgagtatatccgttctgagacatacaaatcctctacggnagacacntgcaggccaaccagaaccaccgagcagannctnncnaatcgaanagatcagcgganaccnnggnagccagacngntnaggnngggntngnatcgntggcttccagcacnttctttctnnnacantatctcncttggccggtttcaattatcccatgtgcctgtagccgttattaccataaccacttaaggtcccc

SEQ ID NO: 28003 - DNA, 902 bp, Homo sapiens
  misc_feature (26)..(26): n is a, c, g, or t
  misc_feature (700)..(700): n is a, c, g, or t
  misc_feature (707)..(707): n is a, c, g, or t
  misc_feature (736)..(737): n is a, c, g, or t
  misc_feature (740)..(741): n is a, c, g, or t
  misc_feature (743)..(743): n is a, c, g, or t
  misc_feature (751)..(751): n is a, c, g, or t
  misc_feature (763)..(763): n is a, c, g, or t
  misc_feature (767)..(768): n is a, c, g, or t
  misc_feature (771)..(771): n is a, c, g, or t
  misc_feature (780)..(780): n is a, c, g, or t
  misc_feature (782)..(782): n is a, c, g, or t
  misc_feature (784)..(784): n is a, c, g, or t
  misc_feature (788)..(789): n is a, c, g, or t
  misc_feature (793)..(793): n is a, c, g, or t
  misc_feature (795)..(795): n is a, c, g, or t
  misc_feature (797)..(797): n is a, c, g, or t
  misc_feature (802)..(802): n is a, c, g, or t
  misc_feature (816)..(816): n is a, c, g, or t
  misc_feature (825)..(827): n is a, c, g, or t
  misc_feature (831)..(831): n is a, c, g, or t
  misc_feature (838)..(838): n is a, c, g, or t
ggggcgccgagacagggcgtgttcgntgttcagtgccggtgttgcagggagtgagggcagctggagtgcgttctgccgaagcttgtggttgcacgcccatcgtcttaggggctaccttccgtgttaccttatcccatatcacacaactggtcctcagccataacaagctaacaatggtgccaccgaacatcgcagaactgaagaatttggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcgtaagtgacaacgattttgaaatcctgccgccagatattgggaagctcacaaagttgcagatactcagccttagggataacgacctgatctcgctgcctaaggaaatcggggagcttacccagcttaaagagctccacattcaggggaaccggctcaccgttctggccccagaactaggaaacttggatttaactggccagaagcaggtattcaaagcagagaacaatccctgggtgacccccattgcagaccagttccagcttgggcgtgtcccatgttttgagtatatccgttctgagacatacaaatcctctacggnagacacntgcaggccaaccagaaccaccgagcagannctnncnaatcgaanagatcagcgganaccnnggnagccagacngntnaggnngggntngnatcgntggcttccagcacnttctttctnnnacantatctcncttggccggtttcaattatcccatgtgcctgtagccgttattaccataaccacttaaggtcccc

SEQ ID NO: 28004 - DNA, 182 bp, Homo sapiens
gacagcaaaaatcttgagttcagtgaaacgaaatacttctcaaatttattagacccatcatatatgctttttaattagttgtctctagttttaacctttcccatatgtttcatacagagagacagctgtaatgtggcaacctgtggctcttgtcttttatctccagaatagtgatgtttttc

SEQ ID NO: 28005 - DNA, 1986 bp, Homo sapiens
  misc_feature (1)..(1): n is a, c, g, or t
  misc_feature (3)..(4): n is a, c, g, or t
  misc_feature (7)..(7): n is a, c, g, or t
ngnncgnggcggggcggggctgagcgtgtttacatccgccgggtgcgcggcttcgccgcccgaggtcgttcggctcgggtaccatcctccgcgccatggacaccagcgacctgttcgccagctgcaggaagggggatgtgggccgagtgcggtacctgctggagcagcgagacgtggaggtgaatgtgcgggacaagtgggacagcacccccttgtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacaggccgcctggacattggcgtagagcatgtgagtgactgtgagcgcctggccaagcaatgccagctgtgggacctgctcagcgacctggaggccaagtgcgagaaggtgtctgagtttgtggcgtctaagccaggcacgtgtgtgaaggtgctgaccatcgagcccccacctgcagacccccgcctccgggaggacatggcgctgctggccgattgtgccctgccccccgagctccgaggtgatctttgggagctgcccttcccttgtcctgacggcttcaacagctgccctgacatctgcttccgagtggctggctgcagcttcctctgccacaaggcctttttctgtggccgcagtgactacttccgagccctgctggatgaccacttccgagagagcgaggagccagcgacctcagggggccccccagccgtcaccctgcatggcatctcacccgacgtcttcactcacgtgctctactacatgtacagcgaccacactgagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcaccgtgggagcatgagcc

SEQ ID NO: 28006 - DNA, 1951 bp, Homo sapiens
  misc_feature (1)..(1): n is a, c, g, or t
  misc_feature (3)..(4): n is a, c, g, or t
  misc_feature (7)..(7): n is a, c, g, or t
ngnncgnggcggggcggggctgagcgtgtttacatccgccgggtgcgcggcttcgccgcccgaggtcgttcggctcgggtaccatcctccgcgccatggacaccagcgacctgttcgccagctgcaggaagggggatgtgggccgagtgcggtacctgctggagcagcgagacgtggaggtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacaggccgcctggacattggcgtagagcatgtgagtgactgtgagcgcctggccaagcaatgccagctgtgggacctgctcagcgacctggaggccaagtgcgagaaggtgtctgagtttgtggcgtctaagccaggcacgtgtgtgaaggtgctgaccatcgagcccccacctgcagacccccgcctccgggaggacatggcgctgctggccgattgtgccctgccccccgagctccgaggtgatctttgggagctgcccttcccttgtcctgacggcttcaacagctgccctgacatctgcttccgagtggctggctgcagcttcctctgccacaaggcctttttctgtggccgcagtgactacttccgagccctgctggatgaccacttccgagagagcgaggagccagcgacctcagggggccccccagccgtcaccctgcatggcatctcacccgacgtcttcactcacgtgctctactacatgtacagcgaccacactgagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcaccgtgggagcatgagcc

SEQ ID NO: 28007 - DNA, 859 bp, Homo sapiens
  misc_feature (1)..(1): n is a, c, g, or t
  misc_feature (3)..(4): n is a, c, g, or t
  misc_feature (7)..(7): n is a, c, g, or t
ngnncgnggcggggcggggctgagcgtgtttacatccgccgggtgcgcggcttcgccgcccgaggtcgttcggctcgggtaccatcctccgcgccatggacaccagcgacctgttcgccagctgcaggaagggggatgtgggccgagtgcgaccatgaacccgtcctgacccaggctctgacctccttcctgcccaggtacctgctggagcagcgagacgtggaggtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacagtgaccccctgggtccagggtaggaggagagggagtgggccgtccttctggacagcagtacacctaggtgtggctgggctgacctttcacctctagacacttcatggtccccccggggtggttccagctgcctctcgggttgggttgcaagagagaggactagtgtgcctgctcaggaagagcttgtcccacccacatgctgaggccctcccatctgttccctggggc

SEQ ID NO: 28008 - DNA, 633 bp, Homo sapiens
  misc_feature (1)..(1): n is a, c, g, or t
  misc_feature (3)..(4): n is a, c, g, or t
  misc_feature (7)..(7): n is a, c, g, or t
ngnncgnggcggggcggggctgagcgtgtttacatccgccgggtgcgcggcttcgccgcccgaggtcgttcggctcgggtaccatcctccgcgccatggacaccagcgacctgttcgccagctgcaggaagggggatgtgggccgagtgcggtgaggacctcgcagtcccggggagggtgcgggaggtggccgccctcggaacgcctcgggccctgggacgggcggctgggcggccgcggagaggcgggcgcctctgccgggtcacagccctcggagcgcccccgcggggcagaccacccggacccccgccgcagccccccagcggaagcgcgctggggcggggacactgatggccattgacccccggagggcttcctgtaagaagggactgctcagcggaggcccgaaggcgcagaagtgggcggagagaaggcgggccactgttcgccctggtagggcccggacgtcagaccccccgggcgcagggcgcgggtataggcctgggactccagacgtggcccctttctctcgtgctctctggacctggcgcggggaacacctagagcccataatcggcctccggtccctgaggattcggaaactcctgacgcagctaaagtgaatctggcgct

SEQ ID NO: 28009 - DNA, 355 bp, Homo sapiens
atatgaaagggtaaaagaatagaatacaaatattaacagtaggcagaagtagggatatgagagagtgatctgattagatagcagcatgcaattagatgaagcaaggagtacggaaggtatacctgcaattcacagatttataaagggaatgagtgaaaaagtaatagtgaaaaagataaatatgggaatgttattgatcccccctacccaccccagtcccaaatccagtcctctggcccttgcctagccctgaattgcttctctaagctggtgttcccatgcacagggccattcaggaagggctgggggagtgtgtgtggcaataaagcttgaaggcaccgtgggagcatgagcc

SEQ ID NO: 28010 - DNA, 2448 bp, Homo sapiens
gtactcccgtagcctccctgggccgctccctgacatcccgtgccactcaagagttagtgcatagtgtcaacgctgagtgggttcacagcacttccaggtgcagcctggaggcctcctttgggctgcccccgcctcagtggggctacattagcattggcgactcccctcgctcaccttccgcatcccatcagttgctgtatcccgcgactcctgcctcctagaattgtgtgccctccacaccatcaggaggcctgcagcagctttttcccgggctccctgcttctaacagggccagcttcttcctgcagtagagagctctggtgggagtgaaggctccatcacctcctctcccaaacgctgaaaggccaaaggtccagcctcggcactggctctggcttctgtccctgtagcccatcgtcccccagcactgatagcacacagtgtctgcctgttcgaccccacctccacatccttgcctgcactttgccttgagtgcctctcctgctctggtctgcctgtcacctgccctcacctgggggaggcttccccataccaaaagggatgttttctctccgttcctttccacgggccttctttctcagaccatgaacccgtcctgacccaggctctgacctccttcctgcccaggtacctgctggagcagcgagacgtggaggtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacaggccgcctggacattggcgtagagcatgtgagtgactgtgagcgcctggccaagcaatgccagctgtgggacctgctcagcgacctggaggccaagtgcgagaaggtgtctgagtttgtggcgtctaagccaggcacgtgtgtgaaggtgctgaccatcgagcccccacctgcagacccccgcctccgggaggacatggcgctgctggccgattgtgccctgccccccgagctccgaggtgatctttgggagctgcccttcccttgtcctgacggcttcaacagctgccctgacatctgcttccgagtggctggctgcagcttcctctgccacaaggcctttttctgtggccgcagtgactacttccgagccctgctggatgaccacttccgagagagcgaggagccagcgacctcagggggccccccagccgtcaccctgcatggcatctcacccgacgtcttcactcacgtgctctactacatgtacagcgaccacactgagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcaccgtgggagcatgagcc

SEQ ID NO: 28011 - DNA, 1927 bp, Homo sapiens
tgagtaaacggctaggctagaggtggctagaataaataggaggcctaggttgaggttgaccagggggttgggccgagtgcgaccatgaacccgtcctgacccaggctctgacctccttcctgcccaggtacctgctggagcagcgagacgtggaggtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacaggccgcctggacattggcgtagagcatgtgagtgactgtgagcgcctggccaagcaatgccagctgtgggacctgctcagcgacctggaggccaagtgcgagaaggtgtctgagtttgtggcgtctaagccaggcacgtgtgtgaaggtgctgaccatcgagcccccacctgcagacccccgcctccgggaggacatggcgctgctggccgattgtgccctgccccccgagctccgaggtgatctttgggagctgcccttcccttgtcctgacggcttcaacagctgccctgacatctgcttccgagtggctggctgcagcttcctctgccacaaggcctttttctgtggccgcagtgactacttccgagccctgctggatgaccacttccgagagagcgaggagccagcgacctcagggggccccccagccgtcaccctgcatggcatctcacccgacgtcttcactcacgtgctctactacatgtacagcgaccacactgagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcaccgtgggagcatgagcc

SEQ ID NO: 28012 - DNA, 4131 bp, Homo sapiens
  misc_feature (1)..(1): n is a, c, g, or t
  misc_feature (3)..(4): n is a, c, g, or t
  misc_feature (7)..(7): n is a, c, g, or t
ngnncgnggcggggcggggctgagcgtgtttacatccgccgggtgcgcggcttcgccgcccgaggtcgttcggctcgggtaccatcctccgcgccatggacaccagcgacctgttcgccagctgcaggaagggggatgtgggccgagtgcggtacctgctggagcagcgagacgtggaggtgaatgtgcgggacaagtgggacagcacccccttgtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacaggccgcctggacattggcgtagagcatgtgagtgactgtgagcgcctggccaagcaatgccagctgtgggacctgctcagcgacctggaggccaagtgcgagaaggtgtctgagtttgtggcgtctaagccaggcacgtgtgtgaaggtgctgaccatcgagcccccacctgcagacccccgcctccgggaggacatggcgctgctggccgattgtgccctgccccccgagctccgaggtgatctttgggagctgcccttcccttgtcctgacggcttcaacagctgccctgacatctgcttccgagtggctggctgcagcttcctctgccacaaggcctttttctgtggccgcagtgactacttccgagccctgctggatgaccacttccgagagagcgaggagccagcgacctcagggggccccccagccgtcaccctgcatggcatctcacccgacgtcttcactcacgtgctctactacatgtacagcgaccacactgagtgggggctcaggcagagctggggatggcacacaacctgtgctgccgtgggctgagagggagcgccagggccctgggggtctgtggaagggcccagctggccccatggttgacgttttgagaaggctggaggggaaggctgtgggactttggatttttctttcaggtagaggaagccttgttgggctccagagagaggatgagtgatgagcctgtgtcacagacactccacacttgtcagccacttgggatcctcagcttctctagcaggagggtggagggtgggtggggacagcctcctctctgtggtgctgcagatccctggggttctgggttcccagtctcctcttcccttgctgcctgcctctgtctccagctgccccaaggtgtccgtaagccaaggctgcagggcagcagcagagtgctgaaggtttgctctgccagggtgtgtgagagagagagagagtgtgtgtgtgcgtgcgcgtgcgcgtgcgcgcgactataaagcaatccccatatctggtggcttaaagaagaggggagtttgtttctccttcacttctgactgaggtgggtgccccagggcaagtggcttgcggaagatcaggtcatccctccatcttgcccctgtatgcctaagggtgaaggtcaaaaaccttttctctgaaggtgagtgtttcaggttctgtgggccatatggccctgttgtagctactcaactctgtagcgcaaaggtagccagagacagtacagagatgagtgggtgaggctgcattccaataaaactttacttgcacaaacaggctggatttggtccacaggccgtagcttacccatcctgcctggggcatcgcgtttggccatggagattgggtcctaggcaaactcatgctctaggaggaagaggaaggcagggcaagcaatgctgtttttgtagaagccaccggaaattgcaccacttctcatgttcccctggagagaacttcgtgcctacctgccaacaagggaggcttggaaagtcattctgtggccagggccctgttttgtgggggaaggggaggaagcatgctgggagacagagggcagtccctactgctgctctatctccagtggcagctcccttgtccatccctccgcgcggcctgacagcccctcagcctccatctttcccaccccctctactgggcatctcctgcagctcagcccagctctctggcccctgtagcaggggttacctttgcccaccctggagaagctccctcttcaaggagcctcgccacccaaagggcaccttgtctcagagtgtggcttgggctcttaacctgggttgatactggttgagctgtgtgacactgggtgagctttgtgatcttgggccagttacttaactgctctgtgcctctagaacatggggatagctctcgtcgtcacttcctaaggccttgtgcagatgcatgggttacccaggtaaaggaggtggcatggcacatggcacgtggcttgtaatgtggtcgcagagctccccttgtctctgtctgcagcttgctccctgtgccacccaggctctggcctgaatctgagggcttcagtcttatccagcacaggatgtatctgtaggtgggctctgtgtccccacagcctcttgagagggagggagctggtagatagtctcccacccctggcagagtccctgcataggtcttgactagctgcctctgtcccaccattctgacagcccccgcaggtaggcatggttatctatacctcatggactgggaactagaggcacagggaggtgcagtgacttgcccagggccccacagctagaagtgtcagacccaggtctgtataactcggagctcagaccctggctcctgcgagggccctgcctcccgcctgccctgccagcctgctcagggcatgggagaaccccccagtcttctgccccctagcggtcctgcagatccctgtgggaatctgggccagccccccgacccccaaccccatacatgcgcagggagctcctactcccactggaagccttcccgccagtgccccccaaccaccacaggccctagccttggctgttgtgccctgggagcccttggtgacctcggggggcaccttcatccctgtcttcactgcagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcaccgtgggagcatgagcc

SEQ ID NO: 28013 - DNA, 1676 bp, Homo sapiens
tgtggcgagtctgctctgactgtggcctgcactgggttctgagtgctccgaggaatggggtggggctgtgccaagtatcctccctcctggcttgtccctccccaggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacaggccgcctggacattggcgtagagcatgtgagtgactgtgagcgcctggccaagcaatgccagctgtgggacctgctcagcgacctggaggccaagtgcgagaaggtgtctgagtttgtggcgtctaagccaggcacgtgtgtgaaggtgctgaccatcgagcccccacctgcagacccccgcctccgggaggacatggcgctgctggccgattgtgccctgccccccgagctccgaggtgatctttgggagctgcccttcccttgtcctgacggcttcaacagctgccctgacatctgcttccgagtggctggctgcagcttcctctgccacaaggcctttttctgtggccgcagtgactacttccgagccctgctggatgaccacttccgagagagcgaggagccagcgacctcagggggccccccagccgtcaccctgcatggcatctcacccgacgtcttcactcacgtgctctactacatgtacagcgaccacactgagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcaccgtgggagcatgagcc

SEQ ID NO: 28014 - DNA, 3946 bp, Homo sapiens
  misc_feature (1)..(1): n is a, c, g, or t
  misc_feature (3)..(4): n is a, c, g, or t
  misc_feature (7)..(7): n is a, c, g, or t
ngnncgnggcggggcggggctgagcgtgtttacatccgccgggtgcgcggcttcgccgcccgaggtcgttcggctcgggtaccatcctccgcgccatggacaccagcgacctgttcgccagctgcaggaagggggatgtgggccgagtgcggtacctgctggagcagcgagacgtggaggtgaatgtgcgggacaagtgggacagcacccccttgtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacaggccgcctggacattggcgtagagcatgtgagtgactgtgagcgcctggccaagcaatgccagctgtgggacctgctcagcgacctggaggccaagtgcgagaaggtgtctgagtttgtggcgtctaagccaggcacgtgtgtgaaggtgctgaccatcgagcccccacctgcagacccccgcctccgggaggacatggcgctgctggccgattgtgccctgccccccgagctccgaggtgatctttgggagctgcccttcccttgtcctgacggcttcaacagctgccctgacatctgcttccgagtggctggctgcagcttcctctgccacaaggcctttttctgtggccgcagtgactacttccgagccctgctggatgaccacttccgagagagcgaggagccagcgacctcagggggccccccagccgtcaccctgcatggcatctcacccgacgtcttcactcacgtgctctactacatgtacagcgaccacactgagtgggggctcaggcagagctggggatggcacacaacctgtgctgccgtgggctgagagggagcgccagggccctgggggtctgtggaagggcccagctggccccatggttgacgttttgagaaggctggaggggaaggctgtgggactttggatttttctttcaggtagaggaagccttgttgggctccagagagaggatgagtgatgagcctgtgtcacagacactccacacttgtcagccacttgggatcctcagcttctctagcaggagggtggagggtgggtggggacagcctcctctctgtggtgctgcagatccctggggttctgggttcccagtctcctcttcccttgctgcctgcctctgtctccagctgccccaaggtgtccgtaagccaaggctgcagggcagcagcagagtgctgaaggtttgctctgccagggtgtgtgagagagagagagagtgtgtgtgtgcgtgcgcgtgcgcgtgcgcgcgactataaagcaatccccatatctggtggcttaaagaagaggggagtttgtttctccttcacttctgactgaggtgggtgccccagggcaagtggcttgcggaagatcaggtcatccctccatcttgcccctgtatgcctaagggtgaaggtcaaaaaccttttctctgaaggtgagtgtttcaggttctgtgggccatatggccctgttgtagctactcaactctgtagcgcaaaggtagccagagacagtacagagatgagtgggtgaggctgcattccaataaaactttacttgcacaaacaggctggatttggtccacaggccgtagcttacccatcctgcctggggcatcgcgtttggccatggagattgggtcctaggcaaactcatgctctaggaggaagaggaaggcagggcaagcaatgctgtttttgtagaagccaccggaaattgcaccacttctcatgttcccctggagagaacttcgtgcctacctgccaacaagggaggcttggaaagtcattctgtggccagggccctgttttgtgggggaaggggaggaagcatgctgggagacagagggcagtccctactgctgctctatctccagtggcagctcccttgtccatccctccgcgcggcctgacagcccctcagcctccatctttcccaccccctctactgggcatctcctgcagctcagcccagctctctggcccctgtagcaggggttacctttgcccaccctggagaagctccctcttcaaggagcctcgccacccaaagggcaccttgtctcagagtgtggcttgggctcttaacctgggttgatactggttgagctgtgtgacactgggtgagctttgtgatcttgggccagttacttaactgctctgtgcctctagaacatggggatagctctcgtcgtcacttcctaaggccttgtgcagatgcatgggttacccaggtaaaggaggtggcatggcacatggcacgtggcttgtaatgtggtcgcagagctccccttgtctctgtctgcagcttgctccctgtgccacccaggctctggcctgaatctgagggcttcagtcttatccagcacaggatgtatctgtaggtgggctctgtgtccccacagctagaagtgtcagacccaggtctgtataactcggagctcagaccctggctcctgcgagggccctgcctcccgcctgccctgccagcctgctcagggcatgggagaaccccccagtcttctgccccctagcggtcctgcagatccctgtgggaatctgggccagccccccgacccccaaccccatacatgcgcagggagctcctactcccactggaagccttcccgccagtgccccccaaccaccacaggccctagccttggctgttgtgccctgggagcccttggtgacctcggggggcaccttcatccctgtcttcactgcagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcaccgtgggagcatgagcc

SEQ ID NO: 28015 - DNA, 3660 bp, Homo sapiens
  misc_feature (1)..(1): n is a, c, g, or t
  misc_feature (3)..(4): n is a, c, g, or t
  misc_feature (7)..(7): n is a, c, g, or t
ngnncgnggcggggcggggctgagcgtgtttacatccgccgggtgcgcggcttcgccgcccgaggtcgttcggctcgggtaccatcctccgcgccatggacaccagcgacctgttcgccagctgcaggaagggggatgtgggccgagtgcggtacctgctggagcagcgagacgtggaggtgaatgtgcgggacaagtgggacagcacccccttgtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacaggccgcctggacattggcgtagagcatgtgagtgactgtgagcgcctggccaagcaatgccagctgtgggacctgctcagcgacctggaggccaagtgcgagaaggtgtctgagtttgtggcgtctaagccaggcacgtgtgtgaaggtgctgaccatcgagcccccacctgcagacccccgcctccgggaggacatggcgctgctggccgattgtgccctgccccccgagctccgaggtgatctttgggagctgcccttcccttgtcctgacggcttcaacagctgccctgacatctgcttccgagtggctggctgcagcttcctctgccacaaggcctttttctgtggccgcagtgactacttccgagccctgctggatgaccacttccgagagagcgaggagccagcgacctcagggggccccccagccgtcaccctgcatggcatctcacccgacgtcttcactcacgtgctctactacatgtacagcgaccacactgagtgggggctcaggcagagctggggatggcacacaacctgtgctgccgtgggctgagagggagcgccagggccctgggggtctgtggaagggcccagctggccccatggttgacgttttgagaaggctggaggggaaggctgtgggactttggatttttctttcaggtagaggaagccttgttgggctccagagagaggatgagtgatgagcctgtgtcacagacactccacacttgtcagccacttgggatcctcagcttctctagcaggagggtggagggtgggtggggacagcctcctctctgtggtgctgcagatccctggggttctgggttcccagtctcctcttcccttgctgcctgcctctgtctccagctgccccaaggtgtccgtaagccaaggctgcagggcagcagcagagtgctgaaggtttgctctgccagggtgtgtgagagagagagagagtgtgtgtgtgcgtgcgcgtgcgcgtgcgcgcgactataaagcaatccccatatctggtggcttaaagaagaggggagtttgtttctccttcacttctgactgaggtgggtgccccagggcaagtggcttgcggaagatcaggtcatccctccatcttgcccctgtatgcctaagggtgaaggtcaaaaaccttttctctgaaggtgagtgtttcaggttctgtgggccatatggccctgttgtagctactcaactctgtagcgcaaaggtagccagagacagtacagagatgagtgggtgaggctgcattccaataaaactttacttgcacaaacaggctggatttggtccacaggccgtagcttacccatcctgcctggggcatcgcgtttggccatggagattgggtcctaggcaaactcatgctctaggaggaagaggaaggcagggcaagcaatgctgtttttgtagaagccaccggaaattgcaccacttctcatgttcccctggagagaacttcgtgcctacctgccaacaagggaggcttggaaagtcattctgtggccagggccctgttttgtgggggaaggggaggaagcatgctgggagacagagggcagtccctactgctgctctatctccagtggcagctcccttgtccatccctccgcgcggcctgacagcccctcagcctccatctttcccaccccctctactgggcatctcctgcagctcagcccagctctctggcccctgtagcaggggttacctttgcccaccctggagaagctccctcttcaaggagcctcgccacccaaagggcaccttgtctcagagtgtggcttgggctcttaacctgggttgatactggttgagctgtgtgacactgggtgagctttgtgatcttgggccagttacttaactgctctgtgcctctagaacatggggatagctctcgtcgtcacttcctaaggccttgtgcagatgcatgggttacccaggtaaaggaggtggcatggcacatggcacgtggcttgtaatgtggtcgcagagctccccttgtctctgtctgcagcttgctccctgtgccaccattctgacagcccccgcaggtaggcatggttatctatacctcatggactgggaactagaggcacagggaggtgcagtgacttgcccagggccccacagctagaagtgtcagacccagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcaccgtgggagcatgagcc

SEQ ID NO: 28016 - DNA, 3826 bp, Homo sapiens
  misc_feature (1)..(1): n is a, c, g, or t
  misc_feature (3)..(4): n is a, c, g, or t
  misc_feature (7)..(7): n is a, c, g, or t
ngnncgnggcggggcggggctgagcgtgtttacatccgccgggtgcgcggcttcgccgcccgaggtcgttcggctcgggtaccatcctccgcgccatggacaccagcgacctgttcgccagctgcaggaagggggatgtgggccgagtgcggtacctgctggagcagcgagacgtggaggtgaatgtgcgggacaagtgggacagcacccccttgtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacaggccgcctggacattggcgtagagcatgtgagtgactgtgagcgcctggccaagcaatgccagctgtgggacctgctcagcgacctggaggccaagtgcgagaaggtgtctgagtttgtggcgtctaagccaggcacgtgtgtgaaggtgctgaccatcgagcccccacctgcagacccccgcctccgggaggacatggcgctgctggccgattgtgccctgccccccgagctccgaggtgatctttgggagctgcccttcccttgtcctgacggcttcaacagctgccctgacatctgcttccgagtggctggctgcagcttcctctgccacaaggcctttttctgtggccgcagtgactacttccgagccctgctggatgaccacttccgagagagcgaggagccagcgacctcagggggccccccagccgtcaccctgcatggcatctcacccgacgtcttcactcacgtgctctactacatgtacagcgaccacactgagtgggggctcaggcagagctggggatggcacacaacctgtgctgccgtgggctgagagggagcgccagggccctgggggtctgtggaagggcccagctggccccatggttgacgttttgagaaggctggaggggaaggctgtgggactttggatttttctttcaggtagaggaagccttgttgggctccagagagaggatgagtgatgagcctgtgtcacagacactccacacttgtcagccacttgggatcctcagcttctctagcaggagggtggagggtgggtggggacagcctcctctctgtggtgctgcagatccctggggttctgggttcccagtctcctcttcccttgctgcctgcctctgtctccagctgccccaaggtgtccgtaagccaaggctgcagggcagcagcagagtgctgaaggtttgctctgccagggtgtgtgagagagagagagagtgtgtgtgtgcgtgcgcgtgcgcgtgcgcgcgactataaagcaatccccatatctggtggcttaaagaagaggggagtttgtttctccttcacttctgactgaggtgggtgccccagggcaagtggcttgcggaagatcaggtcatccctccatcttgcccctgtatgcctaagggtgaaggtcaaaaaccttttctctgaaggtgagtgtttcaggttctgtgggccatatggccctgttgtagctactcaactctgtagcgcaaaggtagccagagacagtacagagatgagtgggtgaggctgcattccaataaaactttacttgcacaaacaggctggatttggtccacaggccgtagcttacccatcctgcctggggcatcgcgtttggccatggagattgggtcctaggcaaactcatgctctaggaggaagaggaaggcagggcaagcaatgctgtttttgtagaagccaccggaaattgcaccacttctcatgttcccctggagagaacttcgtgcctacctgccaacaagggaggcttggaaagtcattctgtggccagggccctgttttgtgggggaaggggaggaagcatgctgggagacagagggcagtccctactgctgctctatctccagtggcagctcccttgtccatccctccgcgcggcctgacagcccctcagcctccatctttcccaccccctctactgggcatctcctgcagctcagcccagctctctggcccctgtagcaggggttacctttgcccaccctggagaagctccctcttcaaggagcctcgccacccaaagggcaccttgtctcagagtgtggcttgggctcttaacctgggttgatactggttgagctgtgtgacactgggtgagctttgtgatcttgggccagttacttaactgctctgtgcctctagaacatggggatagctctcgtcgtcacttcctaaggccttgtgcagatgcatgggttacccaggtaaaggaggtggcatggcacatggcacgtggcttgtaatgtggtcgcagagctccccttgtctctgtctgcagcttgctccctgtgccacccaggctctggcctgaatctgagggcttcagtcttatccagcacaggatgtatctgtaggtgggctctgtgtccccacagcctcttgagagggagggagctggtagatagtctcccacccctggcagagtccctgcataggtcttgactagctgcctctgtcccaccattctgacagcccccgcaggtaggcatggttatctatacctcatggactgggaactagaggcacagggaggtgcagtgacttgcccagggccccacagctagaagtgtcagacccagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcaccgtgggagcatgagcc

SEQ ID NO: 28017 - DNA, 3782 bp, Homo sapiens
  misc_feature (1)..(1): n is a, c, g, or t
  misc_feature (3)..(4): n is a, c, g, or t
  misc_feature (7)..(7): n is a, c, g, or t
ngnncgnggcggggcggggctgagcgtgtttacatccgccgggtgcgcggcttcgccgcccgaggtcgttcggctcgggtaccatcctccgcgccatggacaccagcgacctgttcgccagctgcaggaagggggatgtgggccgagtgcggtacctgctggagcagcgagacgtggaggtgaatgtgcgggacaagtgggacagcacccccttgtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacaggccgcctggacattggcgtagagcatgtgagtgactgtgagcgcctggccaagcaatgccagctgtgggacctgctcagcgacctggaggccaagtgcgagaaggtgtctgagtttgtcacgtgctctactacatgtacagcgaccacactgagtgggggctcaggcagagctggggatggcacacaacctgtgctgccgtgggctgagagggagcgccagggccctgggggtctgtggaagggcccagctggccccatggttgacgttttgagaaggctggaggggaaggctgtgggactttggatttttctttcaggtagaggaagccttgttgggctccagagagaggatgagtgatgagcctgtgtcacagacactccacacttgtcagccacttgggatcctcagcttctctagcaggagggtggagggtgggtggggacagcctcctctctgtggtgctgcagatccctggggttctgggttcccagtctcctcttcccttgctgcctgcctctgtctccagctgccccaaggtgtccgtaagccaaggctgcagggcagcagcagagtgctgaaggtttgctctgccagggtgtgtgagagagagagagagtgtgtgtgtgcgtgcgcgtgcgcgtgcgcgcgactataaagcaatccccatatctggtggcttaaagaagaggggagtttgtttctccttcacttctgactgaggtgggtgccccagggcaagtggcttgcggaagatcaggtcatccctccatcttgcccctgtatgcctaagggtgaaggtcaaaaaccttttctctgaaggtgagtgtttcaggttctgtgggccatatggccctgttgtagctactcaactctgtagcgcaaaggtagccagagacagtacagagatgagtgggtgaggctgcattccaataaaactttacttgcacaaacaggctggatttggtccacaggccgtagcttacccatcctgcctggggcatcgcgtttggccatggagattgggtcctaggcaaactcatgctctaggaggaagaggaaggcagggcaagcaatgctgtttttgtagaagccaccggaaattgcaccacttctcatgttcccctggagagaacttcgtgcctacctgccaacaagggaggcttggaaagtcattctgtggccagggccctgttttgtgggggaaggggaggaagcatgctgggagacagagggcagtccctactgctgctctatctccagtggcagctcccttgtccatccctccgcgcggcctgacagcccctcagcctccatctttcccaccccctctactgggcatctcctgcagctcagcccagctctctggcccctgtagcaggggttacctttgcccaccctggagaagctccctcttcaaggagcctcgccacccaaagggcaccttgtctcagagtgtggcttgggctcttaacctgggttgatactggttgagctgtgtgacactgggtgagctttgtgatcttgggccagttacttaactgctctgtgcctctagaacatggggatagctctcgtcgtcacttcctaaggccttgtgcagatgcatgggttacccaggtaaaggaggtggcatggcacatggcacgtggcttgtaatgtggtcgcagagctccccttgtctctgtctgcagcttgctccctgtgccacccaggctctggcctgaatctgagggcttcagtcttatccagcacaggatgtatctgtaggtgggctctgtgtccccacagcctcttgagagggagggagctggtagatagtctcccacccctggcagagtccctgcataggtcttgactagctgcctctgtcccaccattctgacagcccccgcaggtaggcatggttatctatacctcatggactgggaactagaggcacagggaggtgcagtgacttgcccagggccccacagctagaagtgtcagacccaggtctgtataactcggagctcagaccctggctcctgcgagggccctgcctcccgcctgccctgccagcctgctcagggcatgggagaaccccccagtcttctgccccctagcggtcctgcagatccctgtgggaatctgggccagccccccgacccccaaccccatacatgcgcagggagctcctactcccactggaagccttcccgccagtgccccccaaccaccacaggccctagccttggctgttgtgccctgggagcccttggtgacctcggggggcaccttcatccctgtcttcactgcagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcaccgtgggagcatgagcc

SEQ ID NO: 28018 - DNA, 2726 bp, Homo sapiens
gccatggtacggtccgagagcgttagatctgcagatccctggggttctgggttcccagtctcctcttcccttgctgcctgcctctgtctccagctgccccaaggtgtccgtaagccaaggctgcagggcagcagcagagtgctgaaggtttgctctgccagggtgtgtgagagagagagagagtgtgtgtgtgcgtgcgcgtgcgcgtgcgcgcgactataaagcaatccccatatctggtggcttaaagaagaggggagtttgtttctccttcacttctgactgaggtgggtgccccagggcaagtggcttgcggaagatcaggtcatccctccatcttgcccctgtatgcctaagggtgaaggtcaaaaaccttttctctgaaggtgagtgtttcaggttctgtgggccatatggccctgttgtagctactcaactctgtagcgcaaaggtagccagagacagtacagagatgagtgggtgaggctgcattccaataaaactttacttgcacaaacaggctggatttggtccacaggccgtagcttacccatcctgcctggggcatcgcgtttggccatggagattgggtcctaggcaaactcatgctctaggaggaagaggaaggcagggcaagcaatgctgtttttgtagaagccaccggaaattgcaccacttctcatgttcccctggagagaacttcgtgcctacctgccaacaagggaggcttggaaagtcattctgtggccagggccctgttttgtgggggaaggggaggaagcatgctgggagacagagggcagtccctactgctgctctatctccagtggcagctcccttgtccatccctccgcgcggcctgacagcccctcagcctccatctttcccaccccctctactgggcatctcctgcagctcagcccagctctctggcccctgtagcaggggttacctttgcccaccctggagaagctccctcttcaaggagcctcgccacccaaagggcaccttgtctcagagtgtggcttgggctcttaacctgggttgatactggttgagctgtgtgacactgggtgagctttgtgatcttgggccagttacttaactgctctgtgcctctagaacatggggatagctctcgtcgtcacttcctaaggccttgtgcagatgcatgggttacccaggtaaaggaggtggcatggcacatggcacgtggcttgtaatgtggtcgcagagctccccttgtctctgtctgcagcttgctccctgtgccacccaggctctggcctgaatctgagggcttcagtcttatccagcacaggatgtatctgtaggtgggctctgtgtccccacagcctcttgagagggagggagctggtagatagtctcccacccctggcagagtccctgcataggtcttgactagctgcctctgtcccaccattctgacagcccccgcaggtaggcatggttatctatacctcatggactgggaactagaggcacagggaggtgcagtgacttgcccagggccccacagctagaagtgtcagacccaggtctgtataactcggagctcagaccctggctcctgcgagggccctgcctcccgcctgccctgccagcctgctcagggcatgggagaaccccccagtcttctgccccctagcggtcctgcagatccctgtgggaatctgggccagccccccgacccccaaccccatacatgcgcagggagctcctactcccactggaagccttcccgccagtgccccccaaccaccacaggccctagccttggctgttgtgccctgggagcccttggtgacctcggggggcaccttcatccctgtcttcactgcagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcaccgtgggagcatgagcc

SEQ ID NO: 28019 - DNA, 3036 bp, Homo sapiens
ggctggtactggtccggagattttaaggatgggggctcaggcagagctggggatggcacacaacctgtgctgccgtgggctgagagggagcgccagggccctgggggtctgtggaagggcccagctggccccatggttgacgttttgagaaggctggaggggaaggctgtgggactttggatttttctttcaggtagaggaagccttgttgggctccagagagaggatgagtgatgagcctgtgtcacagacactccacacttgtcagccacttgggatcctcagcttctctagcaggagggtggagggtgggtggggacagcctcctctctgtggtgctgcagatccctggggttctgggttcccagtctcctcttcccttgctgcctgcctctgtctccagctgccccaaggtgtccgtaagccaaggctgcagggcagcagcagagtgctgaaggtttgctctgccagggtgtgtgagagagagagagagtgtgtgtgtgcgtgcgcgtgcgcgtgcgcgcgactataaagcaatccccatatctggtggcttaaagaagaggggagtttgtttctccttcacttctgactgaggtgggtgccccagggcaagtggcttgcggaagatcaggtcatccctccatcttgcccctgtatgcctaagggtgaaggtcaaaaaccttttctctgaaggtgagtgtttcaggttctgtgggccatatggccctgttgtagctactcaactctgtagcgcaaaggtagccagagacagtacagagatgagtgggtgaggctgcattccaataaaactttacttgcacaaacaggctggatttggtccacaggccgtagcttacccatcctgcctggggcatcgcgtttggccatggagattgggtcctaggcaaactcatgctctaggaggaagaggaaggcagggcaagcaatgctgtttttgtagaagccaccggaaattgcaccacttctcatgttcccctggagagaacttcgtgcctacctgccaacaagggaggcttggaaagtcattctgtggccagggccctgttttgtgggggaaggggaggaagcatgctgggagacagagggcagtccctactgctgctctatctccagtggcagctcccttgtccatccctccgcgcggcctgacagcccctcagcctccatctttcccaccccctctactgggcatctcctgcagctcagcccagctctctggcccctgtagcaggggttacctttgcccaccctggagaagctccctcttcaaggagcctcgccacccaaagggcaccttgtctcagagtgtggcttgggctcttaacctgggttgatactggttgagctgtgtgacactgggtgagctttgtgatcttgggccagttacttaactgctctgtgcctctagaacatggggatagctctcgtcgtcacttcctaaggccttgtgcagatgcatgggttacccaggtaaaggaggtggcatggcacatggcacgtggcttgtaatgtggtcgcagagctccccttgtctctgtctgcagcttgctccctgtgccacccaggctctggcctgaatctgagggcttcagtcttatccagcacaggatgtatctgtaggtgggctctgtgtccccacagcctcttgagagggagggagctggtagatagtctcccacccctggcagagtccctgcataggtcttgactagctgcctctgtcccaccattctgacagcccccgcaggtaggcatggttatctatacctcatggactgggaactagaggcacagggaggtgcagtgacttgcccagggccccacagctagaagtgtcagacccaggtctgtataactcggagctcagaccctggctcctgcgagggccctgcctcccgcctgccctgccagcctgctcagggcatgggagaaccccccagtcttctgccccctagcggtcctgcagatccctgtgggaatctgggccagccccccgacccccaaccccatacatgcgcagggagctcctactcccactggaagccttcccgccagtgccccccaaccaccacaggccctagccttggctgttgtgccctgggagcccttggtgacctcggggggcaccttcatccctgtcttcactgcagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcaccgtgggagcatgagcc

SEQ ID NO: 28020 - DNA, 2098 bp, Homo sapiens
  misc_feature (1)..(1): n is a, c, g, or t
  misc_feature (3)..(4): n is a, c, g, or t
  misc_feature (7)..(7): n is a, c, g, or t
ngnncgnggcggggcggggctgagcgtgtttacatccgccgggtgcgcggcttcgccgcccgaggtcgttcggctcgggtaccatcctccgcgccatggacaccagcgacctgttcgccagctgcaggaagggggatgtgggccgagtgcggtacctgctggagcagcgagacgtggaggtgaatgtgcgggacaagtgggacagcacccccttgtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacaggccgcctggacattggcgtagagcatgtgagtgactgtgagcgcctggccaagcaatgccagctgtgggacctgctcagcgacctggaggccaagtgcgagaaggtgtctgagtttgtggcgtctaagccaggcacgtgtgtgaaggtgctgaccatcgagcccccacctgcagacccccgcctccgggaggacatggcgctgctggccgattgtgccctgccccccgagctccgaggtgatctttgggagctgcccttcccttgtcctgacggcttcaacagctgccctgacatctgcttccgagtggctggctgcagcttcctctgccacaagtgcctgtgccctcctgttgcccctggccccagcccgttgccctgagcccccgtctagctcctcaggagacagaccctggccctcacacttcctgagcccggcctcccccagggcctttttctgtggccgcagtgactacttccgagccctgctggatgaccacttccgagagagcgaggagccagcgacctcagggggccccccagccgtcaccctgcatggcatctcacccgacgtcttcactcacgtgctctactacatgtacagcgaccacactgagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcaccgtgggagcatgagcc

SEQ ID NO: 28021 - DNA, 2072 bp, Homo sapiens
  misc_feature (1)..(1): n is a, c, g, or t
  misc_feature (3)..(4): n is a, c, g, or t
  misc_feature (7)..(7): n is a, c, g, or t
ngnncgnggcggggcggggctgagcgtgtttacatccgccgggtgcgcggcttcgccgcccgaggtcgttcggctcgggtaccatcctccgcgccatggacaccagcgacctgttcgccagctgcaggaagggggatgtgggccgagtgcggtacctgctggagcagcgagacgtggaggtgaatgtgcgggacaagtgggacagcacccccttgtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacaggccgcctggacattggcgtagagcatgtgagtgactgtgagcgcctggccaagcaatgccagctgtgggacctgctcagcgacctggaggccaagtgcgagaaggtgtctgagtttgtggcgtctaagccaggcacgtgtgtgaaggtgctgaccatcgagcccccacctgcagacccccgcctccgggaggacatggcgctgctggccgattgtgccctgccccccgagctccgaggtgatctttgggagctgcccttcccttgtcctgacggcttcaacagctgccctgacatctgcttccgagtggctggctgcagcttcctctgccacaaggcctttttctgtggccgcagtgactacttccgagccctgctggatgaccacttccgagagagcgaggagccagcgacctcagggggccccccagccgtcaccctgcatggcatctcacccgacgtcttcactcacgtgctctactacatgtacagcgaccacactgagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagaaggtgggccagtggtctgcagtgggtgggaaggaggggtgagagggcaggcacccctccactgagctggcccttcccgctcatagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcaccgtgggagcatgagcc

SEQ ID NO: 28022 - DNA, 2193 bp, Homo sapiens
  misc_feature (1)..(1): n is a, c, g, or t
  misc_feature (3)..(4): n is a, c, g, or t
  misc_feature (7)..(7): n is a, c, g, or t
ngnncgnggcggggcggggctgagcgtgtttacatccgccgggtgcgcggcttcgccgcccgaggtcgttcggctcgggtaccatcctccgcgccatggacaccagcgacctgttcgccagctgcaggaagggggatgtgggccgagtgcgaccatgaacccgtcctgacccaggctctgacctccttcctgcccaggtacctgctggagcagcgagacgtggaggtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacaggccgcctggacattggcgtagagcatgtgagtgactgtgagcgcctggccaagcaatgccagctgtgggacctgctcagcgacctggaggccaagtgcgagaaggtgtctgagtttggtgcgagcagggtttggggcccggggccatgggtgcggcctggcagggctggcctggctccctgaagttgttcttcccctgtagtggcgtctaagccaggcacgtgtgtgaaggtgctgaccatcgagcccccacctgcagacccccgcctccgggaggacatggcgctgctggccgattgtgccctgccccccgagctccgaggtgatctttgggagctgcccttcccttgtcctgacggcttcaacagctgccctgacatctgcttccgagtggctggctgcagcttcctctgccacaagtgcctgtgccctcctgttgcccctggccccagcccgttgccctgagcccccgtctagctcctcaggagacagaccctggccctcacacttcctgagcccggcctcccccagggcctttttctgtggccgcagtgactacttccgagccctgctggatgaccacttccgagagagcgaggagccagcgacctcagggggccccccagccgtcaccctgcatggcatctcacccgacgtcttcactcacgtgctctactacatgtacagcgaccacactgagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcaccgtgggagcatgagcc

SEQ ID NO: 28023 - DNA, 2114 bp, Homo sapiens
gtactcccgtagcctccctgggccgctccctgacatcccgtgccactcaagagttagtgcatagtgtcaacgctgagtgggttcacagcacttccaggtgcagcctggaggcctcctttgggctgcccccgcctcagtggggctacattagcattggcgactcccctcgctcaccttccgcatcccatcagttgctgtatcccgcgactcctgcctcctagaattgtgtgccctccacaccatcaggaggcctgcagcagctttttcccgggctccctgcttctaacagggccagcttcttcctgcagtagagagctctggtgggagtgaaggctccatcacctcctctcccaaacgctgaaaggccaaaggtccagcctcggcactggctctggcttctgtccctgtagcccatcgtcccccagcactgatagcacacagtgtctgcctgttcgaccccacctccacatccttgcctgcactttgccttgagtgcctctcctgctctggtctgcctgtcacctgccctcacctgggggaggcttccccataccaaaagggatgttttctctccgttcctttccacgggccttctttctcagaccatgaacccgtcctgacccaggctctgacctccttcctgcccaggtacctgctggagcagcgagacgtggaggtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacagggcctttttctgtggccgcagtgactacttccgagccctgctggatgaccacttccgagagagcgaggagccagcgacctcagggggccccccagccgtcaccctgcatggcatctcacccgacgtcttcactcacgtgctctactacatgtacagcgaccacactgagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcaccgtgggagcatgagcc

SEQ ID NO: 28024 - DNA, 1912 bp, Homo sapiens
  misc_feature (1)..(1): n is a, c, g, or t
  misc_feature (3)..(4): n is a, c, g, or t
  misc_feature (7)..(7): n is a, c, g, or t
ngnncgnggcggggcggggctgagcgtgtttacatccgccgggtgcgcggcttcgccgcccgaggtcgttcggctcgggtaccatcctccgcgccatggacaccagcgacctgttcgccagctgcaggaagggggatgtgggccgagtgcgaccatgaacccgtcctgacccaggctctgacctccttcctgcccaggtacctgctggagcagcgagacgtggaggtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacaggccgcctggacattggcgtagagcatgtgagtgactgtgagcgcctggccaagcaatgccagctgtgggacctgctcagcgacctggaggccaagtgcgagaaggtgtctgagtttggtgcgagcagggtttggggcccggggccatgggtgcggcctggcagggctggcctggctccctgaagttgttcttcccctgtagtggcgtctaagccaggcacgtgtgtgaaggtgctgaccatcgagcccccacctgcagacccccgcctccgggaggacatggcgctgctggccgattgtgccctgccccccgagctccgaggtgatctttgggagctgcccttcccttgtcctgacggcttcaacagctgccctgacatctgcttccgagtggctggctgcagcttcctctgccacaactgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcaccgtgggagcatgagcc

SEQ ID NO: 28025 - DNA, 342 bp, Homo sapiens
ttggggcccggggccatgggtgcggcctggcagggctggcctggctccctgaagttgttcttcccctgtagtggcgtctaagccaggcacgtgtgtgaaggtgctgaccatcgagcccccacctgcagacccccgcctccgggaggacatggcgctgctggccgattgtgccctgccccccgagctccgagtaagtgcggggctggtgggcaggaagggcgttttgggatggcaggccgtgacaggcagcccagatacttgggctcaattccttgtgtggtcctggaccagttacttcccttttctgaacctagtcgttcacttctgtgaacaactgctctg

SEQ ID NO: 28026 - DNA, 1997 bp, Homo sapiens
  misc_feature (1)..(1): n is a, c, g, or t
  misc_feature (3)..(4): n is a, c, g, or t
  misc_feature (7)..(7): n is a, c, g, or t
ngnncgnggcggggcggggctgagcgtgtttacatccgccgggtgcgcggcttcgccgcccgaggtcgttcggctcgggtaccatcctccgcgccatggacaccagcgacctgttcgccagctgcaggaagggggatgtgggccgagtgcgaccatgaacccgtcctgacccaggctctgacctccttcctgcccaggtacctgctggagcagcgagacgtggaggtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacaggccgcctggacattggcgtagagcatgtgagtgactgtgagcgcctggccaagcaatgccagctgtgggacctgctcagcgacctggaggccaagtgcgagaaggtgtctgagtttgtggcgtctaagccaggcacgtgtgtgaaggtgctgaccatcgagcccccacctgcagacccccgcctccgggaggacatggcgctgctggccgattgtgccctgccccccgagctccgaggtgatctttgggagctgcccttcccttgtcctgacggcttcaacagctgccctgacatctgcttccgagtggctggctgcagcttcctctgccacaaggcctttttctgtggccgcagtgactacttccgagccctgctggatgaccacttccgagagagcgaggagccagcgacctcagggggccccccagccgtcaccctgcatggcatctcacccgacgtcttcactcacgtgctctactacatgtacagcgaccacactgagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcaccgtgggagcatgagcc

SEQ ID NO: 28027 - DNA, 848 bp, Homo sapiens
  misc_feature (1)..(1): n is a, c, g, or t
  misc_feature (3)..(4): n is a, c, g, or t
  misc_feature (7)..(7): n is a, c, g, or t
ngnncgnggcggggcggggctgagcgtgtttacatccgccgggtgcgcggcttcgccgcccgaggtcgttcggctcgggtaccatcctccgcgccatggacaccagcgacctgttcgccagctgcaggaagggggatgtgggccgagtgcggtacctgctggagcagcgagacgtggaggtgaatgtgcgggacaagtgggacagcacccccttgtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacagtgaccccctgggtccagggtaggaggagagggagtgggccgtccttctggacagcagtacacctaggtgtggctgggctgacctttcacctctagacacttcatggtccccccggggtggttccagctgcctctcgggttgggttgcaagagagaggactagtgtgcctgctcaggaagagcttgtcccacccacatgctgaggccctcccatctgttccctggggc

SEQ ID NO: 28028 - DNA, 1888 bp, Homo sapiens
  misc_feature (1)..(1): n is a, c, g, or t
  misc_feature (3)..(4): n is a, c, g, or t
  misc_feature (7)..(7): n is a, c, g, or t
ngnncgnggcggggcggggctgagcgtgtttacatccgccgggtgcgcggcttcgccgcccgaggtcgttcggctcgggtaccatcctccgcgccatggacaccagcgacctgttcgccagctgcaggaagggggatgtgggccgagtgcggtacctgctggagcagcgagacgtggaggtgaatgtgcgggacaagtgggacagcacccccttgtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacaggccgcctggacattggcgtagagcatgtgagtgactgtgagcgcctggccaagcaatgccagctgtgggacctgctcagcgacctggaggccaagtgcgagaaggtgtctgagtttgtggcgtctaagccaggcacgtgtgtgaaggtgctgaccatcgagcccccacctgcagacccccgcctccgggaggacatggcgctgctggccgattgtgccctgccccccgagctccgaggcctttttctgtggccgcagtgactacttccgagccctgctggatgaccacttccgagagagcgaggagccagcgacctcagggggccccccagccgtcaccctgcatggcatctcacccgacgtcttcactcacgtgctctactacatgtacagcgaccacactgagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcaccgtgggagcatgagcc

SEQ ID NO: 28029 - DNA, 1637 bp, Homo sapiens
  misc_feature (1)..(1): n is a, c, g, or t
  misc_feature (3)..(4): n is a, c, g, or t
  misc_feature (7)..(7): n is a, c, g, or t
ngnncgnggcggggcggggctgagcgtgtttacatccgccgggtgcgcggcttcgccgcccgaggtcgttcggctcgggtaccatcctccgcgccatggacaccagcgacctgttcgccagctgcaggaagggggatgtgggccgagtgcggtacctgctggagcagcgagacgtggaggtgaatgtgcgggacaagtgggacagcacccccttgtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacaggccgcctggacattggcgtagagcatgtgagtgactgtgagcgcctggccaagcaatgccagctgtgggacctgctcagcgacctggaggccaagtgcgagaaggtgtctgagtttgtcacgtgctctactacatgtacagcgaccacactgagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcaccgtgggagcatgagcc

SEQ ID NO: 28030 - DNA, 1750 bp, Homo sapiens
  misc_feature (1)..(1): n is a, c, g, or t
  misc_feature (3)..(4): n is a, c, g, or t
  misc_feature (7)..(7): n is a, c, g, or t
ngnncgnggcggggcggggctgagcgtgtttacatccgccgggtgcgcggcttcgccgcccgaggtcgttcggctcgggtaccatcctccgcgccatggacaccagcgacctgttcgccagctgcaggaagggggatgtgggccgagtgcggtacctgctggagcagcgagacgtggaggtgaatgtgcgggacaagtgggacagcacccccttgtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacaggccgcctggacattggcgtagagcatgtgagtgactgtgagcgcctggccaagcaatgccagctgtgggacctgctcagcgacctggaggccaagtgcgagaaggtgtctgagtttgtggcgtctaagccaggcacgtgtgtgaaggtgctgaccatcgagcccccacctgcagacccccgcctccgggaggacatggcgctgctggccgattgtgccctgccccccgagctccgaggtgatctttgggagctgcccttcccttgtcctgacggcttcaacagctgccctgacatctgcttccgagtggctggctgcagcttcctctgccacaaggcctttttctgtggccgcagtgactacttccgagccctgctggatgaccacttccgagagagcgaggagccagcgacctcagggggccccccagccgtcaccctgcatggcatctcacccgacgtcttcactcacgtgctctactacatgtacagcgaccacactgagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcaccgtgggagcatgagcc

SEQ ID NO: 28031 - DNA, 2184 bp, Homo sapiens
  misc_feature (1)..(1): n is a, c, g, or t
  misc_feature (3)..(4): n is a, c, g, or t
  misc_feature (7)..(7): n is a, c, g, or t
ngnncgnggcggggcggggctgagcgtgtttacatccgccgggtgcgcggcttcgccgcccgaggtcgttcggctcgggtaccatcctccgcgccatggacaccagcgacctgttcgccagctgcaggaagggggatgtgggccgagtgcggtacctgctggagcagcgagacgtggaggtgaatgtgcgggacaagtgggacagcacccccttgtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacaggccgcctggacattggcgtagagcatgtgagtgactgtgagcgcctggccaagcaatgccagctgtgggacctgctcagcgacctggaggccaagtgcgagaaggtgtctgagtttgtggcgtctaagccaggcacgtgtgtgaaggtgctgaccatcgagcccccacctgcagacccccgcctccgggaggacatggcgctgctggccgattgtgccctgccccccgagctccgaggtgatctttgggagctgcccttcccttgtcctgacggcttcaacagctgccctgacatctgcttccgagtggctggctgcagcttcctctgccacaagtgcctgtgccctcctgttgcccctggccccagcccgttgccctgagcccccgtctagctcctcaggagacagaccctggccctcacacttcctgagcccggcctcccccagggcctttttctgtggccgcagtgactacttccgagccctgctggatgaccacttccgagagagcgaggagccagcgacctcagggggccccccagccgtcaccctgcatggcatctcacccgacgtcttcactcacgtgctctactacatgtacagcgaccacactgagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagaaggtgggccagtggtctgcagtgggtgggaaggaggggtgagagggcaggcacccctccactgagctggcccttcccgctcatagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcaccgtgggagcatgagcc

SEQ ID NO: 28032 - DNA, 347 bp, Homo sapiens
actcctaggcacttgggttgtttttatatcttggctattgtaaataatattgtgcctgattctcttgggcacaacagttcacaggttttaatgatagaccttgaaaagtatgttcagctaaataaaaatggaaacataaaaaatcttttgaaaatgttttgaaaaggccccaactatcgttgaatgctttcagtagagagtatatattctattcagtgattaagacattatttttatcaggagactgagggagagaattgtttgaactcaggaggcggaggttgcagtgagccagggtcacgccacggtattccagcctggacaacagagtgagactccgtccaaaa

SEQ ID NO: 28033 - DNA, 740 bp, Homo sapiens
cagagaggaggtcagagtgaagcaatctaagaaggacttatctgttgttgctggttttgaagatggaggaagaagccacaactcaaggaatgcagatggtctctaaagctggaaaagacaaggaaactgattttttcccagagcctccagaagggaacacagccctcttgacgcttgagttttatttagcccagtgagtcctgtctggaccttttaactacagagctgtaagagaaatttgtgttgtctaaagctacaaagtttgtggtaatttgttatagcagtgatagaaaactaatacagccaccttaaatgtgcatacttcaggccccgcaaaacttttatcttccgctgacagggaatataaagagtacaggctttgaagttggaaaacctggtctcgtaacttacttgctgtgttactgtaggcaaatcgctgaactcttccaggccttagtttcttcacaggtacattggagataatacctacaaacctgatctattgtgcagatcaaaagagaaagtgattaataaaacttggaaagtgctctaaaaatgttcatgtgtcattttaagttgttaataaagagtattagagtgactaagtgactccaagcttattagctggaaaaatagaagtaggagagccgattctctgggacatgcctgtagtcccagttacttgggagactgaggtggggagaattgcttgagtccagcctggattccattggggagat

SEQ ID NO: 28034 - DNA, 657 bp, Homo sapiens
  misc_feature (649)..(657): n is a, c, g, or t
actccttcgacgaccagaccccaacacaagcctgatgtagaagccacttgcttcaggtagctctaaatgtactgtctcataccatggcttaaaaaaaaaaaatccaggatgagttaaaagtgttcgtggtttcatcacctagccaaggttaatgtctgggtcttccgtttctagccagagaactggaaacaaatcactgttttgctaggagctttgcatgacctcacgccctaggctgccgggtcctgggctgtcctgatgggctgtgaaatcccacccactcccagggctgccgggtcctgggctgtcctgatgggctgtgaaatcccacccactcccctccccgcgaggcaaggacagcctctgccctgcctgcctgggagcacggtatgggcttgcctaggcctcagtgtcttaacactgtggtgactgaaattccttgttttaccttcaccaagtaacccagagccaggatccttgatgactctggtaaggcagtgactacccctgctcagaatgcaagggtcgctagggaagattttagaaaaaaaaaaaggactccaaaaatggagaatctaaatgtagtcctttgaaaatgtcacccatagatcctctaccactaactgtaataaatttgaccaaatagcannnnnnnnn

SEQ ID NO: 28035 - DNA, 2002 bp, Homo sapiens
cgggttttagcatgtataggagattccaaagcagagttacctatatcaattttagtactattattttcatattctactggataagaaattacttatttggaactaagaattattcttgcaacagaagcttatcagtaacactatttgattgctttttgctgtgtgcacaggtgaggacctgtctagacttctatactatgtacattgtattaattttgttcataaattaggtaattgagttatagatactaatttaatatttaaaaaatttagattgttgattttaaatatcagaataaccaaactgtaacaacagtgctgggattttggtatttaaaaagggcagagtataccagaatattgaaaactggtattgaaatcactacatataattgaattatgaaaaagtacctttaagataataaagcactacataaatatgagctcatatcatatatttgacagtagggcattatttttacaggttaacattcaattaatctgactatgaattagaaaaatcttgaatttgtagagttcatttaactttattaaagcaatttgccaactcagctacagaaatacagaaaatattactatctggagaactacccagtcgtaagtttatcatcgttgaaattgcttaagcagagattaggtgaccattcctcaggaatagtatacgaaggattcctgcagtggtggaggtgtgtatttgattgctgtcagtgtgccttctgatactaacattctgtaattccctgctcatttatcacacaacaaaacatgagacaaaaataactccataaaatatatgttgattataccatataggttgtatacatatagactataaatatgagctttcaaaaacgttttgccattagctaataactaacaaaatcagttttattagggtggttttgtgtttatattgcatggtgttcaatgagcttatatctgtagttttcatcaaatgtggaaaattttgggccatttttgtattatttttctgccctttcctgtcctcctgggactttaattacagcctgttgtaaaccacttgatattgttccttttggttctttttttatatcttctgtcactgtatttatgttttcctttaagtaattggataggcatataatgacttttagcatacttacacagtatctttttcatttctcagtctgtttctggtgactgatttttctcctggtttcgggtttcattttctgcttcttgtaatatctactaattttatattagatgccaggcattgatgatttcacattgttggttatagatttattcttataggcagttaaattaattgcagttcagtttcttcttttcaagcctttgttagggtaagtatagagtgagcttcaccccacagagagtttaacaccatttctaaggcatagctattgtgggatcactagaaaattctgtgagtgatcagctgggacactcaacactggctagttggacctcagatgcctcacaggcctgtgtggcactctgcttgacctcgtagagttttgctctaggcttacatgtcttaatatccagccacctctcaaggggctcctatgcagatttctggaattctgtttttacatatctgttagctctctggtactctgctctgcaacttcagccacttcagcctccctgaactccagcctctgtcttctcaactacatgaaaccaccatgctttgtttgggatcccctaccctgctctgaggtctgtgcctgcaggtagaaatctagaatgatggatgggcctcacttcattcctctcaggggtcatagtcttaaggtgcatgtcaatatctgcagttgtttcatatatttttgactaattttctgtttcttcacagtaagaagctaaatctttcccctgttactctcaaagccagaagtaaaggataaagcattaaaataaaagcaaagaaaatattttaaaatctaatataaaaatccattttgctatg

SEQ ID NO: 28036 - DNA, 245 bp, Homo sapiens
tgggagtttctgtttaaattacaaaacagtgtaagattttattataaattctctttctctttatgttttattgtagaatctgtctattatgcttcttcaggaaaaagaacattaagatttattttaatttgttctaaaagtacataagaaagtgtgatttttgagtatttaagcacatctggttactaatagaagacaagagacttaatagaatgttgatcctgtaaaagctgagctcacatcat

SEQ ID NO: 28037 - DNA, 128 bp, Homo sapiens
ggcttgtgaagatttgtctatatttgttttttttaatgggggaatgaaggctggtatctcctacttagccatcttgatgacaatacctccatgtattctggagtgttttaattgtttaaaattacaaa

SEQ ID NO: 28038 - DNA, 440 bp, Homo sapiens
ccctcgaccttcagagcccctgaggacaccactgtgcattaaataatgctcacagtgatgatcctgagtaactgtgaaaagagtaaactgtgttcaatgcacttcctgcaatgagaaaaattgccatcacaaaaatgattagggctgggcatggtggctcacacctgtaatcccagcacctttgggaggccaaggcgggcggatcacctgaggccaggagtttgagaccagcctggccaatatggtgagaccccctctactaaaaaaaaaatgcaaaacttagtcggatgtggtggtgtgtgcctgtactcccagctacttggaaggctgaggcagtagaatcacttgaaccaggaggcagaggttgcagtgagctgagagcaagccactgtactccagcctgggtgacagaacaagactccgtcaaaaaaaaaaaaaat

SEQ ID NO: 28039 - DNA, 1599 bp, Homo sapiens
aaggtggatgcgcgtgaacagacgccctcgcaggccgccggaagcaaaggcgtgagcgcgcgtgcgtgcgtgtgcgggtgcgtgagcgtgagcgcgcggaggccggaagcgagcgctgcgcagtcgggtggtcgcgggccatggagggtagcttttcggatggcggagcgctgccggaggggctcgcggaagaggccgagccgcagggcgccgcctggagcggggacagtggcactgtttcccagagccacagcagcgcctcggggccgtgggaggacgagggcgcggaggacggcgcgccgggccgcgacctgccgctgcttcgccgcgccgctgcgggctacgccgcctgcctgctgcccggggccggggcgcggcccgaggtcgaggccctggacgcgagcctagaggacctgcttaccagagtggacgagttcgtgggcatgctggacatgcttcgcggcgactcgtcccacgtcgtcagcgagggcgtgccgcgcatccacgcgaaggccgccgagatgcggcgcatctacagcaggatcgaccggctggaggccttcgtgaggatggtggggggccgcgtggccaggatggaggagcaggtcaccaaggccgaggccgagctgggcaccttccccagggcgttcaagaagctcctgcacacgatgaacgtgccctcgctctttagcaagtctgctccctcgaggccacagcaagccggctacgaagcccccgtcctgtttcggaccgaagactacttcccttgttgcagtgaaaggcctcagctctgacggcctgaccactgcggcaagaggaccccagctggggtgcttacctccagtatgaagtgaattgcaaatcctgcttatggacatatatgatgttggagtgtgggattttaaagtttactttctacaaactctccgtagtatattcatgattcagtgtagaatgtatagactttatgtcttccaagtttaaaaaaagagacagggtcttggtatgttgcccagactgttcggaaactcctgggctcaagtgatccttccacctcagcctccccagtagctgggactacggggtcgccactgcacccagcctgtgtcttccagctctaatcagaaagctgcttgtcgagggcatggggaatcaaactgaatgaacttttctctgcactgtggcaaaactgttatttttatggattttactaaatggcgttaccttttcaagatttatatgtttgtataatcataagaaaattgagccattaaagccttgttattcaatcctaatagtcagttttctagaacctacttttagggtaaatggtacattatttaatattatattaaacctcctatagcgtggattgtagaccaaaggaaatggtacaatttctgagaatatatgttgattttttgtgactaattccaaagttgtatttgaaagtatgacctcacagtcttcatttgtccatagcaaacatatgtgtgtgtgtgtgtatatatatatgtgggttgccaatgtttggtttataatttaaatgttaatagaaattttgagttttattggaaatgatttccttctgaaaagagc

SEQ ID NO: 28040 - DNA, 1294 bp, Homo sapiens
aaggtggatgcgcgtgaacagacgccctcgcaggccgccggaagcaaaggcgtgagcgcgcgtgcgtgcgtgtgcgggtgcgtgagcgtgagcgcgcggaggccggaagcgagcgctgcgcagtcgggtggtcgcgggccatggagggtagcttttcggatggcggagcgctgccggaggggctcgcggaagaggccgagccgcagggcgccgcctggagcggggacagtggcactgtttcccagagccacagcagcgcctcggggccgtgggaggacgagggcgcggaggacggcgcgccgggccgcgacctgccgctgcttcgccgcgccgctgcgggctacgccgcctgcctgctgcccggggccggggcgcggcccgaggtcgaggccctggacgcgagcctagaggacctgcttaccagagtggacgagttcgtgggcatgctggacatgcttcgcggcgactcgtcccacgtcgtcagcgagggcgtgccgcgcatccacgcgaaggccgccgagatgcggcgcatctacagcaggatcgaccggctggaggccttcgtgaggatggtggggggccgcgtggccaggatggaggagcaggtcaccaaggccgaggccgagctgggcaccttccccagggcgttcaagaagctcctgcacacgatgaacgtgccctcgctctttagcaagtctgctccctcgaggccacagcaagccggctacgaagcccccgtcctgtttcggaccgaagactacttcccttgttgcagtgaaaggcctcagctctgacggcctgaccactgcggcaagaggaccccagctggggtgcttacctccagtatgaagtgaattgcaaatcctgcttatggacatatatgatgttggagtgtgggattttaaagtttactttctacaaactctccgtagtatattcatgattcagtgtagaatgtatagactttatgtcttccaagtttaaaaaaagagacagggtcttggtatgttgcccagactgttcggaaactcctgggctcaagtgatccttccacctcagcctccccagtagctgggactacggggtcgccactgcacccagcctgtgtcttccagctctaatcagaaagctgcttgtcgagggcatggggaatcaaactgaatgaacttttctctgcactgtggcaaaactgttatttttatggattttactaaatggcgttaccttttcaagatttatatgtttgtataatcataagaaaattgagccattaaagccttgttattcaatccta

SEQ ID NO: 28041 - DNA, 770 bp, Homo sapiens
ttctacaggaggctaccctgcccctgctaccctgggagaagcctcagctttctgggcagagtttgtctccctgtcatttatactctcaggctttatacatttacacagtaagttctccctcctggagggttaaaaggaataatttcaacagggtgaaggcctggcacggtggctcacaactgtaatccaaggactttgggaggctgaggtgggtggatcacctgaggtcaggaatttgagaccagcctggccaacttggtgaaaccctgtctctactaaaaacaaaaattagccaggtgaggtggcacacacctatagccccagctactgggggaggctgaggcaggagaattgcttgaacctgggaggcagaggttacagtgagctgagatggcaccactgcactccagcctaggtgacaaagcagcaagacgcagtctcaaaacaaaacaacaacaacaaaaaaaaacgggaaaacaggtacagacaatagctgcctggagttgtacagaaacttgattgggtaaccctggacctttccaggctgtggccagcagttgaccctgcctgcctttcctccattgttttcccatgtctgaccttccctgttgcaaagcagtggcctactacagggtctctctggagggagcaaggaggctcagtggccccattcagcaattcgaagtccctttaattgttttgtgcttccaacctgttttgttcccgttcagatttctctcgccttccaataaaaacttccctgtcctgtg

SEQ ID NO: 28042 - DNA, 999 bp, Homo sapiens
ttctacaggaggctaccctgcccctgctaccctgggagaagcctcagctttctgggcagagtttgtctccctgtcatttatactctcaggctttatacatttacacagtaagttctccctcctggagggttaaaaggaataatttcaacagggtgaaggcctggcacggtggctcacaactgtaatccaaggactttgggaggctgaggtgggtggatcacctgaggtcaggaatttgagaccagcctggccaacttggtgaaaccctgtctctactaaaaacaaaaattagccaggtgaggtggcacacacctatagccccagctactgggggaggctgaggcaggagaattgcttgaacctgggaggcagaggttacagtgagctgagatggcaccactgcactccagcctaggtgacaaagcagcaagacgcagtctcaaaacaaaacaacaacaacaaaaaaaaacgggaaaacaggtacagacaatagctgcctggagttgtacagaaacttgattgggtaaccctggacctttccaggctgtggccagcagttgaccctgcctgcctttcctccattgttttcccatgtctgaccttccctgttgcaaagcagtggcctactacagggtctctctggagggagcaaggaggctcagtggccccattcagcaattcgaagtccctttaattgttttgtgcttccaacctgttttgttcccgttcagatttctctcgccttccaataaaaacttccctgtcctgtgccccagtccctcagagtccacaagaggttcaacttgctcatctgatgtgtgaattacatcacacagttgaatgagaatttgttaattacaacagaacttttataaatatgtcacttactgtatccaattgtacaattgtccatgggtggcttaatcccaccatggcaaataagcgtctgtttatgcaaccctaatcagtgctgagaaagatcagagctcaactagaatg

SEQ ID NO: 28043 - DNA, 125 bp, Homo sapiens
ttgattacaagcccgtcaagagtattgttagatgattgcatgagcttgagaaagagttctaaaaatgattactatgcttctcagtccactctaacccccagactgtgtattttttcacttggaca

SEQ ID NO: 28044 - DNA, 1313 bp, Homo sapiens
gactattttcaaaatagggcataatgtgaagactattttcaaaaaggaaatacatgtgaagactattttcaaaaagaaaaggcatgccagtcataatgatataccaacacagtgtaggtgcttgatacaaaatgccctttggttatttggagaggtattaaatttagtatgcctcacatggaataaaaataatttatttttgaaattatatttaaaaactaaaattaaaaaaataactttcaaacatagcttataattttttctataagactttgaaggagatacgcaattttgtgttcccatattatttaaaagaatgtatctaggaaaaacatttcattcggaaggagaagattgagtatagtttctttttaattagtaagcttttaattgacacatcatgcaagttaaaatgtatacaaattaagcatgttcatgcaataaatttccacaaagcaaaatactcatgtgatcacaattaactatggttttaaagatcatttttttgttttagtttgcaaaataatattatgaagtcataagaatttaaatatgattgcaatttacaatacatttttattaataaaagttgtaaagacctttgttactattgctctgtggtttacaaagaagataattgtgaacactgggatcccgttgggttcctatagattcccctgcagctgggtgttttagggcatagaattacatatgtgactattgtgacttttatttcaactggactctaaggaatacttttcattagtagtcatttaagatttcctggaagctcttctctgtgatttgaaaaattctctggataatatttccaaattgatgaccttctggagttaaaacaactttttctttggtctagctttaaagatatctttattttctattccattcatcaccattttttcattgaaaaaattaaccatgcttatcccacttcaaatgagcagctgcactttgaaactagatccttcttttggctgtaattgtccaaatgaggaggaccaggtttgtggactatttgaaaagaattggttgtgactcaaagcatttttctgctttcaatttttctcttcaaattttagtgtattcccaagccagaaaaaaaaagaaagaaagaaggaaagagggagggagaaaaggaagaaggaagaaaagaaggaagggctgggcaaggtggctcctgcctgtaatcccagcactttgggaggccaacgcagggttattacttgaggccagcagtttgagactaccctgggcaacatagcaagaccctgtctctatcaaaaattaaaaaa

SEQ ID NO: 28045 - DNA, 667 bp, Homo sapiens
tctgaaataacattttacatttgttgttggtcttgtcttaagcaaatgggattatatttagttatgcagatttaggaagggctcttccttccttctcaaataaaaataaccaggaaaaagcagtcgttttcatatgttctacctgggacattcattatagtctgggtacagcattgtatgtatcttgaaaactactgtactacctttgacagtgaggtgttttacccatagttcaaaattgctgttactgcctagagatgacactgctgtgaatagtataccttattcgaaggcttggtgcttttaggcatggactggtggcatctcttggacaaggcattgcaattgccctggaggactggccaaacaagttttcatgttgaaaagctgagtaaaaatgactctgggtgtaggccaatatagtatcactcgggaaaaagaaaagcacaatatgcctctccctgggaagcagtttggccagggcaaagctcccagaaatggaaatttaagcttgttgatttgggaaactcttggtatttgcccctcagcctttgtgaaatggatcttctttttaaaggggggaggggtaggatagaggagacttaaaggcttaaaataatgtcccctctgaaccatctaatcacctccttagaactaagcaggtaag

SEQ ID NO: 28046 - DNA, 351 bp, Homo sapiens
gtggacacatttaagcaatagcaaatagtgtccccccaaaagatatatccaagctctaactcctagtacctgtgaatatgacctttgcagatataactacatctttgcagatataattaagttaaggatcttgagatgagatcattctaaatcaaatgcctggtgtacttataagtagaggagaagccacaaagacacagaaaagactgtgctgtgaaaatgatggaagagattggagggcagccacaagccaaggaataccaaggatcagaagctaagagagaggcatagagtggattctccctcagagccttccaagagtgagtggctctaccatactgattttgtact

SEQ ID NO: 28047 - DNA, 492 bp, Homo sapiens
aaattaagtttttgtgatgtgttaatcatccaccttagaaataggctatcagctaatttggtggtcagtgctagagatagtgtgataggggcttttgcatacctgtgaaataaatggtgtgtgttttttttttttttttaggcagaatctctgtcatcctggctggagtgcagtagcatcatcttggctcactgcaacctccaccttccaggttcaagggattctcatgcttcaagcctcaagcctgggattacaggcgtctgccatcatgcatggctaatttttgtgtttttagtagggacacggtttcaccatgttggccaggctggtcttgaactgctgacatcaggtgatccgccctcctcagcctcccaaagtgctgggattacaggcgtgagccaccacacccggccgcgtttcttttttttaataagttctctcagaaaggatgacaacatgtccaaagtcattcatctattaagatggtatgag

SEQ ID NO: 28048 - DNA, 503 bp, Homo sapiens
ctttctgatctggatgcctttcatttcgttttcttgtctaattacccttgctagagtatccagtatgatggtgaatggcagtggtgcagtgggcatccttgtcttgttgctgatcttaggggaaagcttttggccttcggccataaagtatcaagttagctgtgggtttttgtagttgcccttaatcagattgaggaaattcccttgtattcctagttggttgaatgtttttatcttgagatattaacttctttaaagttttgttttactttttaatataaaaattttggtgtgtgtgttttattccaaccagtgctgattcctaaagaaaagcccccaatcacggttgtgggtgatgttggaggaaggattgccatcatcgtggtatgtagacctcttttattattaattctagtatttgccattgttattctgttgattgattgattgattgattttattacagagatctagcctgggcgaaagagtgagattccatctca

SEQ ID NO: 28049 - DNA, 551 bp, Homo sapiens
gcaagacatgcaaaagtttaagaatgaggtcaacacattagaagaagagttcctggctttgaagaaagaaaatgttcaacttcataaagaggttgaagaagaaatggagaagcacagaagtaatagcacagaattatcaggaaccctaactgatggtactactgttggcaatgatgatgatggactaaatcagcagattcctaggaaggaaaatgaagagcatgacagcctgcagataaaacagctaatgaaaagaacaaggtcaaaaaccaaatatatcctgaggctgactttgctgactcaatgaagccatctgaaatagcctcagaggattgtgaattgtctcactctgtttatgagaattttatgttgctgattgaacaacttagaatggagtataaagattctgctagcctaccaagaatccaagacacattttgtttgtgtgaacacttactgaaacttaagaataatcactgtgaccaacttacagtaaaacttaaacaaatggaaaatatggtcagtgtactacaaaatgagctatctgaaac

SEQ ID NO: 28050 - DNA, 1910 bp, Homo sapiens
agcgggccagccacagcagagaggtgggggttgtgaccggagttagatgccagcgcagaagggacgtgagcccagccgaggaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacgagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatctacacgctgtgaatgttgaaatgt

SEQ ID NO: 28051 - DNA, 2119 bp, Homo sapiens
agcgggccagccacagcagagaggtgggggttgtgaccggagttagatgccagcgcagaagggacgtgagcccagccgaggtaccgctgaagaggaatcaattttggtatgcagataatcactgggctcatgggtcttgctctttacaaagagaattcagcggggtgccaagtcgttttctgtgtgggttgagagacaggctgtgcagcccactgttgcataggactaactactacaaatcatgctgagaccgagctatttttgctgcttagaggctttgcagccttgagaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacgagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatctacacgctgtgaatgttgaaatgt

SEQ ID NO: 28052 - DNA, 2121 bp, Homo sapiens
cgcccctccccgcccaccggcctcgcagtcaccgcggacgccaatcttgtgcatggagtcgccattttgctcctagagaggccgccagaagacccggcgctttcttccttctgcagctgaggctgcggcggggccggggctggggtcggggccagaattcagcggggtgccaagtcgttttctgtgtgggttgagagacaggctgtgcagcccactgttgcataggactaactactacaaatcatgctgagaccgagctatttttgctgcttagaggctttgcagccttgagaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacgagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatctacacgctgtgaatgttgaaatgt

SEQ ID NO: 28053 - DNA, 1983 bp, Homo sapiens
agcgggccagccacagcagagaggtgggggttgtgaccggagttagatgccagcgcagaagggacgtgagcccagccgaggtaccgctgaagaggaatcaattttggtatgcagataatcactgggctcatgggtcttgctctttacaaagaggaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacgagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatctacacgctgtgaatgttgaaatgt

SEQ ID NO: 28054 - DNA, 1907 bp, Homo sapiens
cgcccctccccgcccaccggcctcgcagtcaccgcggacgccaatcttgtgcatggagtcgccattttgctcctagagaggccgccagaagacccggcgctttcttccttctgcagctgaggctgcggcggggccggggctggggtcggggccaggaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacgagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttcta

SEQ ID NO: 28055 - DNA, 1836 bp, Homo sapiens
cgcccctccccgcccaccggcctcgcagtcaccgcggacgccaatcttgtgcatggagtcgccattttgctcctagagaggccgccagaagacccggcgctttcttccttctgcagctgaggctgcggcggggccggggctggggtcggggccaggctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagaaaacgagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatctacacgctgtgaatgttgaaatgt

SEQ ID NO: 28056 - DNA, 1932 bp, Homo sapiens
cgcccctccccgcccaccggcctcgcagtcaccgcggacgccaatcttgtgcatggagtcgccattttgctcctagagaggccgccagaagacccggcgctttcttccttctgcagctgaggctgcggcggggccggggctggggtcggggccaggaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagaaaacgagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatctacacgctgtgaatgttgaaatgt

SEQ ID NO: 28057 - DNA, 1685 bp, Homo sapiens
cgcccctccccgcccaccggcctcgcagtcaccgcggacgccaatcttgtgcatggagtcgccattttgctcctagagaggccgccagaagacccggcgctttcttccttctgcagctgaggctgcggcggggccggggctggggtcggggccagaaacgagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatctacacgctgtgaatgttgaaatgt

SEQ ID NO: 28058 - DNA, 1869 bp, Homo sapiens
cgcccctccccgcccaccggcctcgcagtcaccgcggacgccaatcttgtgcatggagtcgccattttgctcctagagaggccgccagaagacccggcgctttcttccttctgcagctgaggctgcggcggggccggggctggggtcggggccaggaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacgagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctgatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatctacacgctgtgaatgttgaaatgt

SEQ ID NO: 28059 - DNA, 1853 bp, Homo sapiens
cgcccctccccgcccaccggcctcgcagtcaccgcggacgccaatcttgtgcatggagtcgccattttgctcctagagaggccgccagaagacccggcgctttcttccttctgcagctgaggctgcggcggggccggggctggggtcggggccaggaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacgagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtggtggtcaccaatacaattccacatgaagtccagaagctccagtgccccaagattaaaactgtggatatcagcatgatcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttcta

SEQ ID NO: 28060 - DNA, 1069 bp, Homo sapiens
gctgccatggggcacggtgatggggacatggggccatgccgtctgcacaaggccaagtggaagagcagatttttcacggtaaatgtaggcagaccctttttttttcctggttgtctaacctattattgtagaagtgctcatatacattcttttccatctgtgctttggcaggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatctacacgctgtgaatgttgaaatgt

SEQ ID NO: 28061 - DNA, 1519 bp, Homo sapiens
attttttttctactttttaacttatgaatggtgctgcagtaaacatttgtgtacaagtttttgtgtggacatgtgttttctcttctcttggatacgtacctaggtttagaactgccaggtcatacagtaacttcatgtttaaactttcaaggagctgccagactgtttttcaaagcagctgcgccattttacattcccacagccgtgagttgggggggggctccagtttctctgcatccctccagtacttgttattatcttttttgccatacctatcctagtgggtgtgaggttatcaaatcttaacctaagaaacacaggctgggcgcggtggctcacgcctgtaatcccagcactttgggaggccgaggccggtggatcatgaggtcaggaggtcgagaccatcctggctaacgcggtgaaaccccgtctctactaaaaatacaaaaaaattacttgagcgtggtggcgggcgcctgtcgtcccagcttacttgggaggctgaagcaggagaatggcatgaacccaggaggcagagcttgcagtgagctgagatggcatcactgcactccaggctgagcgacagagcaagactccgtctaaaaataaataaataaataaataattgaaacattgacttgagacatagatccactgtgttttcctgtcgtggcaagcctcagatttgagaagctgtcacatttccagatcaaaccatgaagctacttggctttctgatgctgtggttttttttcttttgcttcacaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatctacacgctgtgaatgttgaaatgt

SEQ ID NO: 28062 - DNA, 1465 bp, Homo sapiens
attttttttctactttttaacttatgaatggtgctgcagtaaacatttgtgtacaagtttttgtgtggacatgtgttttctcttctcttggatacgtacctaggtttagaactgccaggtcatacagtaacttcatgtttaaactttcaaggagctgccagactgtttttcaaagcagctgcgccattttacattcccacagccgtgagttgggggggggctccagtttctctgcatccctccagtacttgttattatcttttttgccatacctatcctagtgggtgtgaggttatcaaatcttaacctaagaaacacaggctgggcgcggtggctcacgcctgtaatcccagcactttgggaggccgaggccggtggatcatgaggtcaggaggtcgagaccatcctggctaacgcggtgaaaccccgtctctactaaaaatacaaaaaaattacttgagcgtggtggcgggcgcctgtcgtcccagcttacttgggaggctgaagcaggagaatggcatgaacccaggaggcagagcttgcagtgagctgagatggcatcactgcactccaggctgagcgacagagcaagactccgtctaaaaataaataaataaataaataattgaaacattgacttgagacatagatccactgtgttttcctgtcgtggcaagcctcagatttgagaagctgtcacatttccagatcaaaccatgaagctacttggctttctgatgctgtggttttttttcttttgcttcacaggtggtggtcaccaatacaattccacatgaagtccagaagctccagtgccccaagattaaaactgtggatatcagcatgatcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatctacacgctgtgaatgttgaaatgt

SEQ ID NO: 28063 - DNA, 1011 bp, Homo sapiens
cgcccctccccgcccaccggcctcgcagtcaccgcggacgccaatcttgtgcatggagtcgccattttgctcctagagaggccgccagaagacccggcgctttcttccttctgcagctgaggctgcggcggggccggggctggggtcggggccaggaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatctacacgctgtgaatgttgaaatgt

SEQ ID NO: 28064 - DNA, 630 bp, Homo sapiens
agcgggccagccacagcagagaggtgggggttgtgaccggagttagatgccagcgcagaagggacgtgagcccagccgaggtaccgctgaagaggaatcaattttggtatgcagataatcactgggctcatgggtcttgctctttacaaagagaattcagcggggtgccaagtcgttttctgtgtgggttgagagacaggctgtgcagcccactgttgcataggactaactactacaaatcatgctgagaccgagctatttttgctgcttagaggctttgcagccttgagtaagtttcttcatctggaaacctagcttccctgtctaaaatgggtctcattctagtgcttgcttcactgggttgtcataagcattgtgaacactcagatgttaggcatgagttaacattgtgttggagagataagcagagcctgggatcatacaggagtggaagagtaattcggtttagaatttgcccttcaaattctcatcaatattgatattaaaaacagatttccttggagtgaggcacatcactaataaacatacataataagtttttttatttttattttttttgcagagtcattgctctccagcctgggcaacaagagtgaaactccatcttaa

SEQ ID NO: 28065 - DNA, 420 bp, Homo sapiens
acaaaaacaaaactatttattgcttgtgtctgctttattttcaaaggtctaactcatcttattactatggatttacaccagaaggaaattcagggcttcttcaatattcctgttgacaatttaagagcatctcccttcttattacagtatattcaagaagaggtgagctagctcaaacttttttattttaacattctgattaaggttgaaagatgtatttccatttccttaggatacccctaaaggattaaaacttgatgtattgtacttaaagtaccattatactttatagctataatccaacgcattttagaattctgaatctgcagtttgtttctttagataagctcttaaaattgctttttcttttggacctcaagtacctagaattggactagatatgattgtaatgagtaattt

SEQ ID NO: 28066 - DNA, 1985 bp, Homo sapiens
cgcccctccccgcccaccggcctcgcagtcaccgcggacgccaatcttgtgcatggagtcgccattttgctcctagagaggccgccagaagacccggcgctttcttccttctgcagctgaggctgcggcggggccggggctggggtcggggccaggaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacgagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatctacacgctgtgaatgttgaaatgt

SEQ ID NO: 28067 - DNA, 1889 bp, Homo sapiens
cgcccctccccgcccaccggcctcgcagtcaccgcggacgccaatcttgtgcatggagtcgccattttgctcctagagaggccgccagaagacccggcgctttcttccttctgcagctgaggctgcggcggggccggggctggggtcggggccaggctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacgagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatctacacgctgtgaatgttgaaatgt

SEQ ID NO: 28068 - DNA, 1953 bp, Homo sapiens
agcgggccagccacagcagagaggtgggggttgtgaccggagttagatgccagcgcagaagggacgtgagcccagccgaggtaccgctgaagaggaatcaattttgatgaggaaacaagctcagagggttgaaatgacttgtccaaggttacaggccagtggaggcttgaacccaggaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagaaaacgagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatctacacgctgtgaatgttgaaatgt

SEQ ID NO: 28069 - DNA, 1962 bp, Homo sapiens
gcaagacatgcaaaagtttaagaatgaggtcaacacattagaagaagagttcctggctttgaagaaagaaaatgttcaacttcataaagaggttgaagaagaaatggagaagcacagaagtaatagcacagaattatcaggaaccctaactgatggtactactgttggcaatgatgatgatggactaaatcagcagattcctaggaaggaaaatgaagagcatgacaggctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacgagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatctacacgctgtgaatgttgaaatgt

SEQ ID NO: 28070 - DNA, 1706 bp, Homo sapiens
agcgggccagccacagcagagaggtgggggttgtgaccggagttagatgccagcgcagaagggacgtgagcccagccgaggtaccgctgaagaggaatcaattttgatgaggaaacaagctcagagggttgaaatgacttgtccaaggttacaggccagtggaggcttgaacccagaaacgagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatctacacgctgtgaatgttgaaatgt

SEQ ID NO: 28071 - DNA, 1590 bp, Homo sapiens
agcgggccagccacagcagagaggtgggggttgtgaccggagttagatgccagcgcagaagggacgtgagcccagccgaggtaccgctgaagaggaatcaattttgatgaggaaacaagctcagagggttgaaatgacttgtccaaggttacaggccagtggaggcttgaacccagaaacgagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctgatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatctacacgctgtgaatgttgaaatgt

SEQ ID NO: 28072 - DNA, 552 bp, Homo sapiens
gcaagacatgcaaaagtttaagaatgaggtcaacacattagaagaagagttcctggctttgaagaaagaaaatgttcaacttcataaagaggttgaagaagaaatggagaagcacagaagtaatagcacagaattatcaggaaccctaactgatggtactactgttggcaatgatgatgatggactaaatcagcagattcctaggaaggaaaatgaagagcatgacaggtaagcctatagcagcgtttaacaggagacaattggtcaagcgtggtggctcacgcctgtaatccagcaatttgggaggccaaggcgggtgaatcacctgaggtcaggagttcaagaccagcctgaccaacatggataaaccccatctctactaaaaatacaaaattagccaggtgtagtggtgcatgcttgtaatcccagttactcaggaggctgaggcaagagaatcgtttgaacctgggaggcggggttgtggtgagccgtgatcatgccattgcactcgagcctgggcaacaagagtaaaactccatttcaaaaaaaaaa

SEQ ID NO: 28073 - DNA, 567 bp, Homo sapiens
ttataatattattttttattatatgttattatttattaatcaatcactttaggtatatgagaaaatattgactcctatctggccttcatcaactgacctcgaaaagcctcatgagatgctttttcttaatgtgattttgttcagcctcactgtttttaccttaatttcaactgcccacacacttgaccgtgcagtcaggagtgactggcttctccttgtcctcatttatgcatgtttggaggagctgattcctgaactcatatttaatctctactgccagggaaatgctacattatttttctaattggaagtataattagagtgatgttggtagggtagaaaaagagggagtcacttgatgctttcaggttaatcagagctatgggtgctacaggcttgtctttctaagtgacatattcttatctaattctcagatcaggttttgaaagctttgggggtctttttagattttaatccctactttctttatggtacaaatatgtacaaaagaaaaaggtcttatattcttttacacaaatttataaataaattttgaactccttctgt

SEQ ID NO: 28074 - DNA, 1702 bp, Homo sapiens
ccagctcaagtcaacatcctgggctgttaacccgcgataaggtcggacggggcctcagtggagaatacgtggggaagttctctggggcgggcgcagtctgctgctgattctgagaaaccgaaactcagctgttaaaaccgctgcctctgcactttggaatcccatctggagactcgctaagcgtcccagccgcatccctcccgcagcgacggcggcccgggacccgcgggctgtgaaccatgaacacccgcaatagagtggtgaactccgggctcggcgcctcccctgcctcccgcccgacccgggatccccaggacccttctgggcggcaaggggagctgagccccgtggaagaccagagagagggtttggaggcagcccctaagggcccttcgcgggagagcgtcgtgcacgcgggccagaggcgcacaagtgcatacaccttgatagcaccaaatataaaccggagaaatgagatacaaagaattgcggagcaggagctggccaacctggagaagtggaaggagcagaacagagctaaaccggttcacctggtgcccagacggctaggtggaagccagtcagaaactgaagtcagacagaaacaacaactccagctgatgcaatctaaatacaagcaaaagctaaaaagagaagaatctgtaagaatcaagaaggaagctgaagaagctgaactccaaaaaatgaaggcaattcagagagagaagagcaataaactggaggagaaaaaaagacttcaagaaaaccttagaagagaagcatttagagagcatcagcaatacaaaaccgctgagttcttgagcaaactgaacacagaatcgccagacagaagtgcctgtcaaagtgctgtttgtggcccacaatcctcaacatgggccagaagctgggcttacagagattctctaaaggcagaagaaaacagaaaattgcaaaagatgaaggatgaacaacatcaaaagagtgaattactggaactgaaacggcagcagcaagagcaagaaagagccaaaatccaccagactgaacacaggagggtaaataatgcttttctggaccgactccaaggcaaaagtcaaccaggtggcctcgagcaatctggaggctgttggaatatgaatagcggtaacagctggggttctctattagttttttcgaggcacctaagggtatatgagaaaatattgactcctatctggccttcatcaactgacctcgaaaagcctcatgagatgctttttcttaatgtgattttgttcagcctcactgtttttaccttaatttcaactgcccacacacttgaccgtgcagtcaggagtgactggcttctccttgtcctcatttatgcatgtttggaggagctgattcctgaactcatatttaatctctactgccagggaaatgctacattatttttctaattggaagtataattagagtgatgttggtagggtagaaaaagagggagtcacttgatgctttcaggttaatcagagctatgggtgctacaggcttgtctttctaagtgacatattcttatctaattctcagatcaggttttgaaagctttgggggtctttttagattttaatccctactttctttatggtacaaatatgtacaaaagaaaaaggtcttatattcttttacacaaatttataaataaattttgaactccttctgt

SEQ ID NO: 28075 - DNA, 997 bp, Homo sapiens
agagaaccacttgaatgaaaagcaggaacagagatcgatgggcgatctatttcccagcaataaactggaggagaaaaaaagacttcaagaaaaccttagaagagaagcatttagagagcatcagcaatacaaaaccgctgagttcttgagcaaactgaacacagaatcgccagacagaagtgcctgtcaaagtgctgtttgtggcccacaatcctcaacatgggccagaagctgggcttacagagattctctaaaggcagaagaaaacagaaaattgcaaaagatgaaggatgaacaacatcaaaagagtgaattactggaactgaaacggcagcagcaagagcaagaaagagccaaaatccaccagactgaacacaggagggtaaataatgcttttctggaccgactccaaggcaaaagtcaaccaggtggcctcgagcaatctggaggctgttggaatatgaatagcggtaacagctggggtatatgagaaaatattgactcctatctggccttcatcaactgacctcgaaaagcctcatgagatgctttttcttaatgtgattttgttcagcctcactgtttttaccttaatttcaactgcccacacacttgaccgtgcagtcaggagtgactggcttctccttgtcctcatttatgcatgtttggaggagctgattcctgaactcatatttaatctctactgccagggaaatgctacattatttttctaattggaagtataattagagtgatgttggtagggtagaaaaagagggagtcacttgatgctttcaggttaatcagagctatgggtgctacaggcttgtctttctaagtgacatattcttatctaattctcagatcaggttttgaaagctttgggggtctttttagattttaatccctactttctttatggtacaaatatgtacaaaagaaaaaggtcttatattcttttacacaaatttataaataaattttgaactccttctgt

SEQ ID NO: 28076 - DNA, 398 bp, Homo sapiens
aattaaggatatgtcaccatttaaagactgatagatgaggactgagcttctccaaagaatgaaagaggaaagctatgcctcaattcacagaggcttggaggaaatatcggaaccagtaaaaagccagagacagagtaaacaaggaggaaggcagaaattatgataaaaccaagccatggaaagaagcagtggtttcttgaaatgtcatatagacacttaagcagtaggcccccaataagtgtgtatgttaggtggattgatttttattttttaatcattgttaatttaaatcagtcttctcatatttcttaacatatacatttattcttcaataattgcttttatatgtaaaaaatatatttttttatttttctagggttctctattagttttttcga

SEQ ID NO: 28077 - DNA, 309 bp, Homo sapiens
aaagagacagaccaaggaagaaacacaaagacagaaatttcacgggcagaagacgtagcccggccattctctgtgatctaagtagcttgaagtaacaacctataatcatggtgaggtatagcacaaacaatactgtaatttgcctttcatcataattttgtgttccagagttcagactgaaaaatggtaactgtttttgttctctgtaatttcaatacaatttagctaaaaagagaagaatctgtaagaatcaagaaggaagctgaagaagctgaactccaaaaaatgaaggcaattcagagagagaag

SEQ ID NO: 28078 - DNA, 302 bp, Homo sapiens
ttttttttctctttgtacctttacaggccagaagctgggcttacagagattctctaaaggcagaagaaaacagaaaattgcaaaagatgaaggatgaacaacatcaaaaggtacttacaagcccctactagttattgctaactgtttatttgaggtactagataattttgaagaatttctgaacagaaatatttagacacatgaaaatcctgaaaacaagaatacaagcattgaaaataaaaggtgagtttctggatgtgttttaagagtatggtggtggctccttctggtcaaaactttca

SEQ ID NO: 28079 - DNA, 306 bp, Homo sapiens
tatttaatctctactgccagggaaatgctacattatttttctaattggaagtataattagagtgatgttggtagggtagaaaaagagggagtcacttgatgctttcaggttaatcagagctatgggtgctacaggcttgtctttctaagtgacatattcttatctaattctcagatcaggttttgaaagctttgggggtctttttagattttaatccctactttctttatggtacaaatatgtacaaaagaaaaaggtcttatattcttttacacaaatttataaataaattttgaactccttctg

SEQ ID NO: 28080 - DNA, 1670 bp, Homo sapiens
ccagctcaagtcaacatcctgggctgttaacccgcgataaggtcggacggggcctcagtggagaatacgtggggaagttctctggggcgggcgcagtctgctgctgattctgagaaaccgaaactcagctgttaaaaccgctgcctctgcactttggaatcccatctggagactcgctaagcgtcccagccgcatccctcccgcagcgacggcggcccgggacccgcgggctgtgaaccatgaacacccgcaatagagtggtgaactccgggctcggcgcctcccctgcctcccgcccgacccgggatccccaggacccttctgggcggcaaggggagctgagccccgtggaagaccagagagagggtttggaggcagcccctaagggcccttcgcgggagagcgtcgtgcacgcgggccagaggcgcacaagtgcatacaccttgatagcaccaaatataaaccggagaaatgagatacaaagaattgcggagcaggagctggccaacctggagaagtggaaggagcagaacagagctaaaccggttcacctggtgcccagacggctaggtggaagccagtcagaaactgaagtcagacagaaacaacaactccagctgatgcaatctaaatacaagcaaaagctaaaaagagaagaatctgtaagaatcaagaaggaagctgaagaagctgaactccaaaaaatgaaggcaattcagagagagaagagcaataaactggaggagaaaaaaagacttcaagaaaaccttagaagagaagcatttagagagcatcagcaatacaaaaccgctgagttcttgagcaaactgaacacagaatcgccagacagaagtgcctgtcaaagtgctgtttgtggcccacaatcctcaacatgggccagaagctgggcttacagagattctctaaaggcagaagaaaacagaaaattgcaaaagatgaaggatgaacaacatcaaaagagtgaattactggaactgaaacggcagcagcaagagcaagaaagagccaaaatccaccagactgaacacaggagggtaaataatgcttttctggaccgactccaaggcaaaagtcaaccaggtggcctcgagcaatctggaggctgttggaatatgaatagcggtaacagctggggtatatgagaaaatattgactcctatctggccttcatcaactgacctcgaaaagcctcatgagatgctttttcttaatgtgattttgttcagcctcactgtttttaccttaatttcaactgcccacacacttgaccgtgcagtcaggagtgactggcttctccttgtcctcatttatgcatgtttggaggagctgattcctgaactcatatttaatctctactgccagggaaatgctacattatttttctaattggaagtataattagagtgatgttggtagggtagaaaaagagggagtcacttgatgctttcaggttaatcagagctatgggtgctacaggcttgtctttctaagtgacatattcttatctaattctcagatcaggttttgaaagctttgggggtctttttagattttaatccctactttctttatggtacaaatatgtacaaaagaaaaaggtcttatattcttttacacaaatttataaataaattttgaactccttctgt

SEQ ID NO: 28081 - DNA, 1056 bp, Homo sapiens
ccagctcaagtcaacatcctgggctgttaacccgcgataaggtcggacggggcctcagtggagaatacgtggggaagttctctggggcgggcgcagtctgctgctgattctgagaaaccgaaactcagctgttaaaaccgctgcctctgcactttggaatcccatctggagactcgctaagcgtcccagccgcatccctcccgcagcgacggcggcccgggacccgcgggctgtgaaccatgaacacccgcaatagagtggtgaactccgggctcggcgcctcccctgcctcccgcccgacccgggatccccaggacccttctgggcggcaaggggagctgagccccgtggaagaccagagagagggtttggaggcagcccctaagggcccttcgcgggagagcgtcgtgcacgcgggccagaggcggtaggagcaagcctacgtcccagcaagactcgcagataaactagcctcttacaaccagaggagtggagctgagagagtgaggagcacaagtgcatacaccttgatagcaccaaatataaaccggagaaatgagatacaaagaattgcggagcaggagctggccaacctggagaagtggaaggagcagaacagagctaaaccggttcacctggtgcccagacggctaggtggaagccagtcagaaactgaagtcagacagaaacaacaactccagctgatgcaatctaaatacaagcaaaagctaaaaagagaagaatctgtaagaatcaagaaggaagctgaagaagctgaactccaaaaaatgaaggcaattcagagagagaagagcaataaactggaggagaaaaaaagacttcaagaaaaccttagaagagaagcatttagagagcatcagcaatacaaaaccgctgagttcttgagcaaactgaacacagaatcgccagacagaagtgcctgtcaaagtgctgtttgtggcccacaatcctcaacatggaaacttcctatcctgcctagggatcacagtgtgcccaagaagctgggttacagagcattctctaagggcagaagac

SEQ ID NO: 28082 - DNA, 1703 bp, Homo sapiens
ccagctcaagtcaacatcctgggctgttaacccgcgataaggtcggacggggcctcagtggagaatacgtggggaagttctctggggcgggcgcagtctgctgctgattctgagaaaccgaaactcagctgttaaaaccgctgcctctgcactttggaatcccatctggagactcgctaagcgtcccagccgcatccctcccgcagcgacggcggcccgggacccgcgggctgtgaaccatgaacacccgcaatagagtggtgaactccgggctcggcgcctcccctgcctcccgcccgacccgggatccccaggacccttctgggcggcaaggggagctgagccccgtggaagaccagagagagggtttggaggcagcccctaagggcccttcgcgggagagcgtcgtgcacgcgggccagaggcgcacaagtgcatacaccttgatagcaccaaatataaaccggagaaatgagatacaaagaattgcggagcaggagctggccaacctggagaagtggaaggagcagaacagagctaaaccggttcacctggtgcccagacggctaggtggaagccagtcagaaactgaagtcagacagaaacaacaactccagctgatgcaatctaaatacaagcaaaagctaaaaagagaagaatctgtaagaatcaagaaggaagctgaagaagctgaactccaaaaaatgaaggcaattcagagagagaagagcaataaactggaggagaaaaaaagacttcaagaaaaccttagaagagaagcatttagagagcatcagcaatacaaaaccgctgagttcttgagcaaactgaacacagaatcgccagacagaagtgcctgtcaaagtgctgtttgtggcccacaatcctcaacatggaaacttcctatcctgcctagggatcacagctgggccagaagctgggcttacagagattctctaaaggcagaagaaaacagaaaattgcaaaagatgaaggatgaacaacatcaaaagagtgaattactggaactgaaacggcagcagcaagagcaagaaagagccaaaatccaccagactgaacacaggagggtaaataatgcttttctggaccgactccaaggcaaaagtcaaccaggtggcctcgagcaatctggaggctgttggaatatgaatagcggtaacagctggggtatatgagaaaatattgactcctatctggccttcatcaactgacctcgaaaagcctcatgagatgctttttcttaatgtgattttgttcagcctcactgtttttaccttaatttcaactgcccacacacttgaccgtgcagtcaggagtgactggcttctccttgtcctcatttatgcatgtttggaggagctgattcctgaactcatatttaatctctactgccagggaaatgctacattatttttctaattggaagtataattagagtgatgttggtagggtagaaaaagagggagtcacttgatgctttcaggttaatcagagctatgggtgctacaggcttgtctttctaagtgacatattcttatctaattctcagatcaggttttgaaagctttgggggtctttttagattttaatccctactttctttatggtacaaatatgtacaaaagaaaaaggtcttatattcttttacacaaatttataaataaattttgaactccttctgt

SEQ ID NO: 28083 - DNA, 1114 bp, Homo sapiens
ccagctcaagtcaacatcctgggctgttaacccgcgataaggtcggacggggcctcagtggagaatacgtggggaagttctctggggcgggcgcagtctgctgctgattctgagaaaccgaaactcagctgttaaaaccgctgcctctgcactttggaatcccatctggagactcgctaagcgtcccagccgcatccctcccgcagcgacggcggcccgggacccgcgggctgtgaaccatgaacacccgcaatagagtggtgaactccgggctcggcgcctcccctgcctcccgcccgacccgggatccccaggacccttctgggcggcaaggggagctgagccccgtggaagaccagagagagggtttggaggcagcccctaagggcccttcgcgggagagcgtcgtgcacgcgggccagaggcgcacaagtgcatacaccttgatagcaccaaatataaaccggagaaatgagatacaaagaattgcggagcaggagctggccaacctggagaagtggaaggagcagaacagagctaaaccggttcacctggtgcccagacggctaggtggaagccagtcagaaactgaagtcagacagaaacaacaactccagctgatgcaatctaaatacaagcaaaagctaaaaagagaagaatctgtaagaatcaagaaggaagctgaagaagctgaactccaaaaaatgaaaccaaatacagcatgttctcgacttataagtgggagctaaatgctgagaacacttggacacatagaggggaacaacaaacactgtagcctatcagaaggtagaaggtgggaggagggagaggatcaggaaaaacaactaatagatactaggcttaatacctgggtgatggaataatctgtacaacaaacccccacgaagcacatttacctgtgtaacaaacctgcacatcctgcacatgtacccctgaattcaaaatgaaagttaaggcccattgtggtgactcatacatgtaatcccagctaatcgggagggtgaggcaggagaattgcttgaacccaggaggtggaggttgcagtaagtcaagatcacgcaactgcactccaggtttgggcaacagagcgaga

SEQ ID NO: 28084 - DNA, 236 bp, Homo sapiens
aagggcgtaatgtttcacttggtggagaacgacagggaaatgatgggtctctgaaagtagccatcaaacagattcatagactgtatgtgtaccatggactgaaccagctatactactggaaactagtagacaaggataaataagataatttccctgccagagggacaaacataggttctttgcaagcccataagaggggcatttaacccatctggcaaccttgaacaaaaacaaaa

SEQ ID NO: 28085 - DNA, 655 bp, Homo sapiens
tgagcaaatggtataactatcaataatagtctttcttgtgtttatttttacctcaaaaaagtagtgaattaaatgtatttttaatgcatgccttcacctttaaggggcttacattctgacaggtaggcaaacacaagtctataagtagctacttcgagaagaaggtataatggaaacataaaccaagtattgtgggtaaaagtcttttatatgagaggaaacatggaaagacttcagaaaatcagcctttatttcctctatttttgcagtgtttgtggataattcatatcaatttggtctattgttgaacaagctggtatatgaaataaggtcttacctccctctctccagttgccagatgagccttttaggagactggactttcttttttttttttttttttaattattatactttaagttttagggtacatgtgcacattgtgcaggttagttacatatgtatgtatacatgtgccatgctggtgcgctgcacccactaactcgtcatctagcgagcattgggaagggtatatctcccaatgctatcccttccccctccccccaccccacagcagtccccagagtgtgatgttccccttcctgtgtccatgtgatctcactgttcaattcccacctatgagtgagaatatgcg

SEQ ID NO: 28086 - DNA, 465 bp, Homo sapiens
gactctaaaaaggtgcttactaatactgttatttacagtacaactgctgagaaggaaatcagcttctatccttaggacttacttttcagtaaaataataattttttaaaactatgggaaatatacaaatatttctaatatttcacttaactagtgacttttatccttactccataaaaaagtatctgggccaggcacgctggctcacacctgtaatcccagcattttgggaagccgaggtaggtggatcatgaggtcaggagttcgagacgagcctggccaacatactgaaaccccgttactactaaaaatacaaaaattagccaggtgtggtggcatgtgcctatagtcctaggtacttgggaggctgaggcgggagaatcgcttgaacccgggaggtggaatgcagtgagccgagaccacaccatctgcactccagcctaggtgacagagtgagattccgtct

SEQ ID NO: 28087 - DNA, 391 bp, Homo sapiens
tgagttctagaaacaacgctgggagtgatccagaatgccttagtaaataaaatagatgaaggtttaaaagactccgtctatctttagagctattaaacaaaagagaaacattcaacatcttccctctaatagtcaataagaaagaagaatgtcacaaaagagttcgatcccctctaggctaatggaagggaaaccacctgagtcagagttggtctggagaggcaagcattacacccagtggtctctgatgtcatctcagctctgagccagtggcctcaggggtactgtgtcccaactggagaattaacaaggtgattactgaactgtaattgctggctaaatgtcttccaaagactatcataatctcagaaataagctgacacattacatg

SEQ ID NO: 28088 - DNA, 342 bp, Homo sapiens
gtttaataacttgaacttgaattgctgttacagagattatcaaaactaaatgcttcctgtttttgacatagagatgcatgatgcaagcaacgacaatgtatatttgtttgaacctgatgataagatctctggctgggcgtggtagttcatgcctataatcccagcactttgggaggcaacatggcaaaactctgtctctactaaaaatactaaatttagctgggcatggtggcatgtacctgtaatcccacctactcaagaggcggaggcaggaggatcgcttgaacctgggaggcagaggttgcagtgagcgccactgcactccagtctgggtggcagagt

SEQ ID NO: 28089 - DNA, 310 bp, Homo sapiens
caacctggaaataaaagtagaaataataacatgatctcagaaaagggtttatatatctaaggcaagataacataatctgctgcatcaacaacctaaataatgtaccatatttttcagtatttattatgggtaatacacgtatagagcctgcaacataattttgatgaaagtccttctattcccaaacttatagacatgctttaagtatgggggcaaaaataaaagttttttaaattcctttctagaaaattataaaatccacctgaagtcacaaaatctgtaactatacaagcccagcatgtattatcca

SEQ ID NO: 28090 - DNA, 412 bp, Homo sapiens
tacttgccattatttgaaataattcataagagctatataagctcttcctttactgcctggaatgtttcatatgacctactaaattttgcattactgtattattttagctagtgggaacatttagtataattactttggctattctttattagattatgagcctcccattacttctaaaagactatcttggatgctgtttgggttcagtaaataactatgtattactgcaaaggtatactgagatttctattttaagtggtgtctggctagcagccctggacacaaccttccaaaaatttccagtaaattgactatgaagacacacaaagagatatctgttcgtagtatggataatatagactgattgtcgcttactgccagaatttgagaggaattctggaattgttttcct

SEQ ID NO: 28091 - DNA, 657 bp, Homo sapiens
gcaccgcgtctacctataatgacattgcagcatctagcaaagttacgcatgtactatcctgtaaccgagcagttctgcttctgggaatttattcttcagatacacttgcataaatgatacatggtgtatgtgcaggctcattacttgcagcattgtctgtgataacaacgttagaagcaatgtagatggacaaaatagggtataaattaaggtgcatccatacaaggaggtaccctgtggctatacagaatggtaaaggagctctttagttactcaaatggaatgatcactggaataaattaaagataaagtccacctcaaagcacataaagtattctaacatttgtgtagaaaggtaggagaggggaggatgtacatacagatatttgtaaatacatacaatggaaagataaaacaagatactgactacaggaatgtctagttacttgaactcagaaatcaaaaattcagatagacatttcagaaatattttagctattggttgcttctgggggtgtgggaaactagggtcagggatggggagatagttttcagtatatacccttgtaagtctttggttaactttgaaaagctctttattgtggtgtcataaatacaccttttaaatttgaattattagatgtattactattaaaa

SEQ ID NO: 28092 - DNA, 438 bp, Homo sapiens
  misc_feature (1)..(1): n is a, c, g, or t
ngaagtaaagctaaaaactgaaaatattggcagcccctctgagtctccttggatggggttagatctgctcccagctcttgacctcccagtctcaggctggccagggagatacttaactatccttgggttccctgcaaaaacctgccctccttccctggttgtattctccagccccttgtgggaaagaaggattctagccactgtgcttctgagcaacactgtgtgtcctaggattcattcagttcaggaagttacaaatgaactttccaaagatgctgggcatctctgatttgctggtgactttcagagattcttcatacctattagtggaaatctcacttccattctagagatggcaaagctgagctgccaactttggtagcagagtccagtgcttccagtcctgctctggggcagatgtggcatgtttctaacatt

SEQ ID NO: 28093 - DNA, 261 bp, Homo sapiens
cctgaccgtcccaaattgcaagtaaacaatacgtcggcttagataaagcgcgagtctgaaactaccgaggccggcctgcgagctagcgcggagggcagccccgggccgccagctttgtagcggttcctgcttacaaaagggctcttcttggaaacggggctggtggggaccgtagagggggtggggatatttctagttcataagggaaaggcaaggggtgcttagatgaggattttaagtatgagaagtagtgtgtttggg

SEQ ID NO: 28094 - DNA, 2550 bp, Homo sapiens
cggacgcgtgggtccggacgcgtgggtcgacccacgcgtctatagtagaaggaattggacacttctccagatatttggcttcaaaggagtacctttacttacatgtgctttatggtaagtacattgaattttactttaaatgcattttactacaaagcacaattcatttgtaatgcatatccatcttggattcaatccaaggtgctttagctatcagtagtaccaaaggatctttttacaaggcttcctgtggtattgactctgagaataacacatagtgaagatctgtgggcttttaaaattgttcacagccaatttaagaagacccctcatgaagtctcagttttcagtacagtacatcattcctcctcactaggagcactttgatgtaaaccagaatagctttaaaaagacaaaaaggatcgtagatctgatttttaaatggttggttgctctgacagatctgaacactttgcttcatgactatttcgtcataaaggtatatgtttaaaatctgaatggcagtactagctctatacttttaatactgctttgtattttatatgtaaagtagtattgctgacattttaaaaaaatacaaaatacaaaagaaaccattagaaattaataactgtggctcttccagttgaaataggaattggagagaaaggattagaatattttaattaggggagtagattattgtccaaaggcttttatttagagaaacgggtaattaaaacagcagctttagaatagcttcttactgaatatgcaaaagaataattccttgttatttcctaattgatccaagtctcataaatttagcttttgtcataattccttaccgaaaacaactgaaattgagagtcataaatactgtgggttagaataaaaaccatttgccaaagcaacactctacttagaagcacatgtacatacatggacctcattcagaagtccatgttgtagcagttagaatttgagtatcagccatttcattgtagtaacaaaaattgaattgcattttgtgctcagttgtttattgtaattttatttttgttacattaatattagttaagatatggtcacttgaattttttgtatttaagaattttctgttttaatgcatgttatacttttatgtaggattcccaaccttccctctaaatgggatttaacccacatctgcgagatcagcgttatgctaagaggaaatcactgaggccatatctttttacaatctgaaaaaaaagtagtaaaaaggtagttaaaaaaaaaaaaaggccgggtggtggctcatacctgtaatcctagcactttgggaggccaaggcaggcagatcacttgaggtcaggggttcaaaaccagcctggccaagatggtgaaaccccatctctgctaaaaatacaaaaaaaaattagccgggcatggtggcacgtgcctgtaatcccagctacttgggagactgaggcaggagaattgcttgaacccgggaggcggagattgcagtgagccaagatcacgccgttgcactccagcctgagcaacagagcaagactccatctcaaaaaaacaaaactactttcattaattacccattatttattttagttacttaattttgagttcataaatggccaccctaatggaaagtttgggtatgatcttaggttttatggagatgttttcaatagagattatttttccctcaccctatttgtgaatatataaattaaagtaagacaatggagtaagtaagagggtagatccaaacacagtatgtctaaattctagcactctactggctgcttagaatacaccaaacctggaagacctttccaagagtaaaatcccagtctgccactatcaaaattgccacagtcacttttactacttgtgttcatagtagactcagcacttctttttcactggacctagtataactgagaaataaataactgtgtgcaaaatattggtatcattaaggacccagagctgcccattttctctttgttctaatagggaagcaattactgatagaaatgtgagattaaaaatagggtcctccctgctgctccaaacaaatgcctaaacacagtatgtatctcagtcctctgttcccagagattccaccctagcccaggaaagaactggcctgtgtaaagcaaaacccaagtcatccccctccagaaatttctctggcagccaagcctgaccctaagggttccactttgctttaaaagctaggagtggcctctagagccaggaacacattaatacaacagttcaacctcagcaccaagtcaggtacgaagcgcttgatacgtggaatttttctctatatcaagtttaaatttctggaaatagactttggttgctaatgacaattacagttataccatagtctgtaatttgagaaaaggtgaaatgtatttaatatatatttagttttaataaaaagataaaattattacagaaataattgagagagagaaaatctattataatttatttgaaaaataaaacattttatccagtaaaaaaaaa

SEQ ID NO: 28095 - DNA, 1859 bp, Homo sapiens
cggacgcgtgggtccggacgcgtgggtcgacccacgcgtgggtaattaaaacagcagctttagaatagcttcttactgaatatgcaaaagaataattccttgttatttcctaattgatccaagtctcataaatttagcttttgtcataattccttaccgaaaacaactgaaattgagagtcataaatactgtgggttagaataaaaaccatttgccaaagcaacactctacttagaagcacatgtacatacatggacctcattcagaagtccatgttgtagcagttagaatttgagtatcagccatttcattgtagtaacaaaaattgaattgcattttgtgctcagttgtttattgtaattttatttttgttacattaatattagttaagatatggtcacttgaattttttgtatttaagaattttctgttttaatgcatgttatacttttatgtaggattcccaaccttccctctaaatgggatttaacccacatctgcgagatcagcgttatgctaagaggaaatcactgaggccatatctttttacaatctgaaaaaaaagtagtaaaaaggtagttaaaaaaaaaaaaaggccgggtggtggctcatacctgtaatcctagcactttgggaggccaaggcaggcagatcacttgaggtcaggggttcaaaaccagcctggccaagatggtgaaaccccatctctgctaaaaatacaaaaaaaaattagccgggcatggtggcacgtgcctgtaatcccagctacttgggagactgaggcaggagaattgcttgaacccgggaggcggagattgcagtgagccaagatcacgccgttgcactccagcctgagcaacagagcaagactccatctcaaaaaaacaaaactactttcattaattacccattatttattttagttacttaattttgagttcataaatggccaccctaatggaaagtttgggtatgatcttaggttttatggagatgttttcaatagagattatttttccctcaccctatttgtgaatatataaattaaagtaagacaatggagtaagtaagagggtagatccaaacacagtatgtctaaattctagcactctactggctgcttagaatacaccaaacctggaagacctttccaagagtaaaatcccagtctgccactatcaaaattgccacagtcacttttactacttgtgttcatagtagactcagcacttctttttcactggacctagtataactgagaaataaataactgtgtgcaaaatattggtatcattaaggacccagagctgcccattttctctttgttctaatagggaagcaattactgatagaaatgtgagattaaaaatagggtcctccctgctgctccaaacaaatgcctaaacacagtatgtatctcagtcctctgttcccagagattccaccctagcccaggaaagaactggcctgtgtaaagcaaaacccaagtcatccccctccagaaatttctctggcagccaagcctgaccctaagggttccactttgctttaaaagctaggagtggcctctagagccaggaacacattaatacaacagttcaacctcagcaccaagtcaggtacgaagcgcttgatacgtggaatttttctctatatcaagtttaaatttctggaaatagactttggttgctaatgacaattacagttataccatagtctgtaatttgagaaaaggtgaaatgtatttaatatatatttagttttaataaaaagataaaattattacagaaataattgagagagagaaaatctattataatttatttgaaaaataaaacattttatccagtaaaaaaaaa

SEQ ID NO: 28096 - DNA, 3565 bp, Homo sapiens
agcggaggagacgcagtctccgtcgttgacgttagtcgcagtcttcgctgctaacgttttgttatgagttgctaaaatggtgaaatgctgctccgccattggatgtgcttctcgctgcttgccaaattcgaagttaaaaggactgacatttcacgtattccccacagatgaaaacatcaaaaggaaatgggtattagcaatgaaaagacttgatgtgaatgcagccggcatttgggagcctaaaaaaggagatgtgttgtgttcgaggcactttaagaagacagattttgacagaagtgctccaaatattaaactgaaacctggagtcataccttctatctttgattctccatatcacctacaggggaaaagagaaaaacttcattgtagaaaaaacttcaccctcaaaaccgttccagccactaactacaatcaccatcttgttggtgcttcctcatgtattgaagaattccaatcccagttcatttttgaacatagctacagtgtaatggacagtccaaagaaacttaagcataaattagatcatgtgatcggcgagctagaggatacaaaggaaagtctacggaatgttttagaccgagaaaaacgttttcagaaatcattgaggaagacaatcagggaattaaaggatgaatgtctgatcagccaagaaacagcaaatagactggacactttctgttgggactgttgtcaggagagcatagaacaggactatatttcatgaaataatttcatgttacgttccacctaaaattgtcattggtacaaatttttataaaatctcatttaccatcactaaataatatccatcatttaaagtgctgctttggattctctggagcattatgcattatagttgttatccaaagacttttttgaaaatatgcagaaatttgtggtaattatgtatttgtgtcttgtgacaattatgttttatagacctacactagtgccaggtcactattgtaagatgttaaaatctcaagaaaatttcacagagctaaagaaatgatgtcaaattagtcacattaagctatagtagaaggaattggacacttctccagatatttggcttcaaaggagtacctttacttacatgtgctttatggtaagtacattgaattttactttaaatgcattttactacaaagcacaattcatttgtaatgcatatccatcttggattcaatccaaggtgctttagctatcagtagtaccaaaggatctttttacaaggcttcctgtggtattgactctgagaataacacatagtgaagatctgtgggcttttaaaattgttcacagccaatttaagaagacccctcatgaagtctcagttttcagtacagtacatcattcctcctcactaggagcactttgatgtaaaccagaatagctttaaaaagacaaaaaggatcgtagatctgatttttaaatggttggttgctctgacagatctgaacactttgcttcatgactatttcgtcataaaggtatatgtttaaaatctgaatggcagtactagctctatacttttaatactgctttgtattttatatgtaaagtagtattgctgacattttaaaaaaatacaaaatacaaaagaaaccattagaaattaataactgtggctcttccagttgaaataggaattggagagaaaggattagaatattttaattaggggagtagattattgtccaaaggcttttatttagagaaacgggtaattaaaacagcagctttagaatagcttcttactgaatatgcaaaagaataattccttgttatttcctaattgatccaagtctcataaatttagcttttgtcataattccttaccgaaaacaactgaaattgagagtcataaatactgtgggttagaataaaaaccatttgccaaagcaacactctacttagaagcacatgtacatacatggacctcattcagaagtccatgttgtagcagttagaatttgagtatcagccatttcattgtagtaacaaaaattgaattgcattttgtgctcagttgtttattgtaattttatttttgttacattaatattagttaagatatggtcacttgaattttttgtatttaagaattttctgttttaatgcatgttatacttttatgtaggattcccaaccttccctctaaatgggatttaacccacatctgcgagatcagcgttatgctaagaggaaatcactgaggccatatctttttacaatctgaaaaaaaagtagtaaaaaggtagttaaaaaaaaaaaaaggccgggtggtggctcatacctgtaatcctagcactttgggaggccaaggcaggcagatcacttgaggtcaggggttcaaaaccagcctggccaagatggtgaaaccccatctctgctaaaaatacaaaaaaaaattagccgggcatggtggcacgtgcctgtaatcccagctacttgggagactgaggcaggagaattgcttgaacccgggaggcggagattgcagtgagccaagatcacgccgttgcactccagcctgagcaacagagcaagactccatctcaaaaaaacaaaactactttcattaattacccattatttattttagttacttaattttgagttcataaatggccaccctaatggaaagtttgggtatgatcttaggttttatggagatgttttcaatagagattatttttccctcaccctatttgtgaatatataaattaaagtaagacaatggagtaagtaagagggtagatccaaacacagtatgtctaaattctagcactctactggctgcttagaatacaccaaacctggaagacctttccaagagtaaaatcccagtctgccactatcaaaattgccacagtcacttttactacttgtgttcatagtagactcagcacttctttttcactggacctagtataactgagaaataaataactgtgtgcaaaatattggtatcattaaggacccagagctgcccattttctctttgttctaatagggaagcaattactgatagaaatgtgagattaaaaatagggtcctccctgctgctccaaacaaatgcctaaacacagtatgtatctcagtcctctgttcccagagattccaccctagcccaggaaagaactggcctgtgtaaagcaaaacccaagtcatccccctccagaaatttctctggcagccaagcctgaccctaagggttccactttgctttaaaagctaggagtggcctctagagccaggaacacattaatacaacagttcaacctcagcaccaagtcaggtacgaagcgcttgatacgtggaatttttctctatatcaagtttaaatttctggaaatagactttggttgctaatgacaattacagttataccatagtctgtaatttgagaaaaggtgaaatgtatttaatatatatttagttttaataaaaagataaaattattacagaaataattgagagagagaaaatctattataatttatttgaaaaataaaacattttatccagtaaaaaaaaa

SEQ ID NO: 28097 - DNA, 3743 bp, Homo sapiens
ctgctcttggacgccagggtgctcgctggcacctcgaagtgcttcttgcttcctccctttcccgtttacttgctgttctttcaaaatatgtactgacattcactattgccagtcaccagctaaaccgtgaggacaaaaagtaaggaaaaatagacacactccaccatgacctcatggaactaacaagactggtggaggaggaagacattaataagagcaatcactgcaataaatttttgttatgagttgctaaaatggtgaaatgctgctccgccattggatgtgcttctcgctgcttgccaaattcgaagttaaaaggactgacatttcacgtattccccacagatgaaaacatcaaaaggaaatgggtattagcaatgaaaagacttgatgtgaatgcagccggcatttgggagcctaaaaaaggagatgtgttgtgttcgaggcactttaagaagacagattttgacagaagtgctccaaatattaaactgaaacctggagtcataccttctatctttgattctccatatcacctacaggggaaaagagaaaaacttcattgtagaaaaaacttcaccctcaaaaccgttccagccactaactacaatcaccatcttgttggtgcttcctcatgtattgaagaattccaatcccagttcatttttgaacatagctacagtgtaatggacagtccaaagaaacttaagcataaattagatcatgtgatcggcgagctagaggatacaaaggaaagtctacggaatgttttagaccgagaaaaacgttttcagaaatcattgaggaagacaatcagggaattaaaggatgaatgtctgatcagccaagaaacagcaaatagactggacactttctgttgggactgttgtcaggagagcatagaacaggactatatttcatgaaataatttcatgttacgttccacctaaaattgtcattggtacaaatttttataaaatctcatttaccatcactaaataatatccatcatttaaagtgctgctttggattctctggagcattatgcattatagttgttatccaaagacttttttgaaaatatgcagaaatttgtggtaattatgtatttgtgtcttgtgacaattatgttttatagacctacactagtgccaggtcactattgtaagatgttaaaatctcaagaaaatttcacagagctaaagaaatgatgtcaaattagtcacattaagctatagtagaaggaattggacacttctccagatatttggcttcaaaggagtacctttacttacatgtgctttatggtaagtacattgaattttactttaaatgcattttactacaaagcacaattcatttgtaatgcatatccatcttggattcaatccaaggtgctttagctatcagtagtaccaaaggatctttttacaaggcttcctgtggtattgactctgagaataacacatagtgaagatctgtgggcttttaaaattgttcacagccaatttaagaagacccctcatgaagtctcagttttcagtacagtacatcattcctcctcactaggagcactttgatgtaaaccagaatagctttaaaaagacaaaaaggatcgtagatctgatttttaaatggttggttgctctgacagatctgaacactttgcttcatgactatttcgtcataaaggtatatgtttaaaatctgaatggcagtactagctctatacttttaatactgctttgtattttatatgtaaagtagtattgctgacattttaaaaaaatacaaaatacaaaagaaaccattagaaattaataactgtggctcttccagttgaaataggaattggagagaaaggattagaatattttaattaggggagtagattattgtccaaaggcttttatttagagaaacgggtaattaaaacagcagctttagaatagcttcttactgaatatgcaaaagaataattccttgttatttcctaattgatccaagtctcataaatttagcttttgtcataattccttaccgaaaacaactgaaattgagagtcataaatactgtgggttagaataaaaaccatttgccaaagcaacactctacttagaagcacatgtacatacatggacctcattcagaagtccatgttgtagcagttagaatttgagtatcagccatttcattgtagtaacaaaaattgaattgcattttgtgctcagttgtttattgtaattttatttttgttacattaatattagttaagatatggtcacttgaattttttgtatttaagaattttctgttttaatgcatgttatacttttatgtaggattcccaaccttccctctaaatgggatttaacccacatctgcgagatcagcgttatgctaagaggaaatcactgaggccatatctttttacaatctgaaaaaaaagtagtaaaaaggtagttaaaaaaaaaaaaaggccgggtggtggctcatacctgtaatcctagcactttgggaggccaaggcaggcagatcacttgaggtcaggggttcaaaaccagcctggccaagatggtgaaaccccatctctgctaaaaatacaaaaaaaaattagccgggcatggtggcacgtgcctgtaatcccagctacttgggagactgaggcaggagaattgcttgaacccgggaggcggagattgcagtgagccaagatcacgccgttgcactccagcctgagcaacagagcaagactccatctcaaaaaaacaaaactactttcattaattacccattatttattttagttacttaattttgagttcataaatggccaccctaatggaaagtttgggtatgatcttaggttttatggagatgttttcaatagagattatttttccctcaccctatttgtgaatatataaattaaagtaagacaatggagtaagtaagagggtagatccaaacacagtatgtctaaattctagcactctactggctgcttagaatacaccaaacctggaagacctttccaagagtaaaatcccagtctgccactatcaaaattgccacagtcacttttactacttgtgttcatagtagactcagcacttctttttcactggacctagtataactgagaaataaataactgtgtgcaaaatattggtatcattaaggacccagagctgcccattttctctttgttctaatagggaagcaattactgatagaaatgtgagattaaaaatagggtcctccctgctgctccaaacaaatgcctaaacacagtatgtatctcagtcctctgttcccagagattccaccctagcccaggaaagaactggcctgtgtaaagcaaaacccaagtcatccccctccagaaatttctctggcagccaagcctgaccctaagggttccactttgctttaaaagctaggagtggcctctagagccaggaacacattaatacaacagttcaacctcagcaccaagtcaggtacgaagcgcttgatacgtggaatttttctctatatcaagtttaaatttctggaaatagactttggttgctaatgacaattacagttataccatagtctgtaatttgagaaaaggtgaaatgtatttaatatatatttagttttaataaaaagataaaattattacagaaataattgagagagagaaaatctattataatttatttgaaaaataaaacattttatccagtaaaaaaaaa

SEQ ID NO: 28098 - DNA, 3540 bp, Homo sapiens
tgtcgaacccacgcgtcgcggacgcgtgggcttttgttatgagttgctaaaatggtgaaatgctgctccgccattggatgtgcttctcgctgcttgccaaattcgaagttaaaaggactgacatttcacgtattccccacagatgaaaacatcaaaaggaaatgggtattagcaatgaaaagacttgatgtgaatgcagccggcatttgggagcctaaaaaaggagatgtgttgtgttcgaggcactttaagaagacagattttgacagaagtgctccaaatattaaactgaaacctggagtcataccttctatctttgattctccatatcacctacaggggaaaagagaaaaacttcattgtagaaaaaacttcaccctcaaaaccgttccagccactaactacaatcaccatcttgttggtgcttcctcatgtattgaagaattccaatcccagttcatttttgaacatagctacagtgtaatggacagtccaaagaaacttaagcataaattagatcatgtgatcggcgagctagaggatacaaaggaaagtctacggaatgttttagaccgagaaaaacgttttcagaaatcattgaggaagacaatcagggaattaaaggatgaatgtctgatcagccaagaaacagcaaatagactggacactttctgttgggactgttgtcaggagagcatagaacaggactatatttcatgaaataatttcatgttacgttccacctaaaattgtcattggtacaaatttttataaaatctcatttaccatcactaaataatatccatcatttaaagtgctgctttggattctctggagcattatgcattatagttgttatccaaagacttttttgaaaatatgcagaaatttgtggtaattatgtatttgtgtcttgtgacaattatgttttatagacctacactagtgccaggtcactattgtaagatgttaaaatctcaagaaaatttcacagagctaaagaaatgatgtcaaattagtcacattaagctatagtagaaggaattggacacttctccagatatttggcttcaaaggagtacctttacttacatgtgctttatggtaagtacattgaattttactttaaatgcattttactacaaagcacaattcatttgtaatgcatatccatcttggattcaatccaaggtgctttagctatcagtagtaccaaaggatctttttacaaggcttcctgtggtattgactctgagaataacacatagtgaagatctgtgggcttttaaaattgttcacagccaatttaagaagacccctcatgaagtctcagttttcagtacagtacatcattcctcctcactaggagcactttgatgtaaaccagaatagctttaaaaagacaaaaaggatcgtagatctgatttttaaatggttggttgctctgacagatctgaacactttgcttcatgactatttcgtcataaaggtatatgtttaaaatctgaatggcagtactagctctatacttttaatactgctttgtattttatatgtaaagtagtattgctgacattttaaaaaaatacaaaatacaaaagaaaccattagaaattaataactgtggctcttccagttgaaataggaattggagagaaaggattagaatattttaattaggggagtagattattgtccaaaggcttttatttagagaaacgggtaattaaaacagcagctttagaatagcttcttactgaatatgcaaaagaataattccttgttatttcctaattgatccaagtctcataaatttagcttttgtcataattccttaccgaaaacaactgaaattgagagtcataaatactgtgggttagaataaaaaccatttgccaaagcaacactctacttagaagcacatgtacatacatggacctcattcagaagtccatgttgtagcagttagaatttgagtatcagccatttcattgtagtaacaaaaattgaattgcattttgtgctcagttgtttattgtaattttatttttgttacattaatattagttaagatatggtcacttgaattttttgtatttaagaattttctgttttaatgcatgttatacttttatgtaggattcccaaccttccctctaaatgggatttaacccacatctgcgagatcagcgttatgctaagaggaaatcactgaggccatatctttttacaatctgaaaaaaaagtagtaaaaaggtagttaaaaaaaaaaaaaggccgggtggtggctcatacctgtaatcctagcactttgggaggccaaggcaggcagatcacttgaggtcaggggttcaaaaccagcctggccaagatggtgaaaccccatctctgctaaaaatacaaaaaaaaattagccgggcatggtggcacgtgcctgtaatcccagctacttgggagactgaggcaggagaattgcttgaacccgggaggcggagattgcagtgagccaagatcacgccgttgcactccagcctgagcaacagagcaagactccatctcaaaaaaacaaaactactttcattaattacccattatttattttagttacttaattttgagttcataaatggccaccctaatggaaagtttgggtatgatcttaggttttatggagatgttttcaatagagattatttttccctcaccctatttgtgaatatataaattaaagtaagacaatggagtaagtaagagggtagatccaaacacagtatgtctaaattctagcactctactggctgcttagaatacaccaaacctggaagacctttccaagagtaaaatcccagtctgccactatcaaaattgccacagtcacttttactacttgtgttcatagtagactcagcacttctttttcactggacctagtataactgagaaataaataactgtgtgcaaaatattggtatcattaaggacccagagctgcccattttctctttgttctaatagggaagcaattactgatagaaatgtgagattaaaaatagggtcctccctgctgctccaaacaaatgcctaaacacagtatgtatctcagtcctctgttcccagagattccaccctagcccaggaaagaactggcctgtgtaaagcaaaacccaagtcatccccctccagaaatttctctggcagccaagcctgaccctaagggttccactttgctttaaaagctaggagtggcctctagagccaggaacacattaatacaacagttcaacctcagcaccaagtcaggtacgaagcgcttgatacgtggaatttttctctatatcaagtttaaatttctggaaatagactttggttgctaatgacaattacagttataccatagtctgtaatttgagaaaaggtgaaatgtatttaatatatatttagttttaataaaaagataaaattattacagaaataattgagagagagaaaatctattataatttatttgaaaaataaaacattttatccagtaaaaaaaaa

SEQ ID NO: 28099 - DNA, 3465 bp, Homo sapiens
agcggaggagacgcagtctccgtcgttgacgttagtcgcagtcttcgctgctaacgattccccacagatgaaaacatcaaaaggaaatgggtattagcaatgaaaagacttgatgtgaatgcagccggcatttgggagcctaaaaaaggagatgtgttgtgttcgaggcactttaagaagacagattttgacagaagtgctccaaatattaaactgaaacctggagtcataccttctatctttgattctccatatcacctacaggggaaaagagaaaaacttcattgtagaaaaaacttcaccctcaaaaccgttccagccactaactacaatcaccatcttgttggtgcttcctcatgtattgaagaattccaatcccagttcatttttgaacatagctacagtgtaatggacagtccaaagaaacttaagcataaattagatcatgtgatcggcgagctagaggatacaaaggaaagtctacggaatgttttagaccgagaaaaacgttttcagaaatcattgaggaagacaatcagggaattaaaggatgaatgtctgatcagccaagaaacagcaaatagactggacactttctgttgggactgttgtcaggagagcatagaacaggactatatttcatgaaataatttcatgttacgttccacctaaaattgtcattggtacaaatttttataaaatctcatttaccatcactaaataatatccatcatttaaagtgctgctttggattctctggagcattatgcattatagttgttatccaaagacttttttgaaaatatgcagaaatttgtggtaattatgtatttgtgtcttgtgacaattatgttttatagacctacactagtgccaggtcactattgtaagatgttaaaatctcaagaaaatttcacagagctaaagaaatgatgtcaaattagtcacattaagctatagtagaaggaattggacacttctccagatatttggcttcaaaggagtacctttacttacatgtgctttatggtaagtacattgaattttactttaaatgcattttactacaaagcacaattcatttgtaatgcatatccatcttggattcaatccaaggtgctttagctatcagtagtaccaaaggatctttttacaaggcttcctgtggtattgactctgagaataacacatagtgaagatctgtgggcttttaaaattgttcacagccaatttaagaagacccctcatgaagtctcagttttcagtacagtacatcattcctcctcactaggagcactttgatgtaaaccagaatagctttaaaaagacaaaaaggatcgtagatctgatttttaaatggttggttgctctgacagatctgaacactttgcttcatgactatttcgtcataaaggtatatgtttaaaatctgaatggcagtactagctctatacttttaatactgctttgtattttatatgtaaagtagtattgctgacattttaaaaaaatacaaaatacaaaagaaaccattagaaattaataactgtggctcttccagttgaaataggaattggagagaaaggattagaatattttaattaggggagtagattattgtccaaaggcttttatttagagaaacgggtaattaaaacagcagctttagaatagcttcttactgaatatgcaaaagaataattccttgttatttcctaattgatccaagtctcataaatttagcttttgtcataattccttaccgaaaacaactgaaattgagagtcataaatactgtgggttagaataaaaaccatttgccaaagcaacactctacttagaagcacatgtacatacatggacctcattcagaagtccatgttgtagcagttagaatttgagtatcagccatttcattgtagtaacaaaaattgaattgcattttgtgctcagttgtttattgtaattttatttttgttacattaatattagttaagatatggtcacttgaattttttgtatttaagaattttctgttttaatgcatgttatacttttatgtaggattcccaaccttccctctaaatgggatttaacccacatctgcgagatcagcgttatgctaagaggaaatcactgaggccatatctttttacaatctgaaaaaaaagtagtaaaaaggtagttaaaaaaaaaaaaaggccgggtggtggctcatacctgtaatcctagcactttgggaggccaaggcaggcagatcacttgaggtcaggggttcaaaaccagcctggccaagatggtgaaaccccatctctgctaaaaatacaaaaaaaaattagccgggcatggtggcacgtgcctgtaatcccagctacttgggagactgaggcaggagaattgcttgaacccgggaggcggagattgcagtgagccaagatcacgccgttgcactccagcctgagcaacagagcaagactccatctcaaaaaaacaaaactactttcattaattacccattatttattttagttacttaattttgagttcataaatggccaccctaatggaaagtttgggtatgatcttaggttttatggagatgttttcaatagagattatttttccctcaccctatttgtgaatatataaattaaagtaagacaatggagtaagtaagagggtagatccaaacacagtatgtctaaattctagcactctactggctgcttagaatacaccaaacctggaagacctttccaagagtaaaatcccagtctgccactatcaaaattgccacagtcacttttactacttgtgttcatagtagactcagcacttctttttcactggacctagtataactgagaaataaataactgtgtgcaaaatattggtatcattaaggacccagagctgcccattttctctttgttctaatagggaagcaattactgatagaaatgtgagattaaaaatagggtcctccctgctgctccaaacaaatgcctaaacacagtatgtatctcagtcctctgttcccagagattccaccctagcccaggaaagaactggcctgtgtaaagcaaaacccaagtcatccccctccagaaatttctctggcagccaagcctgaccctaagggttccactttgctttaaaagctaggagtggcctctagagccaggaacacattaatacaacagttcaacctcagcaccaagtcaggtacgaagcgcttgatacgtggaatttttctctatatcaagtttaaatttctggaaatagactttggttgctaatgacaattacagttataccatagtctgtaatttgagaaaaggtgaaatgtatttaatatatatttagttttaataaaaagataaaattattacagaaataattgagagagagaaaatctattataatttatttgaaaaataaaacattttatccagtaaaaaaaaa

SEQ ID NO: 28100 - DNA, 3562 bp, Homo sapiens
cagagaccactgtgcaagcctaatcacttcccaagaagggttttgctttaaagttttgttatgagttgctaaaatggtgaaatgctgctccgccattggatgtgcttctcgctgcttgccaaattcgaagttaaaaggactgacatttcacgtattccccacagatgaaaacatcaaaaggaaatgggtattagcaatgaaaagacttgatgtgaatgcagccggcatttgggagcctaaaaaaggagatgtgttgtgttcgaggcactttaagaagacagattttgacagaagtgctccaaatattaaactgaaacctggagtcataccttctatctttgattctccatatcacctacaggggaaaagagaaaaacttcattgtagaaaaaacttcaccctcaaaaccgttccagccactaactacaatcaccatcttgttggtgcttcctcatgtattgaagaattccaatcccagttcatttttgaacatagctacagtgtaatggacagtccaaagaaacttaagcataaattagatcatgtgatcggcgagctagaggatacaaaggaaagtctacggaatgttttagaccgagaaaaacgttttcagaaatcattgaggaagacaatcagggaattaaaggatgaatgtctgatcagccaagaaacagcaaatagactggacactttctgttgggactgttgtcaggagagcatagaacaggactatatttcatgaaataatttcatgttacgttccacctaaaattgtcattggtacaaatttttataaaatctcatttaccatcactaaataatatccatcatttaaagtgctgctttggattctctggagcattatgcattatagttgttatccaaagacttttttgaaaatatgcagaaatttgtggtaattatgtatttgtgtcttgtgacaattatgttttatagacctacactagtgccaggtcactattgtaagatgttaaaatctcaagaaaatttcacagagctaaagaaatgatgtcaaattagtcacattaagctatagtagaaggaattggacacttctccagatatttggcttcaaaggagtacctttacttacatgtgctttatggtaagtacattgaattttactttaaatgcattttactacaaagcacaattcatttgtaatgcatatccatcttggattcaatccaaggtgctttagctatcagtagtaccaaaggatctttttacaaggcttcctgtggtattgactctgagaataacacatagtgaagatctgtgggcttttaaaattgttcacagccaatttaagaagacccctcatgaagtctcagttttcagtacagtacatcattcctcctcactaggagcactttgatgtaaaccagaatagctttaaaaagacaaaaaggatcgtagatctgatttttaaatggttggttgctctgacagatctgaacactttgcttcatgactatttcgtcataaaggtatatgtttaaaatctgaatggcagtactagctctatacttttaatactgctttgtattttatatgtaaagtagtattgctgacattttaaaaaaatacaaaatacaaaagaaaccattagaaattaataactgtggctcttccagttgaaataggaattggagagaaaggattagaatattttaattaggggagtagattattgtccaaaggcttttatttagagaaacgggtaattaaaacagcagctttagaatagcttcttactgaatatgcaaaagaataattccttgttatttcctaattgatccaagtctcataaatttagcttttgtcataattccttaccgaaaacaactgaaattgagagtcataaatactgtgggttagaataaaaaccatttgccaaagcaacactctacttagaagcacatgtacatacatggacctcattcagaagtccatgttgtagcagttagaatttgagtatcagccatttcattgtagtaacaaaaattgaattgcattttgtgctcagttgtttattgtaattttatttttgttacattaatattagttaagatatggtcacttgaattttttgtatttaagaattttctgttttaatgcatgttatacttttatgtaggattcccaaccttccctctaaatgggatttaacccacatctgcgagatcagcgttatgctaagaggaaatcactgaggccatatctttttacaatctgaaaaaaaagtagtaaaaaggtagttaaaaaaaaaaaaaggccgggtggtggctcatacctgtaatcctagcactttgggaggccaaggcaggcagatcacttgaggtcaggggttcaaaaccagcctggccaagatggtgaaaccccatctctgctaaaaatacaaaaaaaaattagccgggcatggtggcacgtgcctgtaatcccagctacttgggagactgaggcaggagaattgcttgaacccgggaggcggagattgcagtgagccaagatcacgccgttgcactccagcctgagcaacagagcaagactccatctcaaaaaaacaaaactactttcattaattacccattatttattttagttacttaattttgagttcataaatggccaccctaatggaaagtttgggtatgatcttaggttttatggagatgttttcaatagagattatttttccctcaccctatttgtgaatatataaattaaagtaagacaatggagtaagtaagagggtagatccaaacacagtatgtctaaattctagcactctactggctgcttagaatacaccaaacctggaagacctttccaagagtaaaatcccagtctgccactatcaaaattgccacagtcacttttactacttgtgttcatagtagactcagcacttctttttcactggacctagtataactgagaaataaataactgtgtgcaaaatattggtatcattaaggacccagagctgcccattttctctttgttctaatagggaagcaattactgatagaaatgtgagattaaaaatagggtcctccctgctgctccaaacaaatgcctaaacacagtatgtatctcagtcctctgttcccagagattccaccctagcccaggaaagaactggcctgtgtaaagcaaaacccaagtcatccccctccagaaatttctctggcagccaagcctgaccctaagggttccactttgctttaaaagctaggagtggcctctagagccaggaacacattaatacaacagttcaacctcagcaccaagtcaggtacgaagcgcttgatacgtggaatttttctctatatcaagtttaaatttctggaaatagactttggttgctaatgacaattacagttataccatagtctgtaatttgagaaaaggtgaaatgtatttaatatatatttagttttaataaaaagataaaattattacagaaataattgagagagagaaaatctattataatttatttgaaaaataaaacattttatccagtaaaaaaaaa

SEQ ID NO: 28101 - DNA, 526 bp, Homo sapiens
tcctctctaaatccccaacaccgagcctgagaacctgctgcagtactcttttcctgtcacaccttatcaaatgcaatagccatccaataaagtaacccagttaaaaacttaatttaaatttgtttgataggtaaaaattaaacttagcagcaccacattgaatgaacaaaagctgtagagtcattgcaagtgtcatgctattcatagagataagtgcttcccatccataatattctgcagtctttgtgtatgcctggccttagtaaaaggagggatgcccttagcaccctaaatattgcttctacccccatcttcttcctgtgttccttaaacctctatcaccaacttaaaaatgttctccaggcattgtaaatgaagaaacagcttagacctagttataagcttttatccaactacatatctgtctgatttaataacttggtgtttatgtttttaggaacatagctacagtgtaatggacagtccaaagaaacttaagcataaattagatcatgtgatcggcgag

SEQ ID NO: 28102 - DNA, 157 bp, Homo sapiens
gtcagggctaaagaaaataagtcacgaacacctacgtatatgcttgtgaataagaaaaatgaaaaagcactgaacgaaaccgaacctcccactataaactttatccaattatttgattaatgccatcttctcagatgctagaagttgatgatggtta

SEQ ID NO: 28103 - DNA, 333 bp, Homo sapiens
gtttgtttgtttgttttttccagagggcagttgaaactgttaaagcaaagcgggctcccaagtgtctaagtttaacttttcttccctttgttgaatggatttcactgttatatgttttggtgcagtttataaatacagcttcagcagtcactatggtcaattttcttaaaacacttcatgatgggttaaacattattgcctttggaagctttaaggcgtgagtaacattatgcttatttgttttgtatatttacactatatataccataccgcaaaagtctttttgacatttatttatacagaggagaggacttttttcaagagttggtgagc

SEQ ID NO: 28104 - DNA, 1528 bp, Homo sapiens
aggctaccacgcccagctaatttttatatttttagtagagacggggtttcaccatggtagccagaatggtctctatctcttgaccttgtgatccgcccgcctcagcctcccaaagtgctgggattacaggcgtgagccactgcgcccggcttcctctggtaatcttacacctttacagaattaatctaaactggtggctcataaatgacattaaaaacaaaaaaaaaatctggatgcagtggctcattcctatagtcccagcactttgggaggccaaggcgggaggatcatctgagcccaggagtttggggctgtagtgaactatgatcatacaacttcattctagcctgggtgacaaagtgacaccctgtctctaaacaaaaatcaagaaacaaaaaacttgtatttccctgcagctttgggaagccagaacacaatattgcagtgaatctgaattttctgtgacaaataaattattaaattggcacatatgatcatcaccagtcatgtctcatcaaaagcctttattatgatgcttgtacattttgaagaatttagaattaatgagaagttaaccctttagtcattgtaacacaatcatattttaatcagctttttcttttgctaccaagagtttcaaaaaataaatgcagtatttgatttcaggctgctaaatgggctcatttagcattcattccttgatgtagacattaaaaaaaaaactgaatagcattctttccaggataactaataaagcagacatgctaagcctataaatacatcagcactgcagcacacgtttaaggttgccacggacaaggatcacacaatagagaacactgtagtaacatttcggtctgctcacaagacccagaacattgatcagtttttgttgttggtttattatttttctggttaaaaaattgtgaaaagtttgttttagctagatgatattttaatagctgcgagtgctttggaactataaagatgtcactacttaacacatataccttatgttttgttttgttttgttttacactcagtataaatcaggagaagttagccaaccatctagcatttagaatcctcttttttattgtcttctaaggatatggatgttcccataacagcaacaaaacagcaacaaaaacatttcataaatatcacttgatagactgtaagcacctgcttaactttgtgtcccaaatatttagtgtgtatatatatatatatatatacacacacacacacatatatattcaacaaataaagcaaaatataacatgcatttcacattttgtctttccctgttacgattttaatagcagaactgtatgacaagtttaggtgatcctagcatatgttaaattcaaattaatgtaaaacagattaacaacaacaaagaaactgtctatttgagtgaagtcatgctttctattataataacttggcttcggttatccatcaaatgcacacttatactgttatctgattgtttataataaagaatactgtacttataaaaatt

SEQ ID NO: 28105 - DNA, 1481 bp, Homo sapiens
gggggcggggtaggcggggaggccgcgccggggtcaggggggccagcgcccaccgggtacgagcgcgctggtgaggcaggcccggccgcgcccgcgcccccggcgcacggtcctcccgggagccggtttcggggacggcggcggggagtgggcgctggccagggacgagggttgaggaggtcgcggctctcatgctgggtgggagtcgggccttctgcctgggggttgcgtcagtgtccgaccccgcgatgagtggtcgggacaatttgcaactagagggtggtcctcatgggtaccctgtggggtgtcgcgcgaggtgaagggccaggccatttccgtcgggtcagcgatttccgccttcgccccgctctcgcctggcctggtcagggcctgttttggtacttgttgcgccgattggagtcatctgcgacttgtttgccctcctctgaactcctgaaagccagggctccgtctaggtctcctcctagtcttattctcccagctttcgttgttaagacaaattccttacgttcctggccctttacagaccggccctacagaacccacacccccagctccgactttcttctccagattgggtacttcccagggagtaaagggaatctgtagcttttgtggtttgtcctgctgggaaaatttgggggtaagtggtgggccttctctggacgaccacccacaaatctgtgtgcccaaacggagacaggacccagggtctggacatcaggcaaggggtactctgcagtaaacgtggacattggccgtttcgtgggtttgttttcactctgccaagtccttgaggcgtacacttttgtgtcactcatttatcttgaaagaaaaggttaacagcccaacagagtagttcgctttggtatctggagtggtaatcagagtgccagaactggagagaacattgccgtgtacagatgtttgccttttaccagggcactgaaggcataaaacccttagttaatgcttaactgagtgaaccatgaaagtcatgtgactccaaaggtcgactctagaaatgcggcagtccatgtagcactgtgatgtagaaattctatgatatatgggtcagtgttcacaggcagggagagggggagtcttcaacatctttgaattaaaaagcatctggggcaaaaacaaataaatacacacatatcagtgaactgctttaagttcagttagagaaggtgagattaaagaccagaagaaactcgagggagactgctgtataagtcccagttatctttccaaacagacaggttcatcacagcagtgaaggctagtcttcatctcccttcttgtgggattttctacattaatgtgcagatctgcccttggagaatggggcgtgcatgattgggctgtggtttgctggagtttcatcttactgaagttgcagacacggtgggtttctgtgacaatggtttacactgaaagtagcaaagtcaaggcat

SEQ ID NO: 28106 - DNA, 188 bp, Homo sapiens
cccaggcatctcttagttgccacaggactcctggcagaagttccagcaggtccctcttgactagaccccagctcataagaaggactcaaaccaaatcgcactgccttttgccaaaacggactcaaaccaaatcagctatgcttttcatttacggtgtgccttttcatttaaagctgtgcctttcattt

SEQ ID NO: 28107 - DNA, 593 bp, Homo sapiens
gagatccatctcaagtgctgccctctcctggaagtctacctcttgtagtgcagtcacattttactgaaatgtataattctgggaatttcacatgctgagaaatttaaataaaagtttcttgctttatgtgcaaaatttgaaataatccaaacccctctctattagaaaacacataacttcctattgccatagaacatacagctttaaaaagaaacactagctatcttttgtcagttttttgtgacccaccagcattctgaagtacaggatatctgtcagtgccattgcttgaaaacattccccagaagcattcactttagaatggaagttagatgttgtaaactcgggaagaaggccaaatgatgaccatgacacaacttgctacaaaatattaaagctgatgctgggggtgagggggcagaatttaaaagcacacttaaaatagttgaattgtgaaaaggcataaagaaagcgtggtgattaagtgtgggctgaggagccagatggctctagttcaaatcctgaatctaacacctattggatgactttgcccaaataattcaatctctcatgtttcctcatttaaaaaaaaa

SEQ ID NO: 28108 - DNA, 617 bp, Homo sapiens
aagtatattgatttaaccaaatacattaaattaagtggatggatgaaagttaccaatatcataaggaaatagccagacaaatccagaatataggtcattctacaaaacaactttgttggactcgaaaaagtcaatgtcatgtgggaaaaaaaggtacggggatgttatgcttcgaatgtgtcccccaaatttcatgtgttggaaacctaattcccaaattcatctgttgattgcatttggaggtagggtgtttgaggggtaattgggattagataaggttatcaggttgggatccccatgatgggactggtggctttatatgaagaggaagagagacctgagctatacgctcttgttctctatgtgatgccttccaccatgttgtgacacagcaggaaggccctcaccagatgccagtgccagtcccttcaactttccagcctgcagaactataacaaataatgtgttttcataaattactcattctcagatagtctgttatagtaatagaaaacagactaagggtattaatctagaatctaaacagacattcaaatgcaatgtgtgaatcttagttggatcctgaattagacaaaacaaaaacagctaaaaaaaaa

SEQ ID NO: 28109 - DNA, 661 bp, Homo sapiens
  misc_feature (1)..(1): n is a, c, g, or t
ntgtaattttatgagatgctgcttttttaaaattaatttattattattatacttaaagttttagggtacatgtgcacaatgtgcaggttagttacatatgtatatctccttctatttgttcttttgccctttgtgtagtccgttttgtagattgccttaatgtctccaaacactaattgtgtcctattttgtaatgaaatccatattttacaaaattctgtgactagttgagggataagaaatgttgtttaataatagaaaaactttgaaccaaattggctcatttagctattaaatttctgacatccatcctgggtttacaacagtttcagatcaaaggtcaagcagacaacttgagatccttgcacccacacaacagcaactttgctgcatttctacacacatgtttaaagagttttgcttcatgttttgttatttagttttaaacaacatagaagcacctattattctgtgtttttactcttccaaacaattatacttcaggtacaaaaacaaagagaactaaaacaggtgacagatgtattaactaactttatttaggtaatcatttcacaatatataagttcatcaaagtatctcgttatacaccttaaatatatacaattttaattttcgattatatttcaatgaagctggaaag

SEQ ID NO: 28110 - DNA, 439 bp, Homo sapiens
cattgaaatgcaagcattcttgaatcaggtatcttttaacaaataaaatatttatcaggacatacattttatgattttatgttccattttatccaaatcttaccaggttttgactcattttgtcttaatcatgagtttgaataatttgtaactacttcttctgtccttgccccttgccccactcttactgcctactcccactctacacccccatcacattggttaatcagaagttgcctggccagatgtggtgcctcacacctgtattcctagcactttggcagctcaggcaggtagatcgcttgagcctaggagttagagtccagcctgggcaacatggcgaaaccctgtccctaccaaaaaaattacaaaaattagccaggcctggtgttatgtgcctgtagtcccaactacttgggaggctgaggtgggagaatat

SEQ ID NO: 28111 - DNA, 107 bp, Homo sapiens
gttcaataaataagagacattttccatagtattcatattttgaacatgatgaacaagatttagccaaaaaatatgtgcatattcttatgactcagggacatcacaca

SEQ ID NO: 28112 - DNA, 1851 bp, Homo sapiens
gaaaagccgccggtatttctccacctggctctcctctacctccaggcaggcgcacccgaggtccccctcccaccccaccttctgccctcccgcacacttggaccagtgctgttgacccggaagcggacatttctgcagctattctaagcacacgtcggcggagggagcgggacgtggccagcggtcagcggcgaaggaggcaggccctgcgcggggatcacggaagccctgtgattcaccatgaagttccagtacaaggaggtccatccctttgagtatcggaaaaaggaaggagaaaagatccggaagaaatatccggacagggtccccttgattgtagagaaggctccaaaagcaagggtgcctgatctggacaggaggaagtacctagtgccctccgaccttaccgatggccagttctaccttttaatccggaagagaatccacctgagacctgaggacgccttattcttctttgtcaacaacactatccctcccactagtgctaccatgggccaactatatgaggacagtcatgaggaagatgattttctgtatgtggcctacagtaatgagagtgtctatgggaaatgagtggttggaagcccagcagatggaagcacctggacttaggggtaggggaggggtgtgtgtgtgacttggggaaagagagggcggctcccaccgtgaggagacagaaggtgaagacatatagaaactttacaccgcacacaccgtcaacgcattttcacatgctcaactgatattttttgttgcttccttggcccagggagaaagcatgtcaggacagagctgttggattggctttgatagaggaatggggatgatgtaattttatggcattcctgagatttaatttttgtgcagtttcatagaaaggtcggtcaggaggtggacaagttggggtcagagatgatggcagtccagcagcaactccctgtgctcccttctctttgggcagagattctgtttttgacagttgcacaagacaggtagggaaaggggacttgtggtagtgggccatacctggggacgaaaagagacccactgtaattgatgcatcgtggcccccgatcttccgtatcccacacttcttttctcccatcccagttgcaatctcactcacaaacatcacagtaccaccccaggggcggcagtagacaccaacccagaaatttagacagggatctcttatctttggaaaataggggttaggcatgagggtggttatgattaagaagataattttgttgttaaatagcattaaactggaattgacagagtgagttgagcatctctgtctaacctgctctttctctctggtgctcctcatctcacccctaccttggaatttaataagcttcaggcatttccaattgcagactaaaaccacttctaccatctcctctagtattttccatgtatcaggacagagatgtcttatgtagggaaggggcaggtatgaagtgaggtagattatctatacctctcactcattcaggattctcgctcccatgctgctgtcccttcattctcacactcacaggaatgctatgtgatggccagctgcttcccttcttggttatccactgcagctgctagttagaaaggtttgcagggatgacttttagtaaatcatggggattttattgatttattatcacttataggattttgtggggtgggagtggggagcaggaattgcactcagacatgacatttcaattcatctctgcaaatgaaaagggttcttcctcttgggggaaatctgtgtgtcagttctgtcagctgcaagttcttgtgtaatgaagtcaatgctgtcaggccaag

SEQ ID NO: 28113 - DNA, 236 bp, Homo sapiens
gatcttgacccctgtaagtcagcatggggcagtagtactattactgggcgtcactcttacgttgtgcggctggcatgcacttacctgcatcctgtgacagtaaatgaaatgtaagctccctggaaggggcctgggcaatgaggcgccagaagcataaacttctttggctttgtggatttgctgcacaaaacgataaaagaatgatgcccatcacaacctgtttttaatgatgaaaa

SEQ ID NO: 28114 - DNA, 494 bp, Homo sapiens
  misc_feature (489)..(492): n is a, c, g, or t
tttctatttaaaaaatttacatttaacatgagcaaactctagaaatcagcctctgagatggcccacaaggatccctgcatcctggtatcccaagcccttgtgtgatctactccgcttgagggcgggctgggggtattgaggcttttctaatgaacagaatacagaaggcgtgatagatgggatgtcacttttgtggcttctgtcttgggtgctcgctctctctctctctctggatttctcactcttggggaagccagattctttgtctccaggcagccctgtggagagccccacattaacttggaaatggatcttctgacgctgccaacatccatgtaaggaaacttgaaggtgcctcagctccagcccacagcttgatggcagctcatgagagaccctcagccagaggcccccagctaagccactctggatttctgacccacagaaactgtaagataataaatgtgtgttgttttcagccactaaaannnnaa

SEQ ID NO: 28115 - DNA, 332 bp, Homo sapiens
ccatattttccctcccttcacatccaggaaagaggttggtaacagagtacagtctatggaaagaggcctcctgctgggtggacaaatgctggagaccaaagtagccaccccatccctttcattctccatcccctcactctgcttcacttttctgcatctcctcaccgccaccccaacatttcatgatggatttgtttattgccttctcaaccactgaacaggaactccaagggggcagagactttgtttggttcactaatgcatcgttagtttctggaactgtggctagtattaatacatagcaggtgctcaataaaattatgtattgaatg

SEQ ID NO: 28116 - DNA, 1541 bp, Homo sapiens
  misc_feature (28)..(28): n is a, c, g, or t
gggcagtggggttgaggaccctacaganccctcttcagccccgtggtgatgactttcccctgaggaagccctgtagcgtgcctggaggaaggggctctccaaccccagccccacctagccaccatgaacacttcagccccacctgctgtcagccccaacatcaccgtcctggcaccaggaaagggtccctggcaagtggccttcattgggatcaccacgggcctcctgtcgctagccacagtgacaggcaacctgctggtactcatctctttcaaggtcaacacggagctcaagacagtcaataactacttcctgctgagcctggcctgtgctgacctcatcatcggtaccttctccatgaacctctataccacgtacctgctcatgggccactgggctctgggcacgctggcttgtgacctctggctggccctggactatgtggccagcaatgcctccgtcatgaatctgctgctcatcagctttgaccgctacttctccgtgactcggcccctgagctaccgtgccaagcgcacaccccgccgggcagctctgatgatcggcctggcctggctggtttcctttgtgctctgggccccagccatcctcttctggcagtacctggtaggggagcggacagtgctagctgggcagtgctacatccagttcctctcccagcccatcatcacctttggcacagccatggctgccttctacctccctgtcacagtcatgtgcacgctctactggcgcatctaccgggagacagagaaccgagcacgggagctggcagcccttcagggctccgagacgccaggcaaagggggtggcagcagcagcagctcagagaggtctcagccaggggctgagggctcaccagagactcctccaggccgctgctgtcgctgctgccgggcccccaggctgctgcaggcctacagctggaaggaagaagaggaagaggacgaaggctccatggagtccctcacatcctcagagggagaggagcctggctccgaagtggtgatcaagatgccaatggtggaccccgaggcacaggcccccaccaagcagcccccacggagctccccaaatacagtcaagaggccgactaagaaagggcgtgatcgagctggcaagggccagaagccccgtggaaaggagcagctggccaagcggaagaccttctcgctggtcaaggagaagaaggcggctcggaccctgagtgccatcctcctggccttcatcctcacctggacaccgtacaacatcatggtgctggtgtccaccttctgcaaggactgtgttcccgagaccctgtgggagctgggctactggctgtgctacgtcaacagcaccatcaaccccatgtgctacgcactctgcaacaaagccttccgggacacctttcgcctgctgctgctttgccgctgggacaagagacgctggcgcaagatccccaagcgccctggctccgtgcaccgcactccctcccgccaatgctgatagtcccctctcctgcatccctccaccccagtccc

SEQ ID NO: 28117 - DNA, 380 bp, Homo sapiens
gcaggagagtcgggggaccaggtttgggaatacacttgcatgtacagagcctggggcctggacgccacggcctctcatcttaggacctaatgggacccccgaaaggagccaagtggggccctcggcctcttccttcgttccaggcccatgattttccctacacttctccctggcccaggctccagccacaggcacctctcctgcccccgcccaccctcctgaccgcagctcccaggccctggagacctccaggctttcctgccctgggcagccccacctcacagccagagtcaatgccttcatgggaagggctcccagccacacccagagtggcccaaagctgttgaagtcagcatcctttgtcccatcaggaccctcct

SEQ ID NO: 28118 - DNA, 495 bp, Homo sapiens
gtcactcatccaggctggagtgcagtggtgcaatcacagctcactgcagtctcaacctcttggactctagtgatcctctcaccccaccctcccaaatagttgggaccacaggtgcacaccaccacacccagctaatgaattttttttttttccatagagatgaggtctcaccatgctacccaggctgatctcaggttccagggctcaagtgatccttctgtcttggcctcctaaagtactgggattgcaggtgtgagccaccatacccagccccattttatgttcttttataaaatgtctgtttaaaggtttgctcactttaaaactgggggccaggtgtggtggctcaagtctgcaatcccaatactttgggaggttgaggcaggtgaatcacttgagcccaggagttcaagaccagctgggcaacatggcgaaaccttgtctttacaaaaaatacaaaaattagccaaatgtggtggcatctgtcccagctac

SEQ ID NO: 28119 - DNA, 384 bp, Homo sapiens
agggtaatttaattataaattaataaaatcaagttgttacagtttgaggcacacagaatgaaatgcacaaatctttaagtatataccttggtgaatttttacatatgtatatccactcttctataactaccatataaacagctgtttggatttttatttatttatttttatttatttatttttttagacggagctcgctctgtcgccctgactgaagtgcagtagcgcaacctcggcttactgcaagctccgccaccacggcccagcttaattttatgtatttttagtaggagacgggggtttcaccgtattagccggggtgggtctccaatcttctggacctcgtggatccgcccgcctcagcctcccaaagtgctgggatta

SEQ ID NO: 28120 - DNA, 632 bp, Homo sapiens
cattctctccacaaagtagcctttgagcccaccagccacagaatgtgatataaagatcacccctgcttactccagaatgaacagcctgagacacatatcccttcagtagttggtcttgtgaatgcagtgtcctagtgcaaatgcccatcatctgttgaccccatccttgcccctgcctgccccatgctgtggatatctgggccccctcatcacccatcctgggccccctgaccagtgaggatgccccctcccatctagggtactctgcgtctaaggatgaattccagtgtaattttctctcttctgtaggtttatttatggaagattggacctgttcatacatctgtgggggcagccctccatctcccagctatataaagtctctaaccacagtgttgcattgtggggttaccatgtggtctgacacttccttgcatgaactaccctcactccagccctggacagtccagggcctagcaggcagtgtgtggggcctaccaggtcctggcatccaagctgtgtccaataaagttcttagatgtgactggaaaaaaaaattggattaaaaaaaagcttcagaagttacagagccaactacagagaagcataataaatgaaagagtgtcttctag

SEQ ID NO: 28121 - DNA, 362 bp, Homo sapiens
tggtttggtggttgtcatcagcacacttcagggacttgagattttccccagaacatgccccacgtactccaaaaccagcacaaaccagcccgctccctacctcctgttctgccggaggtgtcggccgctgcctgtcaacagtgttgatctggtctcccaggtgaggacagcaacccagtgggctctggaagaaaatgctagaactcaatgtgtcttgtcttttagaaatttctctgtttggccgggcgtggtggctcacgcctgtaatcccagcactttgggaggccaaggcagggggatcacctgaagtcaggttttcgccatggtcaggctggtctcgaactcctgtcgacgcggccgca

SEQ ID NO: 28122 - DNA, 570 bp, Homo sapiens
aattcggcacgaggattttttttttttgttgttattgttgtttataatagagctgttttaatttgtaagacattaatttgaaagccctttaagactgtttaaaagcttgactgaaaagccataagcagagagttttatttcaacaccagtagaaaagttagaaaattaggcagagaaatgaaatagagggatagagagagctaggaaggctctacacattaattctgtaattacaggggatttttagagagtctgaataatgatcaatcaagccttgagtctttcttaatgtaatttgcccatcagtttaaaaatgtgcatgagaacaggccataatacgtagtcagctagagtcccacaaacccttggcatgccttaatgtttgagaattccattctatttctcattaatctcttgaaagcaaagataattttataaatccttttggaccagtgttttagatggtagtggctgtggcagtgacttttaattagccatcctgaacccatcatttaaaatatttattttgctttcagaaattttgaaataagtaagggaaaaaaccaaatt

SEQ ID NO: 28123 - DNA, 953 bp, Homo sapiens
ctcttttactgttctacacagagaaagggaatgacgtgggctcagtgtacaagaagtaccctcaaggaaggggcttgagaaggactagctcttctattgacttacccagaaaggatacagtttgctcaagccaagagtgggtggcaaaatatgggctcaaaaaattgaagctggagatttccagatgcatgggtcccaactgcactcatcaaaagtcaggacagaggtcagcatccgccaaacactgcagcatcttccccagcgttgagatccatggagtggtgagacacatccagtggacgcccagggagatggaggtgtacatcaggcacttggagaaggtgttaaggcgctatgtccagaggctgcagtggctgctgtccgggagccgccgactgtttggcaccgttttggagagcaaagtatgcatattgctggacacgtcagggtccatgggcccctacctgcagcaggtgaagacagagctggttttgctgatttgggaacagctgcggaagtgctgtgacagttttaacctgctcagctttgcagagagccttcagtcatggcaggacacgctggtggagaccacagatgcagcgtgtcatgaggctatgcaatggggtgacccacctgcaagctcagggcagcacctccatcttgcaagcattgctgaaagctttcagtttccatgatctggaaggattgtacctcctgaccgacggaaagccagacacaagctgcagccttgtcctaaatgaagtccaaaaactcagggagaaaagagatgtgaaagtgcacaccatttccttgaactgctcagacagagcggcggttgagttcctgagaaagctggcttccttcaccggcggacgctatcactgccctgtgggtgaggacacactctccaaaattcacagcctgctgaccaaaggcttcatcaatgaaaaggt

SEQ ID NO: 28124 - DNA, 3242 bp, Homo sapiens
  misc_feature (3242)..(3242): n is a, c, g, or t
agcaaaactaaaaggtagatatctggaatgaatgtatatgttgtaattgaggcagatatttgccttaattggaaggatctaactgctttacaaatattaaacaagtgcttgggcatgattgggagaggaggcagcttagctggaagctgtgcccatcttactgtcactggagaataggatgtcagagctgggcaggactggtacccatcatttgcagtttgcatgtggggaaaccaaagccctaagaaacaacagttcctggcccaaaaaatccatagaaagaggtaactagtggcagatttggggcgccaacctgattttatggattttgagttagattctctaccctctatcaatactaaaaatagattaggagggtttttttttctgtttatcatgttgaatttcattgacttaattagtctttaaatttgaaaacatgttttagggagtttagttctagaaatttctcttagattgaagtgacagaatctgaaagaaaagaatatgattgagctatttgttttcctgaacacctcaccttttatgatgcaataagttactctgagtttcttggcagagtttttgacagctgttgctttcaatggattccattcctgtattccttatgggaggttgtttttaaaatagactactgcgattgaaatgaactcaatatgtagttaagttatagttttcttcaatgtatttttagttacttgggtcacaaatgttcaatttcagcatattttagggtgagtaatcaaaaatgtgaatttgcctttgatttcctaccactgtctgagctatcataaagcattctctttagttgtgatttgattctatagtctgtttctaaatgacatttgtctgtttcttaaatgatctcacagccatggtaataatagatgtgtactcagaagatcaataaggtaatattggaattcatgtgttttttgcaattaaggcaggcatttgccaatgtcttcttttaagcagtagttggaaacatctcaattacagtgtaacaccttagagctaaaaacatttgttcaacacaaactagaatcacaccttctcactagatatcaccaagggaatgtggttttaaaaataaaaagaaaacaatataacgtatcatggcaaccagagcttcccatattattgacaagtagggatcattaggttctggtttgaacattctgaatgtgaacaaaatgaaatagtagttaagaggtgttttcccactgtgtttaaagagaacactagtaattctggtttttctttctaactgctttactgtttcaagggtattcttttaaaactctgatttcaaaggatcagttgaatttatactttagttatgggtgttttgttactttttttttttttgtatcatgactcagtatggttcaatttcctagtaagaagtggggatttgtgtttttggagtcctcagctcacatgtcttgttcctccttcagcacaagctaggggagatcctaccaacactgataggtcagtcattgatggcaatttgaatgtgggtattactctgtgagccaccctgcttcgcttgtttgtaaggagaaatgcatctggttatgtgaatttcccgagagcagcagacatggagggccagactttaaaagcaacgcaagcagattcgaagagctgttgccctcttctaaaaaaggcttttgggaggctgtgttacatgcatgccctaaagcagtcagtctgttagtatgagcaagacatctgaagtacacagttgcttttaggcttgtatagttattttctacacatgccaacacacatgatgataaaggaaccttttctaggaggcattgcagggtttcaatacacaggacatgttctagttacagaagccttgctctgctgtcaacaattgggaaatgctcattttttcatgttttgtgaatactctggtcttgctgtaagctaatgtcatggctgtgggatattagagaagtgggtttatgactctgaagaccagcagacaccagactttaaaagtgcttaaattggaatttggaaactacagtaaagaaaccttcagataccagttccatcctgaagccctctgttgaacaacagggccagatcctaaagctctttcagggagctcttctctggggctggaacagttgattatgcaacaccattgtgtggagattggatcaactgagttgtgttatttttgttttaagtcaccttgtgcgagaacctcaaccgcacctatcttgggaaccgggtatacccttttctttagcactgctatcctttttgtcttcagcacaaataagatgttcaagtgagccagaagcaagaagagccattttagtcttcatagctattggctaagagagataatgagctgatggtctattttaaccttgaaagtaaaaatgtatattttttcactacaagtacattgaacagtaaaaagtgtaacagcaaagtatatatttgatgccttctgtcttttcatgataatgtgctaacaagttgtgttaatattttactcagccagagtctcattcatttgctaagcattgggaacattatgtatattgaccttaaacataggtgtcctatatttggattgtgacttgtagactcaagctaaccttactgcctctttttcacacttgttgaaaggtctgtgaagaacatagttaaagatctccaactttggaaaatatacatgatgtgaaactggggtgctatgttaaaaataaatgtatgataactaaaaaaaaaaaaaaaaaaaaaaaaaaaaaaaaaaaaagaaaaaaaaaaaaaagaaaaaagaaagagagaaggaaagaaaaaaaaggaaaaagaaaaaaaagggggggggggggaaacaaaacacagagacgaacaacagaagacaccacaacacgataatgacaagtcgcgcactacgagtgtgaataatagcaacgcagccggcgcgcagacataagagaagcagagaaaacacgctcaggcctgatagggcgagacccaattgggcgggtatcaagcaaacaccacacgcagaatcgtgcgcagcgaaaaaaaatcgggaggctgttcacacccccagtcgcggcggcagtgggatgttatataatcgcgaggttcaatgaaagatgaggtcgcggacatgccggagcagcagcagccactagtacgacgaacgaaccatgagcagatccgatacacgacan

SEQ ID NO: 28125 - DNA, 2780 bp, Homo sapiens
agcaaaactaaaaggtagatatctggaatgaatgtatatgttgtaattgaggcagatatttgccttaattggaaggatctaactgctttacaaatattaaacaagtgcttgggcatgattgggagaggaggcagcttagctggaagctgtgcccatcttactgtcactggagaataggatgtcagagctgggcaggactggtacccatcatttgcagtttgcatgtggggaaaccaaagccctaagaaacaacagttcctggcccaaaaaatccatagaaagaggtaactagtggcagatttggggcgccaacctgattttatggattttgagttagattctctaccctctatcaatactaaaaatagattaggagggtttttttttctgtttatcatgttgaatttcattgacttaattagtctttaaatttgaaaacatgttttagggagtttagttctagaaatttctcttagattgaagtgacagaatctgaaagaaaagaatatgattgagctatttgttttcctgaacacctcaccttttatgatgcaataagttactctgagtttcttggcagagtttttgacagctgttgctttcaatggattccattcctgtattccttatgggaggttgtttttaaaatagactactgcgattgaaatgaactcaatatgtagttaagttatagttttcttcaatgtatttttagttacttgggtcacaaatgttcaatttcagcatattttagggtgagtaatcaaaaatgtgaatttgcctttgatttcctaccactgtctgagctatcataaagcattctctttagttgtgatttgattctatagtctgtttctaaatgacatttgtctgtttcttaaatgatctcacagccatggtaataatagatgtgtactcagaagatcaataaggtaatattggaattcatgtgttttttgcaattaaggcaggcatttgccaatgtcttcttttaagcagtagttggaaacatctcaattacagtgtaacaccttagagctaaaaacatttgttcaacacaaactagaatcacaccttctcactagatatcaccaagggaatgtggttttaaaaataaaaagaaaacaatataacgtatcatggcaaccagagcttcccatattattgacaagtagggatcattaggttctggtttgaacattctgaatgtgaacaaaatgaaatagtagttaagaggtgttttcccactgtgtttaaagagaacactagtaattctggtttttctttctaactgctttactgtttcaagggtattcttttaaaactctgatttcaaaggatcagttgaatttatactttagttatgggtgttttgttactttttttttttttgtatcatgactcagtatggttcaatttcctagtaagaagtggggatttgtgtttttggagtcctcagctcacatgtcttgttcctccttcagcacaagctaggggagatcctaccaacactgataggtcagtcattgatggcaatttgaatgtgggtattactctgtgagccaccctgcttcgcttgtttgtaaggagaaatgcatctggttatgtgaatttcccgagagcagcagacatggagggccagactttaaaagcaacgcaagcagattcgaagagctgttgccctcttctaaaaaaggcttttgggaggctgtgttacatgcatgccctaaagcagtcagtctgttagtatgagcaagacatctgaagtacacagttgcttttaggcttgtatagttattttctacacatgccaacacacatgatgataaaggaaccttttctaggaggcattgcagggtttcaatacacaggacatgttctagttacagaagccttgctctgctgtcaacaattgggaaatgctcattttttcatgttttgtgaatactctggtcttgctgtaagctaatgtcatggctgtgggatattagagaagtgggtttatgactctgaagaccagcagacaccagactttaaaagtgcttaaattggaatttggaaactacagtaaagaaaccttcagataccagttccatcctgaagccctctgttgaacaacagggccagatcctaaagctctttcagggagctcttctctggggctggaacagttgattatgcaacaccattgtgtggagattggatcaactgagttgtgttatttttgttttaagtcaccttgtgcgagaacctcaaccgcacctatcttgggaaccgggtatacccttttctttagcactgctatcctttttgtcttcagcacaaataagatgttcaagtgagccagaagcaagaagagccattttagtcttcatagctattggctaagagagataatgagctgatggtctattttaaccttgaaagtaaaaatgtatattttttcactacaagtacattgaacagtaaaaagtgtaacagcaaagtatatatttgatgccttctgtcttttcatgataatgtgctaacaagttgtgttaatattttactcagccagagtctcattcatttgctaagcattgggaacattatgtatattgaccttaaacataggtgtcctatatttggattgtgacttgtagactcaagctaaccttactgcctctttttcacacttgttgaaaggtctgtgaagaacatagttaaagatctccaactttggaaaatatacatgatgtgaaactggggtgctatgttaaaaataaatgtatgataactaa

SEQ ID NO: 28126 - DNA, 2770 bp, Homo sapiens
agcaaaactaaaaggtagatatctggaatgaatgtatatgttgtaattgaggcagatatttgccttaattggaaggatctaactgctttacaaatattaaacaagtgcttgggcatgattgggagaggaggcagcttagctggaagctgtgcccatcttactgtcactggagaataggatgtcagagctgggcaggactggtacccatcatttgcagtttgcatgtggggaaaccaaagccctaagaaacaacagttcctggcccaaaaaatccatagaaagaggtaactagtggcagatttggggcgccaacctgattttatggattttgagttagattctctaccctctatcaatactaaaaatagattaggagggtttttttttctgtttatcatgttgaatttcattgacttaattagtctttaaatttgaaaacatgttttagggagtttagttctagaaatttctcttagattgaagtgacagaatctgaaagaaaagaatatgattgagctatttgttttcctgaacacctcaccttttatgatgcaataagttactctgagtttcttggcagagtttttgacagctgttgctttcaatggattccattcctgtattccttatgggaggttgtttttaaaatagactactgcgattgaaatgaactcaatatgtagttaagttatagttttcttcaatgtatttttagttacttgggtcacaaatgttcaatttcagcatattttagggtgagtaatcaaaaatgtgaatttgcctttgatttcctaccactgtctgagctatcataaagcattctctttagttgtgatttgattctatagtctgtttctaaatgacatttgtctgtttcttaaatgatctcacagccatggtaataatagatgtgtactcagaagatcaataaggtaatattggaattcatgtgttttttgcaattaaggcaggcatttgccaatgtcttcttttaagcagtagttggaaacatctcaattacagtgtaacaccttagagctaaaaacatttgttcaacacaaactagaatcacaccttctcactagatatcaccaagggaatgtggttttaaaaataaaaagaaaacaatataacgtatcatggcaaccagagcttcccatattattgacaagtagggatcattaggttctggtttgaacattctgaatgtgaacaaaatgaaatagtagttaagaggtgttttcccactgtgtttaaagagaacactagtaattctggtttttctttctaactgctttactgtttcaagggtattcttttaaaactctgatttcaaaggatcagttgaatttatactttagttatgggtgttttgttactttttttttttttgtatcatgactcagtatggttcaatttcctagtaagaagtggggatttgtgtttttggagtcctcagctcacatgtcttgttcctccttcagcacaagctaggggagatcctaccaacactgataggtcagtcattgatggcaatttgaatgtgggtattactctgtgagccaccctgcttcgcttgtttgtaaggagaaatgcatctggttatgtgaatttcccgagagcagcagacatggagggccagactttaaaagcaacgcaagcagattcgaagagctgttgccctcttctaaaaaaggcttttgggaggctgtgttacatgcatgccctaaagcagtcagtctgttagtatgagcaagacatctgaagtacacagttgcttttaggcttgtatagttattttctacacatgccaacacacatgatgataaaggaaccttttctaggaggcattgcagggtttcaatacacaggacatgttctagttacagaagccttgctctgctgtcaacaattgggaaatgctcattttttcatgttttgtgaatactctggtcttgctgtaagctaatgtcatggctgtgggatattagagaagtgggtttatgactctgaagaccagcagacaccagactttaaaagtgcttaaattggaatttggaaactacagtaaagaaaccttcagataccagttccatcctgaagccctctgttgaacaacagggccagatcctaaagctctttcagggagctcttctctggggctggaacagttgattatgcaacaccattgtgtggagattggatcaactgagttgtgttatttttgttttaagtcaccttgtgcgagaacctcaaccgcacctatcttgggaaccgggtatacccttttctttagcactgctatcctttttgtcttcagcacaaataagatgttcaagtgagccagaagcaagaagagccattttagtcttcatagctattggctaagagagataatgagctgatggtctattttaaccttgaaagtaaaaatgtatattttttcactacaagtacattgaacagtaaaaagtgtaacagcaaagtatatatttgatgccttctgtcttttcatgataatgtgctaacaagttgtgttaatattttactcagccagagtctcattcatttgctaagcattgggaacattatgcaccccagcattagccaaggttgtcaaattgtgggttagaggatagttggcttcaggcctctttcctgttaaatagtaagtctgggaaataggggggtgagggaagtagccccagttccagttgttggcagaatattagagaatgaagcatcggttaattaaccccccaagccctga

SEQ ID NO: 28127 - DNA, 340 bp, Homo sapiens
gtctactactactaaattagcaaccgctcgacgtgtaacagcaaagtatatatttgatgccttctgtcttttcatgataatgtgctaacaagttgtgttaatattttactcagccagagtctcattcatttgctaagcattgggaacattatgtatattgaccttaaacataggtgtcctatatttggattgtgacttgtagactcaagctaaccttactgcctctttttcacacttgttgaaaggtctgtgaagaacatagttaaagatctccaactttggaaaatatacatgatgtgaaactggggtgctatgttaaaaataaatgtatgataactaa

SEQ ID NO: 28128 - DNA, 1019 bp, Homo sapiens
cacctccttgttctagtccaccgctgttgacctagttcccgtccttatctccagtccttatctctagcctcgctgttctcccagcctcccgctcagcgctttgttcttgctctgctcagaagcctttagggaacacatgaacccacaggagagcagtggctcttagctaatcccagcctcttggatggtagtcaccacctgttcctgctgactcttggtgaagcactgaatggggaatcagatctgtctacactgcacagatcatctgacgtcatctcctaatgtcttggtgaagcaggtattacaacactgccctgtctgcttacaggattgctgagaacatctgataaggatgatgggcatgggagcttcccatgacctctgcagaggcacaccgttctgggcctgtgccccgctggcttttctgcagccctttccttcctgccctggcctgattctccctgttcttcaggctccctaagctgcaggcttttctccttcatcatttccttgtaatggtgatatgatgtcagtatgattatcctcatttttgtagatgaggaaactgaggccagacaggtcatataacttgcccaaggtcacacagccaagatgaaatggagctgggatttccccgctcctgtgcactcctctaccacagtgctgtgcctgctgtagttggtgtcaggcctgtgggtgcaaactggtacaacaaacgtctgccctctaggaactcttggtctggtcagcagatagagtggatactcggaccaagtcatcctagcagcacattgagtgcaggggacccagagtgaggagctctgcagcctgacgagatctcagcctgcccaggagaagcagagtctctccccctttccccctgccagtctctgggcagtagagatctgtgcagtttctggtcccaggcatggtggtgttcagctcacttcttatcactccatcttcagggtgagtcagactccgggtgactgccctacccgctaagtgcccttggaaca

SEQ ID NO: 28129 - DNA, 516 bp, Homo sapiens
gtaggtctctgatagatttgttgctaatctaaggaaattattttcttagttggagggttttgttgtttgtttatttgtttaaatggtgaactacatacaaaaaggatactgcttcatgaccatgttggttttataccaataatgtaaagtcagcttaactttagaaaatcaatcattgtaacttcacataagtggtataaacttaacataagcataaaatgttatcattttcatatattgttgcatttggcttactaaagcttcattaagagtttttaagtattgaagatttttgcatcataagtgagactgggcagaataggatggtttccttttctttcgctgcaattatctagattgaaaaagtctgataataccaaggtttggcgagccttatacaatgagctaatatgatactatatacattttgtttgtttctacttcattttctgtcctgacagatcagtgtgttcttcattctgttttctttgggtttattttgttatttttctaact

SEQ ID NO: 28130 - DNA, 387 bp, Homo sapiens
tgcttttagaaccgagctgttcagggtcccagatcctctaatgtaatgccagctgaacccagacagtgacttccacctccatgaatgcaggtgattgcatcctttgaaagcctgtttgcatagcagacaatgaagctgagcagagaaaaacaagatgagagacagatggagtaggagacctgagaaagatgggcttgagtccatgaattctggtgttccctaggccacatttgcccccatccttcccagacttctcctatggagaatgcagcaagaaaataccatcttgaagcagagagcagcgctcatcaggcatcagtccttctggagccttgatcttggacctcccagctccaaaataataagtaataaattgttattgcttat

SEQ ID NO: 28131 - DNA, 970 bp, Homo sapiens
attttaaagattagtttcggtccccatcaatcaattatttattaacccatcaataaaaatttaaatgctctgtgaggtacaatagctattaaaagagacagaggcactttctgtgtccagaggggcttttagtctgctctggaaagcaagatgcgtgcagatgagtgacgcagtgcatcgtgtggatgcaaagggagggactcacatgggaaccagaggagctacgaagggaggcagtggggactggtgggtcgagacctggaaataacacatgaataggcaacaaaggtttcctttcctcttccatgcacttcagtccttgaaaaacgtcttaccacggaattccacagcgtaccaagcgattccacagcttgatggcacactctcctttctcagcattcttgaaaatggcgtgtgagccaagccatcttactgagaaattaccttaaaccatttgatgaaccaaaaatattttgtaatacccatctccgacattaggtaggcaaatcacacagaaacaccgaggtcttctgagtcatatttatctgaaaaatcacagcttgggtgcatgtgaagccagaggagcactcctggggcctgcggtgccatcactcagctcccctgggcttcacatggccatggagcacccagcaagtgtaggctctgagccttcagggaggggcggcatcagccagcaccatcgtctcctgggtcttgtgcctcttccttggttgcggtgttgtcagggccagaattgggcaattccgggtgacatccaggtgtggctgctgacacggagcacaggtgaggttcactgaggtaagtgggccatggccttgggcttctagttcagagcacaccatccactcagcatgtgaacccagctccaaagcgtatgtgtgcatgtgtgtacctgtgcacattgcgcatgtctctgtgtatgcatgtgctttgatgcatgttgatgtac

SEQ ID NO: 28132 - DNA, 411 bp, Homo sapiens
gggcatcgagacaaaagccgagttccctggggacttaccagaacattccagccccacccccgacctgagctcccccaaagagaacccttccccactggaggcatggccccttcaggggagcagtgagaagctttgccagctgcaagtcccctggatcagctcacacctcagaacatcttgtccccagtgagctggcaggggcgccggcccagggcggggggcgctgctgtatctaaccgggtcgattgtgcataaccgtctaggccggttcgtggaatgttcgtggggccccctgcccctccctcagcctccccccgcatccccccaagaaaggaaaattatttttcgtattgtaaactttaaacatgaaaaagctgtttttaatttagcagaaactggcttgaatcttca

SEQ ID NO: 28133 - DNA, 3567 bp, Homo sapiens
agcggactcgaacgcgcgacggcggggggaagatggcggagtccggcggtagcagcggtggtgctggtggcggcggcgctttcggcgcgggcccgggccccgagcgcccgaacagcacggccgacaagaacggggccctcaagtgcaccttctcggcacccagccacagcaccagcctcctgcagggcctggccaccctccgcgctcagggccagctcctcgatgttgtgctgactattaacagagaggcctttcctgcacacaaggtcgtcctggctgcctgcagcgactacttcagggccatgttcaccggcggcatgcgggaggcaagccaggacgtcatcgagctgaagggcgtgtcggcccgtggcctgcggcacatcatcgacttcgcctacagcgccgaggtgacactggacctggactgcgtgcaggacgtgctgggcgcggccgtgttcttgcagatgctgcccgtggtggagctgtgcgaggagttcctgaaggcggccatgagcgtggagacctgcctcaacatcggccagatggccaccaccttcagcctggcctcgctgcgagagtcggtggatgccttcaccttccggcacttcctgcagatcgccgaggaggaggatttcctgcgcctgccactggagcgcctggtcttcttcctgcagagcaaccggctgcagagctgtgccgagatcgacctgttccgcgcggccgtccgctggctgcagcatgacccggcccggcggccgcgcgccagccacgtgctctgccacattcgcttcccgctcatgcagtcgtccgagctggtggacagcgtgcagacgctggacatcatggtggaggacgtgctgtgccgccagtatctgctggaggccttcaactaccaggtgctgcccttccggcagcacgagatgcagtctccgcgcaccgccgtgcgctcggatgtgccctcgctcgtcaccttcggcggcacgccctacaccgacagcgaccgctcggtcagcagcaaggtctaccagctgcctgagccgggagcccgccacttccgcgagctcacggagatggaggtaggctgcagccacacgtgcgtggccgtgctggacaattttgtgtacgtggccggggggcagcacctgcagtaccgcagcggcgagggcgcagtggacgcctgctaccgctacgacccccacctgaatcgctggctgcgcctgcaggccatgcaggaaagccgcatccagttccagctgaacgtgctgtgcggcatggtgtacgccacgggcggccgcaaccgagccggcagcctggcctccgtggagcggtactgcccccggcgcaatgagtggggctacgcctgctcgctgaagcgccgtacctggggccatgctggggccgcctcagggggccgcctctacatctcgggtggctacgggatctcagtggaggacaagaaggccctgcactgctacgaccccgtggccgaccagtgggagttcaaggcgcccatgagcgaaccccgcgtgctacacgccatggtgggtgccggcggccgcatctatgccctcgggggccgcatggaccacgtggaccgctgcttcgacgtgctggctgtggagtactatgtgccggagacggaccagtggaccagcgtgagccccatgcgggccggccagtcagaggccggctgctgcctgctggagaggaagatctacatcgtcgggggctacaactggcgtctcaacaacgtcacgggcatcgtacaggtgtacaacacggacaccgacgagtgggagcgggacctgcacttcccggagtccttcgcaggcatagcctgcgcccccgtcctgctgccccgggccgggaccaggaggtagcccccaagacccccgggaccctggcctgaccgcatgttgtctccaagtggggcttggcgaatgcacgtctgcctgagaaccccagtgccccccttcgcccgggctgcccttgaggggcctgctgcgttgataagcccccctcccaggggtccctccctccctccttcccaaagcagatcctggctgcgagtccatccgagggagcctgccggcaaagcgtctgacatgtggtggcagcaaattcgtccccggggtggtttcctcgcctggcccccgagtccccacgggctggcgggtggaatcccaggtctccagggggtccctgtgcagctccatctcacttctctactgcctcccagccccacggtttcaggcattcagatgtgagctcatcaacattgaacccaaagtcggtggtatatgactcaccctccttccaagtctcctgcgcgcgtgtttttaaaataaactcacccgaaacgtccgtaacacacggacctccaggagcagtgagaggtggcttagaagcccctggtttggggtgggtggaggaggagggcacgtgtctgcctcccctggggtgccctccttcccccatcccaagctgctgaggggaggccctggtcatgcctcagttcctgccttcatctgctttccggaggaaaaaccatatcaactcctagaaacgctccttaggggcttgggaccttccatttggcactgagcatcttgtggggccttaactggctgagacatcccggccctctacatttgccctgttggccaggcagtccccttcccgcaattggagggcgacgctaacttcagaatcccatagtggcgcttgccgcaggtctggtggggtgtcttttttctcctccctcctttccacccctccgcgccctgccactccctggcctgccctgtttttgggtcaacattgctacggagccagcagtgaggcctttcccttcaagggctctgtggtatctctggccacatttgttctaatgtctgaacctctaaatcttttctttttgattggttttactgtttttaagaagccagcactgctgtctcatagatgggatttgtactcttggggcaacttaaagtgtctctctcgctgctaacagacgattgatgtcttgtctctgtgacccactcaccatgtaaagaattaacctcctatcttagcagacatcgtctcctaatatttccctttatttaataaaaatgttatggtgaagagatggagccggcccagcactgagcttgtgcggcttgggtctgattggtcacagattcctcgtgtgtcctccgcgtgtctgggggctcctctcccccgcctcaaccttttccagcctttcagaggagtcggcagtgggctgggctttggctcaggggcgcagaggcagcaggaagcgtggccaggactttcaccctggcgttttttgttgttggtttttttgtttttttgagacggagcctcgctctgtcacccaggctggagtgcagtggcgtgatctcggctcactgcaacctctgcctcctgggttcaagcaattcacctgcctcagcagcctccccccgcatccccccaagaaaggaaaattatttttcgtattgtaaactttaaacatgaaaaagctgtttttaatttagcagaaactggcttgaatcttca

SEQ ID NO: 28134 - DNA, 3335 bp, Homo sapiens
agcggactcgaacgcgcgacggcggggggaagatggcggagtccggcggtagcagcggtggtgctggtggcggcggcgctttcggcgcgggcccgggccccgagcgcccgaacagcacggccgacaagaacggggccctcaagtgcaccttctcggcacccagccacagcaccagcctcctgcagggcctggccaccctccgcgctcagggccagctcctcgatgttgtgctgactattaacagagaggcctttcctgcacacaaggtcgtcctggctgcctgcagcgactacttcagggccatgttcaccggcggcatgcgggaggcaagccaggacgtcatcgagctgaagggcgtgtcggcccgtggcctgcggcacatcatcgacttcgcctacagcgccgaggtgacactggacctggactgcgtgcaggacgtgctgggcgcggccgtgttcttgcagatgctgcccgtggtggagctgtgcgaggagttcctgaaggcggccatgagcgtggagacctgcctcaacatcggccagatggccaccaccttcagcctggcctcgctgcgagagtcggtggatgccttcaccttccggcacttcctgcagatcgccgaggaggaggatttcctgcgcctgccactggagcgcctggtcttcttcctgcagagcaaccggctgcagagctgtgccgagatcgacctgttccgcgcggccgtccgctggctgcagcatgacccggcccggcggccgcgcgccagccacgtgctctgccacattcgcttcccgctcatgcagtcgtccgagctggtggacagcgtgcagacgctggacatcatggtggaggacgtgctgtgccgccagtatctgctggaggccttcaactaccaggtgctgcccttccggcagcacgagatgcagtctccgcgcaccgccgtgcgctcggatgtgccctcgctcgtcaccttcggcggcacgccctacaccgacagcgaccgctcggtcagcagcaaggtctaccagctgcctgagccgggagcccgccacttccgcgagctcacggagatggaggtaggctgcagccacacgtgcgtggccgtgctggacaattttgtgtacgtggccggggggcagcacctgcagtaccgcagcggcgagggcgcagtggacgcctgctaccgctacgacccccacctgaatcgctggctgcgcctgcaggccatgcaggaaagccgcatccagttccagctgaacgtgctgtgcggcatggtgtacgccacgggcggccgcaaccgagccggcagcctggcctccgtggagcggtactgcccccggcgcaatgagtggggctacgcctgctcgctgaagcgccgtacctggggccatgctggggccgcctcagggggccgcctctacatctcgggtggctacgggatctcagtggaggacaagaaggccctgcactgctacgaccccgtggccgaccagtgggagttcaaggcgcccatgagcgaaccccgcgtgctacacgccatggtgggtgccggcggccgcatctatgccctcgggggccgcatggaccacgtggaccgctgcttcgacgtgctggctgtggagtactatgtgccggagacggaccagtggaccagcgtgagccccatgcgggccggccagtcagaggccggctgctgcctgctggagaggaagatctacatcgtcgggggctacaactggcgtctcaacaacgtcacgggcatcgtacaggtgtacaacacggacaccgacgagtgggagcgggacctgcacttcccggagtccttcgcaggcatagcctgcgcccccgtcctgctgccccgggccgggaccaggaggtagcccccaagacccccgggaccctggcctgaccgcatgttgtctccaagtggggcttggcgaatgcacgtctgcctgagaaccccagtgccccccttcgcccgggctgcccttgaggggcctgctgcgttgataagcccccctcccaggggtccctccctccctccttcccaaagcagatcctggctgcgagtccatccgagggagcctgccggcaaagcgtctgacatgtggtggcagcaaattcgtccccggggtggtttcctcgcctggcccccgagtccccacgggctggcgggtggaatcccaggtctccagggggtccctgtgcagctccatctcacttctctactgcctcccagccccacggtttcaggcattcagatgtgagctcatcaacattgaacccaaagtcggtggtatatgactcaccctccttccaagtctcctgcgcgcgtgtttttaaaataaactcacccgaaacgtccgtaacacacggacctccaggagcagtgagaggtggcttagaagcccctggtttggggtgggtggaggaggagggcacgtgtctgcctcccctggggtgccctccttcccccatcccaagctgctgaggggaggccctggtcatgcctcagttcctgccttcatctgctttccggaggaaaaaccatatcaactcctagaaacgctccttaggggcttgggaccttccatttggcactgagcatcttgtggggccttaactggctgagacatcccggccctctacatttgccctgttggccaggcagtccccttcccgcaattggagggcgacgctaacttcagaatcccatagtggcgcttgccgcaggtctggtggggtgtcttttttctcctccctcctttccacccctccgcgccctgccactccctggcctgccctgtttttgggtcaacattgctacggagccagcagtgaggcctttcccttcaagggctctgtggtatctctggccacatttgttctaatgtctgaacctctaaatcttttctttttgattggttttactgtttttaagaagccagcactgctgtctcatagatgggatttgtactcttggggcaacttaaagtgtctctctcgctgctaacagacgattgatgtcttgtctctgtgacccactcaccatgtaaagaattaacctcctatcttagcagacatcgtctcctaatatttccctttatttaataaaaatgttatggtgaagagatggagccggcccagcactgagcttgtgcggcttgggtctgattggtcacagattcctcgtgtgtcctccgcgtgtctgggggctcctctcccccgcagcctccccccgcatccccccaagaaaggaaaattatttttcgtattgtaaactttaaacatgaaaaagctgtttttaatttagcagaaactggcttgaatcttca

SEQ ID NO: 28135 - DNA, 4627 bp, Homo sapiens
cgcgtcgtttggagctgcgacgccaaacatggcgtgttcctagaagccgctttcggcatcagtaggcggcggcgtggggtctggcagcgtggggagagggaccaaccgacgccacttcgtgttgggaagtgggagcgggagggccgggcaattcccgaccgaaccaaacggtttccatggatctcaatagtgccagcactgttgttcttcaggtgttaacacaggccaccagtcaggatactgctgtgttaaaaccagctgaggagcagttgaagcagtgggagacacagccaggtttctattcagtgttgctgaatattttcaccaaccacactttggatataaatgtaaggtggcttgctgtactgtattttaaacatggaattgatcgctactggagacgtgtagcacctcatgctctctcagaggaggagaaaactactctgcgtgcagggctcatcaccaacttcaatgaaccaataaaccagattgcaactcagattgcagtgctcattgcaaaagttgctagattggattgtcccagacagtggcctgaactaattcccactcttatagagtctgttaaagtccaggatgatcttcgacagcacagagcattacttaccttctatcatgttaccaagacactggcatctaaacgacttgctgctgatagaaaactattttatgatttagcttctggaatttataattttgcctgctctctgtggaatcaccacacagacacattcctgcaagaagtttcttctggcaatgaagctgcaattttgagttcactagaacgaacactgctatcattgaaagtgctgcgtaagttaactgttaatggatttgtggaacctcataagaatatggaggtgatgggttttttacatggaatatttgaacgtctaaaacagtttctggaatgcagtagaagtataggtacagataatgtgtgtagagatagactggaaaagaccatcattctttttactaaagtgcttttggacttcttggatcagcatcctttttcatttactcctctaattcagagatcactggaattttctgtaagctatgtttttacagaagttggtgaaggcgttacatttgaacgattcattgtccaatgtatgaatcttattaagatgattgtcaaaaattatgcttataagccatccaaaaattttgaagatagcagccctgaaactcttgaagcccataagattaagatggcattcttcacatatcctactttgacagagatatgtagaagattagtctctcattatttcctattaactgaagaagaactgacaatgtgggaagaagacccagaaggctttacagtggaagaaacaggaggagattcttggaaatatagtttgaggccatgcactgaagtattatttatagatatattccatgaatataatcagactcttactcctgtacttctagaaatgatgcaaacacttcaaggacccacaaatgtggaagatatgaatgcactgttaatcaaagatgctgtgtataatgctgttggattagctgcttatgagctctttgacagtgttgattttgatcagtggtttaaaaaccagcttcttccagaattacaagtcattcacaataggtataagccattgcgacgcagggtgatttggctcatcggtcagtggatttctgtgaaattcaagtctgacttaagacccatgctttatgaagcaatctgtaacttgcttcaagatcaagatttagtggtccgtattgaaacagctacaactttgaagttaactgttgatgattttgaatttagaacagatcagtttctaccgtatttggaaaccatgttcacactactttttcagttactgcagcaagttacagaatgtgacacaaagatgcatgttttgcatgtcctttcttgtgtgatcgaaagagtcaacatgcagatacgaccatatgtgggatgtttggtacaatatttgcccctcctttggaagcagagtgaagaacacaatatgttgagatgtgctattttgacaacacttattcatcttgttcagggattaggagcagacagcaagaacctgtaccctttcctgctcccagttattcaactgagtacagatgtttcacagcctccacatgtttatcttctggaagatggtttagaattatggttagtaactttggaaaacagtccatgtattacaccagagttgcttcgtatatttcagaatatgtcaccacttcttgaactaagttcagaaaatcttagaacttgctttaagatcatcaatggttatatctttttatcatcaacagaatttttacagacatacgcagtaggtctatgccagtccttttgtgaacttttaaaggaaattactacagaaggtcaagttcaggtgctcaaggttgtggaaaatgcccttaaagtgaacccaatactaggtccacaaatgtttcaaccgattttaccctatgttttcaagggtattatagaaggggagaggtatcctgtagtgatgtccacgtatcttggagttatgggtcgagttctactacaaaacactagttttttttcttcactacttaatgagatggcccataaatttaatcaggagatggaccagcttttgggaaatatgattgaaatgtgggttgatcgaatggacaacattacccagcctgaaagaagaaaactttcagctttggctttgctctctcttctgccatctgataatagtgttatccaagataaattctgtgggattataaacatttcagtagaaggcctgcatgatgtcatgacggaagatcctgaaacaggaacttataaagactgtatgttgatgtctcatcttgaggaaccaaaagtaacagaagatgaagaaccacccacagaacaagataagaggaaaaagatgctggccctgaaggaccctgttcatacagtgtcactgcagcagttcatctacgagaagctcaaggcacagcaggagatgctaggagaacaaggtttccagtccctcatggaaacagtggatacggagattgtcacccagctacaggagtttttgcaaggattctaagagcacatgacatgtggctgcctcccctttcagaaacaagctgagtaacccagcctgccgtttgtatgtgagagcctgctgagatgaagaaatcacttcatgaaaataagcaaagaccacacattttttactacaaaatgtaaaggataaatgtaaatcctgcataactaaaatcacaaacctattcctcaaaagaatttaattttatatttatgagggggcccttcactaaaaagtacatgtaaaagtacatttgatgacaatagctgcttagtttcctgttaagagaagaaactttatcttttaattatgtgctcttaatatttgaagatgagagttaatacctgagatgtttttctgcaaccaaaattcattaaatttggctgccttatcctttttttaagctaatgaaactacaggtttgaaaaatgacaaagctgttcagatgatgctattaaagaaatgtgtgtactaagcaaaaatatataaatagtgacaaatacacattaccaagcttatcttgcaagggagttattttcatctaacatagaaagtgtgttttatcagacaaatgcttttattttcattctaataatttgatacagaaattagtaaaggcatttttttctttttttttccagtaaatacattgggtctataaatgtgcatttgtaagggccacaaaagtgaacgtgtggtactgtagtaccacgtgggagacctctggttatggtttagtcctagttcctttgttactcctgtgagcaccgagaagaactgggcgactcccagtcccacctgtgctgtgacagtcccacgtggctatgacagactgtttagtacttacccttctcaggttcctcagtgcaggggtgcatcagggcctcaataataggggtatacctgggaggatccagcagtaatccccagggtactaggattactagtactctgatggaactagtcttccttccttattcctcgaacatgcagtacataaaaaggggaaaaggagaaaaaaaaagccttactttgttttacttgccatttattgtaaggaaactttaaagcattttttaggaaatactcaaaagcaaggttggaaaatgttttatctttctatagaaagttgggtacagtatgtaactgcgggaaacccactgcccctttgtaagctgtggaacccaaactgtatggggatatttgatgttttcagaaagaggaagaaaatatggtccaaattaaattttccaaagatactcaccttggactgatttgtctgactacttttcttgctccccccaaaaaatgagttcttaaaaattgcccagtgacttatagagaattttcttttatactctagctttgattctgtgctagtaggtatcagtattgcaggtggcaaatcctagttacccttttaatttatcttcatttaaagacaaaaagctcctttcaagtgatatttctttatcagtattactcagtcctgaagactgatccaagaagaatttctttttgtt

SEQ ID NO: 28136 - DNA, 1201 bp, Homo sapiens
gggggtggaggtcagcagtgccacagaacaaactggagttaagaaatgtcgttcttcagatttaaaaagaaaacctttactgaatcagctgagtgttaataatacgaatttccttttcttgccaattctgatctgaacagaaaatccaagaacagggatatgtgtggattacagttttctctgccttgcctacgactgtttctgccttgcatccaagggtccttaagccgttgtcttcattgattcatcttcaggcaaattctaatccttgggaatgtaactgcaaacttttgggccttcgagactggctagcatcttcagccattactctaaacatctattgtcagaatcccccatccatgcgtggcagagcattacgttatattaacattacaaattgtgttacatcttcaataaatgtatccagagcttgggctgttgtaaaatctcctcatattcatcacaagactactgcgctaatgatggcctggcataaagtaaccacaaatggcagtcctctggaaaatactgagactgagaacattactttctgggaacgaattcctacttcacctgctggtagattttttcaagagaatgcctttggtaatccattagagactacagcagtgttacctgtgcaaatacaacttactacttctgttaccttgaacttggaaaaaaacagtgctctaccgaatgatgctgcttcaatgtcagggaaaacatctctaatttgtacacaagaagttgagaagttgaatgaggcttttgacattttgctagcttttttcatcttagcttgtgttttaatcatttttttgatctacaaagttgttcagtttaaacaaaaactaaaggcatcagaaaactcaagggaaaatagacttgaatactacagcttttatcagtcagcaaggtataatgtaactgcctcaatttgtaacacttccccaaattctctagaaagtcctggcttggagcagattcgacttcataaacaaattgttcctgaaaatgaggcacaggtcattctttttgaacattctgctttataactcaactaaatattgtctataagaaacttcagtgccatggacatgatttaaactgaaacctccttatataattatatactttagttggaaatataatgaattatatgaggttagcattattaaaatatgtttttaataaaaaa

SEQ ID NO: 28137 - DNA, 879 bp, Homo sapiens
gggggtggaggtcagcagtgccacagaacaaactggagttaagaaatgtcgttcttcagatttaaaaagaaaacctttactgaatcagctgagtgttaataatacgaatttccttttcttgtgttatccaagataaattctgtgggattataaacatttcagtagaaggcctgcatgatgtcatgacggaagatcctgaaacaggaacttataaagactgtatgttgatgtctcatcttgaggaaccaaaagtaacagaagatgaagaaccacccacagaacaagataagaggaaaaagatgctggccctgaaggaccctgttcatacagtgtcactgcagcagttcatctacgagaagctcaaggcacagcaggagatgctaggagaacaaggtttccagtccctcatggaaacagtggatacggagattgtcacccagctacaggagtttttgcaaggattctaagagcacatgacatgtggctgcctcccctttcagaaacaagctgagtaacccagcctgccgtttgtatgtgagagcctgctgagatgaagaaatcacttcatgaaaataagcaaagaccacacattttttactacaaaatgtaaaggataaatgtaaatcctgcataactaaaatcacaaacctattcctcaaaagaatttaattttatatttatgagggggcccttcactaaaaagtacatgtaaaagtacatttgatgacaatagctgcttagtttcctgttaagagaagaacttacttatatgtgcctaattgaaagaggataccgcgagtcttggccctcttatgggcccccttacacgaccacgcgagcacggctcgtctccacgtgcaatgtggccccctccggggc

SEQ ID NO: 28138 - DNA, 539 bp, Homo sapiens
atatcgtcgacccacgcgtccggaaaaggagaaaaaaaaagccttactttgttttacttgccatttattgtaaggaaactttaaagcattttttaggaaatactcaaaagcaaggttggaaaatgttttatctttctatagaaagttgggtacagtatgtaactgcgggaaacccactgcccctttgtaagctgtggaacccaaactgtatggggatatttgatgttttcagaaagaggaagaaaatatggtccaaattaaattttccaaagatactcaccttggactgatttgtctgactacttttcttgctccccccaaaaaatgagttcttaaaaattgcccagtgacttatagagaattttcttttatactctagctttgattctgtgctagtaggtatcagtattgcaggtggcaaatcctagttacccttttaatttatcttcatttaaagacaaaaagctcctttcaagtgatatttctttatcagtattactcagtcctgaagactgatccaagaagaatttctttttgtt

SEQ ID NO: 28139 - DNA, 749 bp, Homo sapiens
gggggtggaggtcagcagtgccacagaacaaactggagttaagaaatgtcgttcttcagatttaaaaagaaaacctttactgaatcagctgagtgttaataatacgaatttccttttcttgccaattctgatctgaacagaaaatccaagaacagggatatgtgtggattacagttttctctgccttgcctacgactgtttctggttgttacctgttatcttttattattactccacaaagaaatacttggatgttcgtctgtttgtcagctctgcactgggagacaaattaactgccgtaacttaggcctttcgagtattcctaagaattttcctgaaagtacagtttttctgtatctgactgggaataatatatcttatataaatgaaagtgaattaacaggacttcattctcttgtagcattgtatttggataattctaacattctgtatgtatatccaaaagcctttgttcaattgaggcatctatattttctatttctaaataataatttcatcaaacgcttagatcctggaatatttaagggacttttaaatcttcgtaatttatatttacagtataatcaggtatcttttgttccgagaggagtatttaatgatctagtttcagttcagtacttaaatctacaaaggaatcgcctcactgtccttgggagtggtacctttgttggtatggttgctcttcggatacttgatttatcaaacaataacattttgaggatatcaga

SEQ ID NO: 28140 - DNA, 320 bp, Homo sapiens
gtgagaccctgtctctgcaaaaagtaaaaaaaggaaaaaaaaattagaccagagtggtggcgcatacctgtagtcccaactcttcaggaatctgaggcaggaggattgtttgagcccaggaggttgaggctgccgtgtgccatgatgatgccactgcgttctagcctggattacaaagcaaaacccgtctcttaaaaaaaaaaaaaaaaaaattaaagattcccaacattaagtcagacagataagaaactgtttataagaaactaagaactatattcatattaaattatgacgtttaatctgagttttttttctttttt

SEQ ID NO: 28141 - DNA, 3746 bp, Homo sapiens
cgcgtcgtttggagctgcgacgccaaacatggcgtgttcctagaagccgctttcggcatcagtaggcggcggcgtggggtctggcagcgtggggagagggaccaaccgacgccacttcgtgttgggaagtgggagcgggagggccgggcaattcccgaccgaaccaaacggtttccatggatctcaatagtgccagcactgttgttcttcaggtgttaacacaggccaccagtcaggatactgctgtgttaaaaccagctgaggagcagttgaagcagtgggagacacagccaggtttctattcagtgttgctgaatattttcaccaaccacactttggatataaatgtaaggtggcttgctgtactgtattttaaacatggaattgatcgctactggagacgtgtagcacctcatgctctctcagaggaggagaaaactactctgcgtgcagggctcatcaccaacttcaatgaaccaataaaccagattgcaactcagattgcagtgctcattgcaaaagttgctagattggattgtcccagacagtggcctgaactaattcccactcttatagagtctgttaaagtccaggatgatcttcgacagcacagagcattacttaccttctatcatgttaccaagacactggcatctaaacgacttgctgctgatagaaaactattttatgatttagcttctggaatttataattttgcctgctctctgtggaatcaccacacagacacattcctgcaagaagtttcttctggcaatgaagctgcaattttgagttcactagaacgaacactgctatcattgaaagtgctgcgtaagttaactgttaatggatttgtggaacctcataagaatatggaggtgatgggttttttacatggaatatttgaacgtctaaaacagtttctggaatgcagtagaagtataggtacagataatgtgtgtagagatagactggaaaagaccatcattctttttactaaagtgcttttggacttcttggatcagcatcctttttcatttactcctctaattcagagatcactggaattttctgtaagctatgtttttacagaagttggtgaaggcgttacatttgaacgattcattgtccaatgtatgaatcttattaagatgattgtcaaaaattatgcttataagccatccaaaaattttgaagatagcagccctgaaactcttgaagcccataagattaagatggcattcttcacatatcctactttgacagagatatgtagaagattagtctctcattatttcctattaactgaagaagaactgacaatgtgggaagaagacccagaaggctttacagtggaagaaacaggaggagattcttggaaatatagtttgaggccatgcactgaagtattatttatagatatattccatgaatataatcagactcttactcctgtacttctagaaatgatgcaaacacttcaaggacccacaaatgtggaagatatgaatgcactgttaatcaaagatgctgtgtataatgctgttggattagctgcttatgagctctttgacagtgttgattttgatcagtggtttaaaaaccagcttcttccagaattacaagtcattcacaataggtataagccattgcgacgcagggtgatttggctcatcggtcagtggatttctgtgaaattcaagtctgacttaagacccatgctttatgaagcaatctgtaacttgcttcaagatcaagatttagtggtccgtattgaaacagctacaactttgaagttaactgttgatgattttgaatttagaacagatcagtttctaccgtatttggaaaccatgttcacactactttttcagttactgcagcaagttacagaatgtgacacaaagatgcatgttttgcatgtcctttcttgtgtgatcgaaagagtcaacatgcagatacgaccatatgtgggatgtttggtacaatatttgcccctcctttggaagcagagtgaagaacacaatatgttgagatgtgctattttgacaacacttattcatcttgttcagggattaggagcagacagcaagaacctgtaccctttcctgctcccagttattcaactgagtacagatgtttcacagcctccacatgtttatcttctggaagatggtttagaattatggttagtaactttggaaaacagtccatgtattacaccagagttgcttcgtatatttcagaatatgtcaccacttcttgaactaagttcagaaaatcttagaacttgctttaagatcatcaatggttatatctttttatcatcaacagaatttttacagacatacgcagtaggtctatgccagtccttttgtgaacttttaaaggaaattactacagaaggtcaagttcaggtgctcaaggttgtggaaaatgcccttaaagtgaacccaatactaggtccacaaatgtttcaaccgattttaccctatgttttcaagggtattatagaaggggagaggtatcctgtagtgatgtccacgtatcttggagttatgggtcgagttctactacaaaacactagttttttttcttcactacttaatgagatggcccataaatttaatcaggagatggaccagcttttgggaaatatgattgaaatgtgggttgatcgaatggacaacattacccagcctgaaagaagaaaactttcagctttggctttgctctctcttctgccatctgataatagtgttatccaagataaattctgtgggattataaacatttcagtagaaggcctgcatgatgtcatgacggaagatcctgaaacaggaacttataaagactgtatgttgatgtctcatcttgaggaaccaaaagtaacagaagatgaagaaccacccacagaacaagataagaggaaaaagatgctggccctgaaggaccctgttcatacagtgtcactgcagcagttcatctacgagaagctcaaggcacagcaggagatgctaggagaacaaggtttccagtccctcatggaaacagtggatacggagattgtcacccagctacaggagtttttgcaaggattctaagagcacatgacatgtggctgcctcccctttcagaaacaagctgagtaacccagcctgccgtttgtatgtgagagcctgctgagatgaagaaatcacttcatgaaaataagcaaagaccacacattttttactacaaaatgtaaaggataaatgtaaatcctgcataactaaaatcacaaacctattcctcaaaagaatttaattttatatttatgagggggcccttcactaaaaagtacatgtaaaagtacatttgatgacaatagctgcttagtttcctgttaagagaagaaactttatcttttaattatgtgctcttaatatttgaagatgagagttaatacctgagatgtttttctgcaaccaaaattcattaaatttggctgccttatcctttttttaagctaatgaaactacaggtttgaaaaatgacaaagctgttcagatgatgctattaaagaaatgtgtgtactaagcaaaaatatataaatagtgacaaatacacattaccaagcttatcttgcaagggagttattttcatctaacatagaaagtgtgttttatcagacaaatgcttttattttcattctaataatttgatacagaaattagtaaaggcatttttttctttttttttccagt

SEQ ID NO: 28142 - DNA, 4556 bp, Homo sapiens
cgcgtcgtttggagctgcgacgccaaacatggcgtgttcctagaagccgctttcggcatcagtaggcggcggcgtggggtctggcagcgtggggagagggaccaaccgacgccacttcgtgttgggaagtgggagcgggagggccgggcaattcccgaccgaaccaaacggtttccatggatctcaatagtgccagcactgttgttcttcaggtgttaacacaggccaccagtcaggatactgctgtgttaaaaccagctgaggagcagttgaagcagtgggagacacagccaggtttctattcagtgttgctgaatattttcaccaaccacactttggatataaatgtaaggtggcttgctgtactgtattttaaacatggaattgatcgctactggagacgtgtagcacctcatgctctctcagaggaggagaaaactactctgcgtgcagggctcatcaccaacttcaatgaaccaataaaccagattgcaactcagattgcagtgctcattgcaaaagttgctagattggattgtcccagacagtggcctgaactaattcccactcttatagagtctgttaaagtccaggatgatcttcgacagcacagagcattacttaccttctatcatgttaccaagacactggcatctaaacgacttgctgctgatagaaaactattttatgatttagcttctggaatttataattttgcctgctctctgtggaatcaccacacagacacattcctgcaagaagtttcttctggcaatgaagctgcaattttgagttcactagaacgaacactgctatcattgaaagtgctgcgtaagttaactgttaatggatttgtggaacctcataagaatatggaggtgatgggttttttacatggaatatttgaacgtctaaaacagtttctggaatgcacttttggacttcttggatcagcatcctttttcatttactcctctaattcagagatcactggaattttctgtaagctatgtttttacagaagttggtgaaggcgttacatttgaacgattcattgtccaatgtatgaatcttattaagatgattgtcaaaaattatgcttataagccatccaaaaattttgaagatagcagccctgaaactcttgaagcccataagattaagatggcattcttcacatatcctactttgacagagatatgtagaagattagtctctcattatttcctattaactgaagaagaactgacaatgtgggaagaagacccagaaggctttacagtggaagaaacaggaggagattcttggaaatatagtttgaggccatgcactgaagtattatttatagatatattccatgaatataatcagactcttactcctgtacttctagaaatgatgcaaacacttcaaggacccacaaatgtggaagatatgaatgcactgttaatcaaagatgctgtgtataatgctgttggattagctgcttatgagctctttgacagtgttgattttgatcagtggtttaaaaaccagcttcttccagaattacaagtcattcacaataggtataagccattgcgacgcagggtgatttggctcatcggtcagtggatttctgtgaaattcaagtctgacttaagacccatgctttatgaagcaatctgtaacttgcttcaagatcaagatttagtggtccgtattgaaacagctacaactttgaagttaactgttgatgattttgaatttagaacagatcagtttctaccgtatttggaaaccatgttcacactactttttcagttactgcagcaagttacagaatgtgacacaaagatgcatgttttgcatgtcctttcttgtgtgatcgaaagagtcaacatgcagatacgaccatatgtgggatgtttggtacaatatttgcccctcctttggaagcagagtgaagaacacaatatgttgagatgtgctattttgacaacacttattcatcttgttcagggattaggagcagacagcaagaacctgtaccctttcctgctcccagttattcaactgagtacagatgtttcacagcctccacatgtttatcttctggaagatggtttagaattatggttagtaactttggaaaacagtccatgtattacaccagagttgcttcgtatatttcagaatatgtcaccacttcttgaactaagttcagaaaatcttagaacttgctttaagatcatcaatggttatatctttttatcatcaacagaatttttacagacatacgcagtaggtctatgccagtccttttgtgaacttttaaaggaaattactacagaaggtcaagttcaggtgctcaaggttgtggaaaatgcccttaaagtgaacccaatactaggtccacaaatgtttcaaccgattttaccctatgttttcaagggtattatagaaggggagaggtatcctgtagtgatgtccacgtatcttggagttatgggtcgagttctactacaaaacactagttttttttcttcactacttaatgagatggcccataaatttaatcaggagatggaccagcttttgggaaatatgattgaaatgtgggttgatcgaatggacaacattacccagcctgaaagaagaaaactttcagctttggctttgctctctcttctgccatctgataatagtgttatccaagataaattctgtgggattataaacatttcagtagaaggcctgcatgatgtcatgacggaagatcctgaaacaggaacttataaagactgtatgttgatgtctcatcttgaggaaccaaaagtaacagaagatgaagaaccacccacagaacaagataagaggaaaaagatgctggccctgaaggaccctgttcatacagtgtcactgcagcagttcatctacgagaagctcaaggcacagcaggagatgctaggagaacaaggtttccagtccctcatggaaacagtggatacggagattgtcacccagctacaggagtttttgcaaggattctaagagcacatgacatgtggctgcctcccctttcagaaacaagctgagtaacccagcctgccgtttgtatgtgagagcctgctgagatgaagaaatcacttcatgaaaataagcaaagaccacacattttttactacaaaatgtaaaggataaatgtaaatcctgcataactaaaatcacaaacctattcctcaaaagaatttaattttatatttatgagggggcccttcactaaaaagtacatgtaaaagtacatttgatgacaatagctgcttagtttcctgttaagagaagaaactttatcttttaattatgtgctcttaatatttgaagatgagagttaatacctgagatgtttttctgcaaccaaaattcattaaatttggctgccttatcctttttttaagctaatgaaactacaggtttgaaaaatgacaaagctgttcagatgatgctattaaagaaatgtgtgtactaagcaaaaatatataaatagtgacaaatacacattaccaagcttatcttgcaagggagttattttcatctaacatagaaagtgtgttttatcagacaaatgcttttattttcattctaataatttgatacagaaattagtaaaggcatttttttctttttttttccagtaaatacattgggtctataaatgtgcatttgtaagggccacaaaagtgaacgtgtggtactgtagtaccacgtgggagacctctggttatggtttagtcctagttcctttgttactcctgtgagcaccgagaagaactgggcgactcccagtcccacctgtgctgtgacagtcccacgtggctatgacagactgtttagtacttacccttctcaggttcctcagtgcaggggtgcatcagggcctcaataataggggtatacctgggaggatccagcagtaatccccagggtactaggattactagtactctgatggaactagtcttccttccttattcctcgaacatgcagtacataaaaaggggaaaaggagaaaaaaaaagccttactttgttttacttgccatttattgtaaggaaactttaaagcattttttaggaaatactcaaaagcaaggttggaaaatgttttatctttctatagaaagttgggtacagtatgtaactgcgggaaacccactgcccctttgtaagctgtggaacccaaactgtatggggatatttgatgttttcagaaagaggaagaaaatatggtccaaattaaattttccaaagatactcaccttggactgatttgtctgactacttttcttgctccccccaaaaaatgagttcttaaaaattgcccagtgacttatagagaattttcttttatactctagctttgattctgtgctagtaggtatcagtattgcaggtggcaaatcctagttacccttttaatttatcttcatttaaagacaaaaagctcctttcaagtgatatttctttatcagtattactcagtcctgaagactgatccaagaagaatttctttttgtt

SEQ ID NO: 28143 - DNA, 4569 bp, Homo sapiens
cgcgtcgtttggagctgcgacgccaaacatggcgtgttcctagaagccgctttcggcatcagtaggcggcggcgtggggtctggcagcgtggggagagggaccaaccgacgccacttcgtgttgggaagtgggagcgggagggccgggcaattcccgaccgaaccaaacggtttccatggatctcaatagtgccagcactgttgttcttcaggtgttaacacaggccaccagtcaggatactgctgtgttaaaaccagctgaggagcagttgaagcagtgggagacacagccaggtttctattcagtgttgctgaatattttcaccaaccacactttggatataaatgtaaggtggcttgctgtactgtattttaaacatggaattgatcgctactggagacgtgtagcacctcatgctctctcagaggaggagaaaactactctgcgtgcagggctcatcaccaacttcaatgaaccaataaaccagattgcaactcagattgcagtgctcattgcaaaagttgctagattggattgtcccagacagtggcctgaactaattcccactcttatagagtctgttaaagtccaggatgatcttcgacagcacagagcattacttaccttctatcatgttaccaagacactggcatctaaacgacttgctgctgatagaaaactattttatgatttagcttctggaatttataattttgcctgctctctgtggaatcaccacacagacacattcctgcaagaagtttcttctggcaatgaagctgcaattttgagttcactagaacgaacactgctatcattgaaagtgctgcgtaagttaactgttaatggatttgtggaacctcataagaatatggaggtgatgggttttttacatggaatatttgaacgtctaaaacagtttctggaatgcagtagaagtataggtacagataatgtgtgtagagatagactggaaaagaccatcattctttttactaaagtgcttttggacttcttggatcagcatcctttttcatttactcctctaattcagagatcactggaattttctgtaagctatgtttttacagaagttggtgaaggcgttacatttgaacgattcattgtccaatgtatgaatcttattaagatgattgtcaaaaattatgcttataagccatccaaaaattttgaagatagcagccctgaaactcttgaagcccataagattaagatggcattcttcacatatcctactttgacagagatatgtagaagattagtctctcattatttcctattaactgaagaagaactgacaatgtgggaagaagacccagaaggctttacagtggaagaaacaggaggagattcttggaaatatagtttgaggccatgcactgaagtattatttatagatatattccatgaatataatcagactcttactcctgtacttctagaaatgatgcaaacacttcaaggacccacaaatgtggaagatatgaatgcactgttaatcaaagatgctgtgtataatgctgttggattagctgcttatgagctctttgacagtgttgattttgatcagtggtttaaaaaccagcttcttccagaattacaagtcattcacaataggtataagccattgcgacgcagggtgatttggctcatcggtcagtggatttctgtgaaattcaagtctgacttaagacccatgctttatgaagcaatctgtaacttgcttcaagatcaagatttagtggtccgtattgaaacagctacaactttgaagttaactgttgatgattttgaatttagaacagatcagtttctaccgtatttggaaaccatgttcacactactttttcagttactgcagcaagttacagaatgtgacacaaagatgcatgttttgcatgtcctttcttgtgtgatcgaaagagtcaacatgcagatacgaccatatgtgggatgtttggtacaatatttgcccctcctttggaagcagagtgaagaacacaatatgttgagatgtgctattttgacaacacttattcatcttgttcagggattaggagcagacagcaagaacctgtaccctttcctgctcccagttattcaactgagtacagatgtttcacagcctccacatgtttatcttctggaagatggtttagaattatggttagtaactttggaaaacagtccatgtattacaccagagttgcttcgtatatttcagaatatgtcaccacttcttgaactaagttcagaaaatcttagaacttgctttaagatcatcaatggttatatctttttatcatcaacagaatttttacagacatacgcagtaggtctatgccagtccttttgtgaacttttaaaggaaattactacagaaggtcaagttcaggtgctcaaggttgtggaaaatgcccttaaagtgaacccaatactaggtccacaaatgtttcaaccgattttaccctatgttttcaagggtattatagaaggggagaggtatcctgtagtgatgtccacgtatcttggagttatgggtcgagttctactacaaaacactagttttttttcttcactacttaatgagatggcccataaatttaatcaggagatggaccagcttttgggaaatatgattgaaatgtgggttgatcgaatggacaacattacccagcctgaaagaagaaaactttcagctttggctttgctctctcttctgccatctgataatagtgttatccaagataaattctgtgggattataaacatttcagtagaaggcctgcatgatgtcatgacggaagatcctgaaacaggaacttataaagactgtatgttgatgtctcatcttgaggaaccaaaagtaacagaagatgaagaaccacccacagaacaagataagaggaaaaagatgctggccctgaaggaccctgttcatacagtgtcactgcagcagttcatctacgagaagctcaaggcacagcaggagatgctaggagaacaaggtttccagtccctcatggaaacagtggatacggagattgtcacccagctacaggagtttttgcaaggattctaagagcacatgacatgtggctgcctcccctttcagaaacaagctgagtaacccagcctgccgtttgtatgtgagagcctgctgagatgaagaaatcacttcatgaaaataagcaaagaccacacattttttactacaaaatgtaaaggataaatgtaaatcctgcataactaaaatcacaaacctattcctcaaaagaatttaattttatatttatgagggggcccttcactaaaaagtacatgtaaaagtacatttgatgacaatagctgcttagtttcctgttaagagaagaaactttatcttttaattatgtgctcttaatatttgaagatgagagttaatacctgagatgtttttctgcaaccaaaattcattaaatttggctgccttatcctttttttaagctaatgaaactacaggtttgaaaaatgacaaagctgttcagatgatgctattaaagaaatgtgtgtactaagcaaaaatatataaatagtgacaaatacacattaccaagcttatcttgcaagggagttattttcatctaacatagaaagtgtgttttatcagacaaatgcttttattttcattctaataatttgatacagaaattagtaaaggcatttttttctttttttttccagtaaatacattgggtctataaatgtgcatttgtaagggccacaaaagtgaacgtgtggtactgtagtaccacgtgggagacctctggttatggtttagtcctagttcctttgttactcctgtgagcaccgagaagaactgggcgactcccagtcccacctgtgctgtgacagtcccacgtggctatgacagactgtttagtacttacccttctcaggttcctcagtgcaggggtgcatcagggcctcaataataggggtatacctgggaggatccagcagtaatccccagggtactaggattactagtactctgatggaactagtcttccttccttattcctcgaacatgcagtacataaaaaggggaaaaggagattttaggaaatactcaaaagcaaggttggaaaatgttttatctttctatagaaagttgggtacagtatgtaactgcgggaaacccactgcccctttgtaagctgtggaacccaaactgtatggggatatttgatgttttcagaaagaggaagaaaatatggtccaaattaaattttccaaagatactcaccttggactgatttgtctgactacttttcttgctccccccaaaaaatgagttcttaaaaattgcccagtgacttatagagaattttcttttatactctagctttgattctgtgctagtaggtatcagtattgcaggtggcaaatcctagttacccttttaatttatcttcatttaaagacaaaaagctcctttcaagtgatatttctttatcagtattactcagtcctgaagactgatccaagaagaatttctttttgtt

SEQ ID NO: 28144 - DNA, 1990 bp, Homo sapiens
gggggtggaggtcagcagtgccacagaacaaactggagttaagaaatgtcgttcttcagatttaaaaagaaaacctttactgaatcagctgagtgttaataatacgaatttccttttcttgtgttatccaagataaattctgtgggattataaacatttcagtagaaggcctgcatgatgtcatgacggaagatcctgaaacaggaacttataaagactgtatgttgatgtctcatcttgaggaaccaaaagtaacagaagatgaagaaccacccacagaacaagataagaggaaaaagatgctggccctgaaggaccctgttcatacagtgtcactgcagcagttcatctacgagaagctcaaggcacagcaggagatgctaggagaacaaggtttccagtccctcatggaaacagtggatacggagattgtcacccagctacaggagtttttgcaaggattctaagagcacatgacatgtggctgcctcccctttcagaaacaagctgagtaacccagcctgccgtttgtatgtgagagcctgctgagatgaagaaatcacttcatgaaaataagcaaagaccacacattttttactacaaaatgtaaaggataaatgtaaatcctgcataactaaaatcacaaacctattcctcaaaagaatttaattttatatttatgagggggcccttcactaaaaagtacatgtaaaagtacatttgatgacaatagctgcttagtttcctgttaagagaagaaactttatcttttaattatgtgctcttaatatttgaagatgagagttaatacctgagatgtttttctgcaaccaaaattcattaaatttggctgccttatcctttttttaagctaatgaaactacaggtttgaaaaatgacaaagctgttcagatgatgctattaaagaaatgtgtgtactaagcaaaaatatataaatagtgacaaatacacattaccaagcttatcttgcaagggagttattttcatctaacatagaaagtgtgttttatcagacaaatgcttttattttcattctaataatttgatacagaaattagtaaaggcatttttttctttttttttccagtaaatacattgggtctataaatgtgcatttgtaagggccacaaaagtgaacgtgtggtactgtagtaccacgtgggagacctctggttatggtttagtcctagttcctttgttactcctgtgagcaccgagaagaactgggcgactcccagtcccacctgtgctgtgacagtcccacgtggctatgacagactgtttagtacttacccttctcaggttcctcagtgcaggggtgcatcagggcctcaataataggggtatacctgggaggatccagcagtaatccccagggtactaggattactagtactctgatggaactagtcttccttccttattcctcgaacatgcagtacataaaaaggggaaaaggagaaaaaaaaagccttactttgttttacttgccatttattgtaaggaaactttaaagcattttttaggaaatactcaaaagcaaggttggaaaatgttttatctttctatagaaagttgggtacagtatgtaactgcgggaaacccactgcccctttgtaagctgtggaacccaaactgtatggggatatttgatgttttcagaaagaggaagaaaatatggtccaaattaaattttccaaagatactcaccttggactgatttgtctgactacttttcttgctccccccaaaaaatgagttcttaaaaattgcccagtgacttatagagaattttcttttatactctagctttgattctgtgctagtaggtatcagtattgcaggtggcaaatcctagttacccttttaatttatcttcatttaaagacaaaaagctcctttcaagtgatatttctttatcagtattactcagtcctgaagactgatccaagaagaatttctttttgtt

SEQ ID NO: 28145 - DNA, 1948 bp, Homo sapiens
gtagagtgaaatgattagatttaccctttagaaatttccctctttctggaaggaacaataaaaccggagccagaattagtgttatccaagataaattctgtgggattataaacatttcagtagaaggcctgcatgatgtcatgacggaagatcctgaaacaggaacttataaagactgtatgttgatgtctcatcttgaggaaccaaaagtaacagaagatgaagaaccacccacagaacaagataagaggaaaaagatgctggccctgaaggaccctgttcatacagtgtcactgcagcagttcatctacgagaagctcaaggcacagcaggagatgctaggagaacaaggtttccagtccctcatggaaacagtggatacggagattgtcacccagctacaggagtttttgcaaggattctaagagcacatgacatgtggctgcctcccctttcagaaacaagctgagtaacccagcctgccgtttgtatgtgagagcctgctgagatgaagaaatcacttcatgaaaataagcaaagaccacacattttttactacaaaatgtaaaggataaatgtaaatcctgcataactaaaatcacaaacctattcctcaaaagaatttaattttatatttatgagggggcccttcactaaaaagtacatgtaaaagtacatttgatgacaatagctgcttagtttcctgttaagagaagaaactttatcttttaattatgtgctcttaatatttgaagatgagagttaatacctgagatgtttttctgcaaccaaaattcattaaatttggctgccttatcctttttttaagctaatgaaactacaggtttgaaaaatgacaaagctgttcagatgatgctattaaagaaatgtgtgtactaagcaaaaatatataaatagtgacaaatacacattaccaagcttatcttgcaagggagttattttcatctaacatagaaagtgtgttttatcagacaaatgcttttattttcattctaataatttgatacagaaattagtaaaggcatttttttctttttttttccagtaaatacattgggtctataaatgtgcatttgtaagggccacaaaagtgaacgtgtggtactgtagtaccacgtgggagacctctggttatggtttagtcctagttcctttgttactcctgtgagcaccgagaagaactgggcgactcccagtcccacctgtgctgtgacagtcccacgtggctatgacagactgtttagtacttacccttctcaggttcctcagtgcaggggtgcatcagggcctcaataataggggtatacctgggaggatccagcagtaatccccagggtactaggattactagtactctgatggaactagtcttccttccttattcctcgaacatgcagtacataaaaaggggaaaaggagaaaaaaaaagccttactttgttttacttgccatttattgtaaggaaactttaaagcattttttaggaaatactcaaaagcaaggttggaaaatgttttatctttctatagaaagttgggtacagtatgtaactgcgggaaacccactgcccctttgtaagctgtggaacccaaactgtatggggatatttgatgttttcagaaagaggaagaaaatatggtccaaattaaattttccaaagatactcaccttggactgatttgtctgactacttttcttgctccccccaaaaaatgagttcttaaaaattgcccagtgacttatagagaattttcttttatactctagctttgattctgtgctagtaggtatcagtattgcaggtggcaaatcctagttacccttttaatttatcttcatttaaagacaaaaagctcctttcaagtgatatttctttatcagtattactcagtcctgaagactgatccaagaagaatttctttttgtt

SEQ ID NO: 28146 - DNA, 1223 bp, Homo sapiens
cgcgtcgtttggagctgcgacgccaaacatggcgtgttcctagaagccgctttcggcatcagtaggcggcggcgtggggtctggcagcgtggggagagggaccaaccgacgccacttcgtgttgggaagtgggagcgggagggccgggcaattcccgaccgaaccaaacggtttccatggatctcaatagtgccagcactgttgttcttcaggtgttaacacaggccaccagtcaggatactgctgtgttaaaaccagctgaggagcagttgaagcagtgggagacacagccaggtttctattcagtgttgctgaatattttcaccaaccacactttggatataaatgtaaggtggcttgctgtactgtattttaaacatggaattgatcgctactggagacgtgtagcacctcatgctctctcagaggaggagaaaactactctgcgtgcagggctcatcaccaacttcaatgaaccaataaaccagattgcaactcagattgcagtgctcattgcaaaagttgctagattggattgtcccagacagtggcctgaactaattcccactcttatagagtctgttaaagtccaggatgatcttcgacagcacagagcattacttaccttctatcatgttaccaagacactggcatctaaacgacttgctgctgatagaaaactattttatgatttagcttctggaatttataattttgcctgctctctgtggaatcaccacacagacacattcctgcaagaagtttcttctggcaatgaagctgcaattttgagttcactagaacgaacactgctatcattgaaagtgctgcgtaagttaactgttaatggatttgtggaacctcataagaatatggaggtgatgggttttttacatggaatatttgaacgtctaaaacagtttctggaatgcacttttggacttcttggatcagcatcctttttcatttactcctctaattcagagatcactggaattttctgtaagctatgtttttacagaagttggtgaaggcgttacatttgaacgattcattgtccaatgtatgaatcttattaagatgattgtcaaaaattatgcttataagccatccaaaaattttgaaggtaattcctttattggcagtttaaaagaattattttaatcttaagtgtgatataattgctataattacaaactttttaaaaaatgtcattttagtct

SEQ ID NO: 28147 - DNA, 598 bp, Homo sapiens
gggggtggaggtcagcagtgccacagaacaaactggagttaagaaatgtcgttcttcagatttaaaaagaaaacctttactgaatcagctgagtgttaataatacgaatttccttttcttgccaattctgatctgaacagaaaatccaagaacagggatatgtgtggattacagttttctctgccttgcctacgactgtttctgccttgcatccaagggtccttaagccgttgtcttcattgattcatcttcaggcaaattctaatccttgggaatgtaactgcaaacttttgggccttcgagactggctagcatcttcagccattactctaaacatctattgtcagaatcccccatccatgcgtggcagagcattacgttatattaacattacaaattgtgttacatcttcaataaatgtatccagagcttgggctgttgtaaaatctcctcatattcatcacaagactactgcgctaatgatggcctggcataaagtaaccacaaatggcagtcctctggaaaatactgagactgagaacattactttctgggaacgaattcctagtgcttagagtcctccccagtgccagagtcc

SEQ ID NO: 28148 - DNA, 196 bp, Homo sapiens
tgctgcgtaagttaactgttaatggatttgtggaacctcataagaatatggaggtgatggtaagtgatcgaagaaatttgctgtgactttgggaaagtggtattttcctgaatgtttgaaagagtgctctttttatttggcattcaattagaagagtttttattaagtgaccatctagttttttaccattctgact

SEQ ID NO: 28149 - DNA, 936 bp, Homo sapiens
atggagagtgtgagtaatcattgtacctagtgaaacatgattactgtattgaaatgaaatgattctcagaattctagtgatattggatcaggtgatagcagataccctggaaatgacaactactttgagcttttttccataaagaatttttatcgaaaatgagaatgcttatggatatagtaagcacttaatagacgactgtgagatacacaactgtgatctgtagcatatagtaacaaaatctgtgtaaggcctgtgttcccaaggatttgctcttaatgttatgtttaaaagagttcacaaaaatattatactgatgttattaaaatctttgttttctaaaccaagatgttgaaaatgtcattattacatatttttaattgcagcagtggaagaaacaggaggagattcttggaaatatagtttgagggtaagtattaattgcaagaaaaattgataggggaaagcttaatctttctaaagctcttagtagagaatgacactctattaaagattccagacatttgctgggcatggtggctcacactttaatcctagcactttgggaagccaaggtgggaggatcgcttgaggccagaaattcaagaccggcctggtaaacatagtgagaccctgtctctgcaaaaagtaaaaaaaggaaaaaaaaattagaccagagtggtggcgcatacctgtagtcccaactcttcaggaatctgaggcaggaggattgtttgagcccaggaggttgaggctgccgtgtgccatgatgatgccactgcgttctagcctggattacaaagcaaaacccgtctcttaaaaaaaaaaaaaaaaaaattaaagattcccaacattaagtcagacagataagaaactgtttataagaaactaagaactatattcatattaaattatgacgtttaatctgagtttttt

SEQ ID NO: 28150 - DNA, 180 bp, Homo sapiens
agtaggttagaaaatgtatgaatataccatctcccaacatctagagggatgtgtttcctcataatacaattcctcagtgtggcagaaaaaaacatgtttattaacgggccaaaatatctttagtctctctgtaaaaataggaagccaaaagtatataaacttgaattatttatgttcagt

SEQ ID NO: 28151 - DNA, 519 bp, Homo sapiens
tcccaggcactttgtcctgcatccagacctcaagcagtcagataaagctgattctttatttttgcacttcttttaaagctcaggctcagagagagagtccccagctcacaagagtcagaagcaggatataaactctgatctactcactccagagctgcccgcaagaaggacacctgtctctacccatctcgggaatgtgccatgaccacagcagatggctggactacgtttaggagacaggatgctggagaaaggaagtgtcaagcagtgggcagcacccttcagacctcccctgacaccaaccaccaccaccccaatactgagggctccatggacaaaggccagctcgttcttgggcccaaacaccagttgcagctcctggatcctgggaaacgtgggagagcaccagtgactgctccctgggctccactgctgttccattcccaagggcatcctccatcatcctggtgtccaattcctaggcagacaggccctccccttgctgaggacctccaaagc

SEQ ID NO: 28152 - DNA, 3663 bp, Homo sapiens
acccggaaacgccttgcggggcagtgtgggagggagaagtccagggcggacaggctgggcgcacccgtgctcgcgcaccccaagatggctgagaggcaggaagagcagagagggagcccgcccttgagggcggaaggcaaggccgacgcggaggttaagctcattctgtaccattggacgcattccttcagctctcaaaaggtgcgcttggtaattgctgaaaaggcattgaagtgcgaggaacatgatgtaagtctgcccttgagtgagcacaatgagccttggtttatgcgtttgaactcaactggagaagtgcctgtccttatccacggggaaaacataatttgtgaggccactcagatcattgattatcttgaacagactttcctggatgaaagaacacccaggttaatgcctgataaagaaagcatgtattacccacgggtacaacattaccgagagctgcttgactccttgccaatggatgcctatacacatggctgcattttacatcctgagttaactgtggactccatgatcccggcttatgcaactacaaggattcgtagccaaattggaaacacagagtctgagctgaagaaacttgctgaagaaaacccagatttacaagaagcatacattgcaaaacagaaacgacttaaatcaaagctgcttgatcatgacaatgtcaagtatttgaagaaaattcttgatgagttggagaaagtcttggatcaggttgaaactgaattgcaaagaagaaatgaagaaaccccagaagagggccagcaaccttggctctgcggtgaatccttcaccctggcagacgtctcactcgctgtcacattgcatcgactgaagttcctggggtttgcaaggagaaactggggaaacggaaagcgaccaaacttggaaacctattacgagcgtgtcttgaagagaaaaacatttaacaaggttttaggacatgtcaacaatatattaatctctgcagtgctgccaacagcattccgggtggccaagaaaagggccccaaaagttcttggcacgacccttgtggttggtttgcttgcaggagtgggatattttgcttttatgcttttcagaaagaggcttggcagcatgatattagcatttagacccagaccaaattatttctaggtttgttgggatcttgtcgtggcagctcatccaagcatttagctagaccctgtgattgcccgtggctctctgagtctgtcttattgagtagttagcagtattttttcctaaaattcagaagtcatctttgttacacaacacaggggttcaggtagcaataggacacaaaattgctttattctacaactgccagctccaggcagaaataggaaggcaaagagataagagaaggaaaaatgagagaatgaagtctgtatagggtagagcaatagaaagtaagcttcgggtgcctccaacgttcatggctgcctgtctcattggtaaacctcacatttagttacttgtggctactgcccacacatacacttctgtaattgagaactcttaggagaggactagggaatcactggggatagtgggctggagagaaccccaggctttatatgtatactttgacctcagtgttaattttaaatgcttatgaatcacacacattgctttagtaagattaagtgcttatatactagaaatttgatgctcattggaacacatctgcctagcatttctgtaaaagtcttaagtgatattaagatgattccttaccatttcagatggtccgcaatttgaattaccaagtggtaatggttccttactgttttagatggtgcctgtgagataccattcctctggatggtcatgtccagtcagtgggaggtagaaagggtggcatctgtagccctcttcatacacataagtggcatttaggtgaatgtcccagctaatcactagcatgtctgggtattggctgggtagtgggtattttgatgatctgggagcaccaaatatgttcattcttcgtttggggaggctggtctgtaaacacaaaaattgttgtccagatctttcatctgtttatgatcatcaacaaagacttgttagaaaggtctagtcttagcacttggcagttaatctagggaagatgaattaaatgggtagatagtgatgcatacctgtattcactgatgtatgtttaagggatttgggggggatacctcagttcatgtggaagggacagtctcggtgtgtcccatgaataaccttggaactgcaacaaatggtttgtgctcagaaaaagtctttcatggtgacaggaagacagtttccctggagctggccatgaaggccttagaagccatttctggtgtctggtgggtagcaggcatagagatgatgtgccgaggtcccagtgaacaacagtagccaaagaatgtactaactttatcattaataggaaagtcatacctaggaaacaatgactttttgatggcaaaatgattttttaattctattttgatgctgtaattccatttcatgacctagttgtattagaaaaccttgatgaactatatgttcccgatttacaaaaaaattaataaaacctccagagtaaactcagtcaaacaataattgagtagcagcttttataacatttaaaatttgcacatgagtgtgttgtcatatggagtgtctgaatctgttgctgggacataccaatccatgtattcattagagccatagaagttattattcattagttcatagtgtttgagttctttatgtcactctgttagaaacaagaactgagtcgtgaagaaataagaattggatttttataaaaacctctgaaggatatttacctatgaaaaagttgttaagaataaaaattagaagtccatggttaacttttccttcaatttatattattcctgaatcatagggaatctttctagaatgtgtttataatttccttgtacagtttctttggaaatacgttaaagatagtggcaatttcatatatttcatggatacttgagtttgtgcttttaaggtgtttgtttagggatacaatgaccactagatgtcgctgtttatccagtagactaagattgagtgttctttttgttcagcaactcttctaaaatgtttcaagcaaagatagtaatgacctcagtttctgaaataagggcatcttcatcagattattcttctgttttaaaaaaaagcttgaggcaaatgtgagtgatttccagtgctttgaaagggattacagtatcacacaatgtcaagctagagttaaacacagtattagctaaataggcacttatgtgtattttctttttcatgattatcggtgactggtcagtgtactcatcaatttccaaaatttgtataaatatcacaattagaaaaatgcctgaggtactaaagttatgttggctttttgtgtcttaacacacataaatactattgttattgcagcagatgccttttgaatccattttccataattgcggatagtcataaattgcttgctcaatttttagtaattattgctgttgacaccagcgttgtagatttttggtgttgttgaatgcagtagagagaccaagacactattctgtaagatcaataaaagtaattggaaaataaatatgaacccta

SEQ ID NO: 28153 - DNA, 3898 bp, Homo sapiens
acccggaaacgccttgcggggcagtgtgggagggagaagtccagggcggacaggctgggcgcacccgtgctcgcgcaccccaagatggctgagaggcaggaagagcagagagggagcccgcccttgagggcggaaggcaaggccgacgcggaggttaagctcattctgtaccattggacgcattccttcagctctcaaaaggtgcgcttggtaattgctgaaaaggcattgaagtgcgaggaacatgatgtaagtctgcccttgagtgagcacaatgagccttggtttatgcgtttgaactcaactggagaagtgcctgtccttatccacggggaaaacataatttgtgaggccactcagatcattgattatcttgaacagactttcctggatgaaagaacacccaggttaatgcctgataaagaaagcatgtattacccacgggtacaacattaccgagagctgcttgactccttgccaatggatgcctatacacatggctgcattttacatcctgagttaactgtggactccatgatcccggcttatgcaactacaaggattcgtagccaaattggaaacacagagtctgagctgaagaaacttgctgaagaaaacccagatttacaagaagcatacattgcaaaacagaaacgacttaaatcaaagctgcttgatcatgacaatgtcaagtatttgaagaaaattcttgatgagttggagaaagtcttggatcaggttgaaactgaattgcaaagaagaaatgaagaaaccccagaagagggccagcaaccttggctctgcggtgaatccttcaccctggcagacgtctcactcgctgtcacattgcatcgactgaagttcctggggtttgcaaggagaaactggggaaacggaaagcgaccaaacttggaaacctattacgagcgtgtcttgaagagaaaaacatttaacaaggttttaggacatgtcaacaatatattaatctctgcagtgctgccaacagcattccgggtggccaagaaaagggccccaaaagttcttggcacgacccttgtggttggtttgcttgcaggagtgggatattttgcttttatgcttttcagaaagaggcttggcagcatgatattagcatttagacccagaccaaattatttctaggtttgttgggatcttgtcgtggcagctcatccaagcatttagctagaccctgtgattgcccgtggctctctgagtctgtcttattgagtagttagcagtattttttcctaaaattcagaagtcatctttgttacacaacacaggggttcaggtagcaataggacacaaaattgctttattctacaactgccagctccaggcagaaataggaaggcaaagagataagagaaggaaaaatgagagaatgaagtctgtatagggtagagcaatagaaagtaagcttcgggtgcctccaacgttcatggctgcctgtctcattggtaaacctcacatttagttacttgtggctactgcccacacatacacttctgtaattgagaactcttaggagaggactagggaatcactggggatagtgggctggagagaaccccaggctttatatgtatactttgacctcagtgttaattttaaatgcttatgaatcacacacattgctttagtaagattaagtgcttatatactagaaatttgatgctcattggaacacatctgcctagcatttctgtaaaagtcttaagtgatattaagatgattccttaccatttcagatggtccgcaatttgaattaccaagtggtaatggttccttactgttttagatggtgcctgtgagataccattcctctggatggtcatgtccagtcagtgggaggtagaaagggtggcatctgtagccctcttcatacacataagtggcatttaggtgaatgtcccagctaatcactagcatgtctgggtattggctgggtagtgggtattttgatgatctgggagcaccaaatatgttcattcttcgtttggggaggctggtctgtaaacacaaaaattgttgtccagatctttcatctgtttatgatcatcaacaaagacttgttagaaaggtctagtcttagcacttggcagttaatctagggaagatgaattaaatgggtagatagtgatgcatacctgtattcactgatgtatgtttaagggatttgggggggatacctcagttcatgtggaagggacagtctcggtgtgtcccatgaataaccttggaactgcaacaaatggtttgtgctcagaaaaagtctttcatggtgacaggaagacagtttccctggagctggccatgaaggccttagaagccatttctggtgtctggtgggtagcaggcatagagatgatgtgccgaggtcccagtgaacaacagtagccaaagaatgtactaactttatcattaataggaaagtcatacctaggaaacaatgactttttgatggcaaaatgattttttaattctattttgatgctgtaattccatttcatgacctagttgtattagaaaaccttgatgaactatatgttcccgatttacaaaaaaattaataaaacctccagagtaaactcagtcaaacaataattgagtagcagcttttataacatttaaaatttgcacatgagtgtgttgtcatatggagtgtctgaatctgttgctgggacataccaatccatgtattcattagagccatagaagttattattcattagttcatagtgtttgagttctttatgtcactctgttagaaacaagaactgagtcgtgaagaaataagaattggatttttataaaaacctctgaaggatatttacctatgaaaaagttgttaagaataaaaattagaagtccatggttaacttttccttcaatttatattattcctgaatcatagggaatctttctagaatgtgtttataatttccttgtacagtttctttggaaatacgttaaagatagtggcaatttcatatatttcatggatacttgagtttgtgcttttaaggtgtttgtttagggatacaatgaccactagatgtcgctgtttatccagtagactaagattgagtgttctttttgttcagcaactcttctaaaatgtttcaagcaaagatagtaatgacctcagtttctgaaataagggcatcttcatcagattattcttctgttttaaaaaaaagcttgaggcaaatgtgagtgatttccagtgctttgaaagggattacagtatcacacaatgtcaagctagagttaaacacagtattagctaaataggcacttatgtgtattttctttttcatgattatcggtgactggtcagtgtactcatcaatttccaaaatttgtataaatatcacaattagaaaaatgcctgaggtactaaagttatgttggctttttgtgtcttaacacacataaatactattgttattgcagcagatgccttttgaatccattttccataattgcggatagtcataaattgcttgctcaatttttagtaattattgctgttgacaccagcgttgtagatttttggtgttgttgaatgcagtagagagaccaagacactattctgtaagatcaataaaagtaattggaaaataaatatgaaccctaaaacaaagtactcactttgtaatcttttttggaaaacagatatatttttttcatttaaaatcaaagcatcatgtggtagttaaaagggtaaaataagcagaggttaggtattcaagatacttagctataggatgccatattttcgttataacaaaattgctgactcttgcttcatttaaatatgcacggttaaaatgaatagcggcctaaagaataacactgatctctcaaaaaa

SEQ ID NO: 28154 - DNA, 3518 bp, Homo sapiens
acccggaaacgccttgcggggcagtgtgggagggagaagtccagggcggacaggctgggcgcacccgtgctcgcgcaccccaagatggctgagaggcaggaagagcagagagggagcccgcccttgagggcggaaggcaaggccgacgcggaggttaagctcattctgtaccattggacgcattccttcagctctcaaaaggtgcgcttggtaattgctgaaaaggcattgaagtgcgaggaacatgataaagaacacccaggttaatgcctgataaagaaagcatgtattacccacgggtacaacattaccgagagctgcttgactccttgccaatggatgcctatacacatggctgcattttacatcctgagttaactgtggactccatgatcccggcttatgcaactacaaggattcgtagccaaattggaaacacagagtctgagctgaagaaacttgctgaagaaaacccagatttacaagaagcatacattgcaaaacagaaacgacttaaatcaaagctgcttgatcatgacaatgtcaagtatttgaagaaaattcttgatgagttggagaaagtcttggatcaggttgaaactgaattgcaaagaagaaatgaagaaaccccagaagagggccagcaaccttggctctgcggtgaatccttcaccctggcagacgtctcactcgctgtcacattgcatcgactgaagttcctggggtttgcaaggagaaactggggaaacggaaagcgaccaaacttggaaacctattacgagcgtgtcttgaagagaaaaacatttaacaaggttttaggacatgtcaacaatatattaatctctgcagtgctgccaacagcattccgggtggccaagaaaagggccccaaaagttcttggcacgacccttgtggttggtttgcttgcaggagtgggatattttgcttttatgcttttcagaaagaggcttggcagcatgatattagcatttagacccagaccaaattatttctaggtttgttgggatcttgtcgtggcagctcatccaagcatttagctagaccctgtgattgcccgtggctctctgagtctgtcttattgagtagttagcagtattttttcctaaaattcagaagtcatctttgttacacaacacaggggttcaggtagcaataggacacaaaattgctttattctacaactgccagctccaggcagaaataggaaggcaaagagataagagaaggaaaaatgagagaatgaagtctgtatagggtagagcaatagaaagtaagcttcgggtgcctccaacgttcatggctgcctgtctcattggtaaacctcacatttagttacttgtggctactgcccacacatacacttctgtaattgagaactcttaggagaggactagggaatcactggggatagtgggctggagagaaccccaggctttatatgtatactttgacctcagtgttaattttaaatgcttatgaatcacacacattgctttagtaagattaagtgcttatatactagaaatttgatgctcattggaacacatctgcctagcatttctgtaaaagtcttaagtgatattaagatgattccttaccatttcagatggtccgcaatttgaattaccaagtggtaatggttccttactgttttagatggtgcctgtgagataccattcctctggatggtcatgtccagtcagtgggaggtagaaagggtggcatctgtagccctcttcatacacataagtggcatttaggtgaatgtcccagctaatcactagcatgtctgggtattggctgggtagtgggtattttgatgatctgggagcaccaaatatgttcattcttcgtttggggaggctggtctgtaaacacaaaaattgttgtccagatctttcatctgtttatgatcatcaacaaagacttgttagaaaggtctagtcttagcacttggcagttaatctagggaagatgaattaaatgggtagatagtgatgcatacctgtattcactgatgtatgtttaagggatttgggggggatacctcagttcatgtggaagggacagtctcggtgtgtcccatgaataaccttggaactgcaacaaatggtttgtgctcagaaaaagtctttcatggtgacaggaagacagtttccctggagctggccatgaaggccttagaagccatttctggtgtctggtgggtagcaggcatagagatgatgtgccgaggtcccagtgaacaacagtagccaaagaatgtactaactttatcattaataggaaagtcatacctaggaaacaatgactttttgatggcaaaatgattttttaattctattttgatgctgtaattccatttcatgacctagttgtattagaaaaccttgatgaactatatgttcccgatttacaaaaaaattaataaaacctccagagtaaactcagtcaaacaataattgagtagcagcttttataacatttaaaatttgcacatgagtgtgttgtcatatggagtgtctgaatctgttgctgggacataccaatccatgtattcattagagccatagaagttattattcattagttcatagtgtttgagttctttatgtcactctgttagaaacaagaactgagtcgtgaagaaataagaattggatttttataaaaacctctgaaggatatttacctatgaaaaagttgttaagaataaaaattagaagtccatggttaacttttccttcaatttatattattcctgaatcatagggaatctttctagaatgtgtttataatttccttgtacagtttctttggaaatacgttaaagatagtggcaatttcatatatttcatggatacttgagtttgtgcttttaaggtgtttgtttagggatacaatgaccactagatgtcgctgtttatccagtagactaagattgagtgttctttttgttcagcaactcttctaaaatgtttcaagcaaagatagtaatgacctcagtttctgaaataagggcatcttcatcagattattcttctgttttaaaaaaaagcttgaggcaaatgtgagtgatttccagtgctttgaaagggattacagtatcacacaatgtcaagctagagttaaacacagtattagctaaataggcacttatgtgtattttctttttcatgattatcggtgactggtcagtgtactcatcaatttccaaaatttgtataaatatcacaattagaaaaatgcctgaggtactaaagttatgttggctttttgtgtcttaacacacataaatactattgttattgcagcagatgccttttgaatccattttccataattgcggatagtcataaattgcttgctcaatttttagtaattattgctgttgacaccagcgttgtagatttttggtgttgttgaatgcagtagagagaccaagacactattctgtaagatcaataaaagtaattggaaaataaatatgaacccta

SEQ ID NO: 28155 - DNA, 3533 bp, Homo sapiens
acccggaaacgccttgcggggcagtgtgggagggagaagtccagggcggacaggctgggcgcacccgtgctcgcgcaccccaagatggctgagaggcattgaagtgcgaggaacatgatgtaagtctgcccttgagtgagcacaatgagccttggtttatgcgtttgaactcaactggagaagtgcctgtccttatccacggggaaaacataatttgtgaggccactcagatcattgattatcttgaacagactttcctggatgaaagaacacccaggttaatgcctgataaagaaagcatgtattacccacgggtacaacattaccgagagctgcttgactccttgccaatggatgcctatacacatggctgcattttacatcctgagttaactgtggactccatgatcccggcttatgcaactacaaggattcgtagccaaattggaaacacagagtctgagctgaagaaacttgctgaagaaaacccagatttacaagaagcatacattgcaaaacagaaacgacttaaatcaaagctgcttgatcatgacaatgtcaagtatttgaagaaaattcttgatgagttggagaaagtcttggatcaggttgaaactgaattgcaaagaagaaatgaagaaaccccagaagagggccagcaaccttggctctgcggtgaatccttcaccctggcagacgtctcactcgctgtcacattgcatcgactgaagttcctggggtttgcaaggagaaactggggaaacggaaagcgaccaaacttggaaacctattacgagcgtgtcttgaagagaaaaacatttaacaaggttttaggacatgtcaacaatatattaatctctgcagtgctgccaacagcattccgggtggccaagaaaagggccccaaaagttcttggcacgacccttgtggttggtttgcttgcaggagtgggatattttgcttttatgcttttcagaaagaggcttggcagcatgatattagcatttagacccagaccaaattatttctaggtttgttgggatcttgtcgtggcagctcatccaagcatttagctagaccctgtgattgcccgtggctctctgagtctgtcttattgagtagttagcagtattttttcctaaaattcagaagtcatctttgttacacaacacaggggttcaggtagcaataggacacaaaattgctttattctacaactgccagctccaggcagaaataggaaggcaaagagataagagaaggaaaaatgagagaatgaagtctgtatagggtagagcaatagaaagtaagcttcgggtgcctccaacgttcatggctgcctgtctcattggtaaacctcacatttagttacttgtggctactgcccacacatacacttctgtaattgagaactcttaggagaggactagggaatcactggggatagtgggctggagagaaccccaggctttatatgtatactttgacctcagtgttaattttaaatgcttatgaatcacacacattgctttagtaagattaagtgcttatatactagaaatttgatgctcattggaacacatctgcctagcatttctgtaaaagtcttaagtgatattaagatgattccttaccatttcagatggtccgcaatttgaattaccaagtggtaatggttccttactgttttagatggtgcctgtgagataccattcctctggatggtcatgtccagtcagtgggaggtagaaagggtggcatctgtagccctcttcatacacataagtggcatttaggtgaatgtcccagctaatcactagcatgtctgggtattggctgggtagtgggtattttgatgatctgggagcaccaaatatgttcattcttcgtttggggaggctggtctgtaaacacaaaaattgttgtccagatctttcatctgtttatgatcatcaacaaagacttgttagaaaggtctagtcttagcacttggcagttaatctagggaagatgaattaaatgggtagatagtgatgcatacctgtattcactgatgtatgtttaagggatttgggggggatacctcagttcatgtggaagggacagtctcggtgtgtcccatgaataaccttggaactgcaacaaatggtttgtgctcagaaaaagtctttcatggtgacaggaagacagtttccctggagctggccatgaaggccttagaagccatttctggtgtctggtgggtagcaggcatagagatgatgtgccgaggtcccagtgaacaacagtagccaaagaatgtactaactttatcattaataggaaagtcatacctaggaaacaatgactttttgatggcaaaatgattttttaattctattttgatgctgtaattccatttcatgacctagttgtattagaaaaccttgatgaactatatgttcccgatttacaaaaaaattaataaaacctccagagtaaactcagtcaaacaataattgagtagcagcttttataacatttaaaatttgcacatgagtgtgttgtcatatggagtgtctgaatctgttgctgggacataccaatccatgtattcattagagccatagaagttattattcattagttcatagtgtttgagttctttatgtcactctgttagaaacaagaactgagtcgtgaagaaataagaattggatttttataaaaacctctgaaggatatttacctatgaaaaagttgttaagaataaaaattagaagtccatggttaacttttccttcaatttatattattcctgaatcatagggaatctttctagaatgtgtttataatttccttgtacagtttctttggaaatacgttaaagatagtggcaatttcatatatttcatggatacttgagtttgtgcttttaaggtgtttgtttagggatacaatgaccactagatgtcgctgtttatccagtagactaagattgagtgttctttttgttcagcaactcttctaaaatgtttcaagcaaagatagtaatgacctcagtttctgaaataagggcatcttcatcagattattcttctgttttaaaaaaaagcttgaggcaaatgtgagtgatttccagtgctttgaaagggattacagtatcacacaatgtcaagctagagttaaacacagtattagctaaataggcacttatgtgtattttctttttcatgattatcggtgactggtcagtgtactcatcaatttccaaaatttgtataaatatcacaattagaaaaatgcctgaggtactaaagttatgttggctttttgtgtcttaacacacataaatactattgttattgcagcagatgccttttgaatccattttccataattgcggatagtcataaattgcttgctcaatttttagtaattattgctgttgacaccagcgttgtagatttttggtgttgttgaatgcagtagagagaccaagacactattctgtaagatcaataaaagtaattggaaaataaatatgaacccta

SEQ ID NO: 28156 - DNA, 3387 bp, Homo sapiens
aggtgtagcctccgaccacctcgaagccgtgcgaccaggagcccgagtactcgccctggcccttgggccccgtgcagatgccatgcccgtgcgccttgccctcctcccagccgccgcaaaagaacacccaggttaatgcctgataaagaaagcatgtattacccacgggtacaacattaccgagagctgcttgactccttgccaatggatgcctatacacatggctgcattttacatcctgagttaactgtggactccatgatcccggcttatgcaactacaaggattcgtagccaaattggaaacacagagtctgagctgaagaaacttgctgaagaaaacccagatttacaagaagcatacattgcaaaacagaaacgacttaaatcaaagctgcttgatcatgacaatgtcaagtatttgaagaaaattcttgatgagttggagaaagtcttggatcaggttgaaactgaattgcaaagaagaaatgaagaaaccccagaagagggccagcaaccttggctctgcggtgaatccttcaccctggcagacgtctcactcgctgtcacattgcatcgactgaagttcctggggtttgcaaggagaaactggggaaacggaaagcgaccaaacttggaaacctattacgagcgtgtcttgaagagaaaaacatttaacaaggttttaggacatgtcaacaatatattaatctctgcagtgctgccaacagcattccgggtggccaagaaaagggccccaaaagttcttggcacgacccttgtggttggtttgcttgcaggagtgggatattttgcttttatgcttttcagaaagaggcttggcagcatgatattagcatttagacccagaccaaattatttctaggtttgttgggatcttgtcgtggcagctcatccaagcatttagctagaccctgtgattgcccgtggctctctgagtctgtcttattgagtagttagcagtattttttcctaaaattcagaagtcatctttgttacacaacacaggggttcaggtagcaataggacacaaaattgctttattctacaactgccagctccaggcagaaataggaaggcaaagagataagagaaggaaaaatgagagaatgaagtctgtatagggtagagcaatagaaagtaagcttcgggtgcctccaacgttcatggctgcctgtctcattggtaaacctcacatttagttacttgtggctactgcccacacatacacttctgtaattgagaactcttaggagaggactagggaatcactggggatagtgggctggagagaaccccaggctttatatgtatactttgacctcagtgttaattttaaatgcttatgaatcacacacattgctttagtaagattaagtgcttatatactagaaatttgatgctcattggaacacatctgcctagcatttctgtaaaagtcttaagtgatattaagatgattccttaccatttcagatggtccgcaatttgaattaccaagtggtaatggttccttactgttttagatggtgcctgtgagataccattcctctggatggtcatgtccagtcagtgggaggtagaaagggtggcatctgtagccctcttcatacacataagtggcatttaggtgaatgtcccagctaatcactagcatgtctgggtattggctgggtagtgggtattttgatgatctgggagcaccaaatatgttcattcttcgtttggggaggctggtctgtaaacacaaaaattgttgtccagatctttcatctgtttatgatcatcaacaaagacttgttagaaaggtctagtcttagcacttggcagttaatctagggaagatgaattaaatgggtagatagtgatgcatacctgtattcactgatgtatgtttaagggatttgggggggatacctcagttcatgtggaagggacagtctcggtgtgtcccatgaataaccttggaactgcaacaaatggtttgtgctcagaaaaagtctttcatggtgacaggaagacagtttccctggagctggccatgaaggccttagaagccatttctggtgtctggtgggtagcaggcatagagatgatgtgccgaggtcccagtgaacaacagtagccaaagaatgtactaactttatcattaataggaaagtcatacctaggaaacaatgactttttgatggcaaaatgattttttaattctattttgatgctgtaattccatttcatgacctagttgtattagaaaaccttgatgaactatatgttcccgatttacaaaaaaattaataaaacctccagagtaaactcagtcaaacaataattgagtagcagcttttataacatttaaaatttgcacatgagtgtgttgtcatatggagtgtctgaatctgttgctgggacataccaatccatgtattcattagagccatagaagttattattcattagttcatagtgtttgagttctttatgtcactctgttagaaacaagaactgagtcgtgaagaaataagaattggatttttataaaaacctctgaaggatatttacctatgaaaaagttgttaagaataaaaattagaagtccatggttaacttttccttcaatttatattattcctgaatcatagggaatctttctagaatgtgtttataatttccttgtacagtttctttggaaatacgttaaagatagtggcaatttcatatatttcatggatacttgagtttgtgcttttaaggtgtttgtttagggatacaatgaccactagatgtcgctgtttatccagtagactaagattgagtgttctttttgttcagcaactcttctaaaatgtttcaagcaaagatagtaatgacctcagtttctgaaataagggcatcttcatcagattattcttctgttttaaaaaaaagcttgaggcaaatgtgagtgatttccagtgctttgaaagggattacagtatcacacaatgtcaagctagagttaaacacagtattagctaaataggcacttatgtgtattttctttttcatgattatcggtgactggtcagtgtactcatcaatttccaaaatttgtataaatatcacaattagaaaaatgcctgaggtactaaagttatgttggctttttgtgtcttaacacacataaatactattgttattgcagcagatgccttttgaatccattttccataattgcggatagtcataaattgcttgctcaatttttagtaattattgctgttgacaccagcgttgtagatttttggtgttgttgaatgcagtagagagaccaagacactattctgtaagatcaataaaagtaattggaaaataaatatgaacccta

SEQ ID NO: 28157 - DNA, 3625 bp, Homo sapiens
aacccccaaaggaattgggcttggaagaagggcaagggaaagaagccagaagaaggggaagccccgcccctttgaagggaaaaggggcaaagggcgaccccggagggttaaagttaattctgttaccaatttggaacgcatttcctttcagctctcaaaaagggtgcgcttggtaattgctgaaaaggcattgaagtgcgaggaacatgatgtaagtctgcccttgagtgagcacaatgagccttggtttatgcgtttgaactcaactggagaagtgcctgtccttatccacggggaaaacataatttgtgaggccactcagatcattgattatcttgaacagactttcctggatgaaagaacacccaggttaatgcctgataaagaaagcatgtattacccacgggtacaacattaccgagagctgcttgactccttgccaatggatgcctatacacatggctgcattttacatcctgagttaactgtggactccatgatcccggcttatgcaactacaaggattcgtagccaaattggaaacacagagtctgagctgaagaaacttgctgaagaaaacccagatttacaagaagcatacattgcaaaacagaaacgacttaaatcaaagctgcttgatcatgacaatgtcaagtatttgaagaaaattcttgatgagttggagaaagtcttggatcaggttgaaactgaattgcaaagaagaaatgaagaaaccccagaagagggccagcaaccttggctctgcggtgaatccttcaccctggcagacgtctcactcgctgtcacattgcatcgactgaagttcctggggtttgcaaggagaaactggggaaacggaaagcgaccaaacttggaaacctattacgagcgtgtcttgaagagaaaaacatttaacaaggttttaggacatgtcaacaatatattaatctctgcagtgctgccaacagcattccgggtggccaagaaaagggccccaaaagttcttggcacgacccttgtggttggtttgcttgcaggagtgggatattttgcttttatgcttttcagaaagaggcttggcagcatgatattagcatttagacccagaccaaattatttctaggtttgttgggatcttgtcgtggcagctcatccaagcatttagctagaccctgtgattgcccgtggctctctgagtctgtcttattgagtagttagcagtattttttcctaaaattcagaagtcatctttgttacacaacacaggggttcaggtagcaataggacacaaaattgctttattctacaactgccagctccaggcagaaataggaaggcaaagagataagagaaggaaaaatgagagaatgaagtctgtatagggtagagcaatagaaagtaagcttcgggtgcctccaacgttcatggctgcctgtctcattggtaaacctcacatttagttacttgtggctactgcccacacatacacttctgtaattgagaactcttaggagaggactagggaatcactggggatagtgggctggagagaaccccaggctttatatgtatactttgacctcagtgttaattttaaatgcttatgaatcacacacattgctttagtaagattaagtgcttatatactagaaatttgatgctcattggaacacatctgcctagcatttctgtaaaagtcttaagtgatattaagatgattccttaccatttcagatggtccgcaatttgaattaccaagtggtaatggttccttactgttttagatggtgcctgtgagataccattcctctggatggtcatgtccagtcagtgggaggtagaaagggtggcatctgtagccctcttcatacacataagtggcatttaggtgaatgtcccagctaatcactagcatgtctgggtattggctgggtagtgggtattttgatgatctgggagcaccaaatatgttcattcttcgtttggggaggctggtctgtaaacacaaaaattgttgtccagatctttcatctgtttatgatcatcaacaaagacttgttagaaaggtctagtcttagcacttggcagttaatctagggaagatgaattaaatgggtagatagtgatgcatacctgtattcactgatgtatgtttaagggatttgggggggatacctcagttcatgtggaagggacagtctcggtgtgtcccatgaataaccttggaactgcaacaaatggtttgtgctcagaaaaagtctttcatggtgacaggaagacagtttccctggagctggccatgaaggccttagaagccatttctggtgtctggtgggtagcaggcatagagatgatgtgccgaggtcccagtgaacaacagtagccaaagaatgtactaactttatcattaataggaaagtcatacctaggaaacaatgactttttgatggcaaaatgattttttaattctattttgatgctgtaattccatttcatgacctagttgtattagaaaaccttgatgaactatatgttcccgatttacaaaaaaattaataaaacctccagagtaaactcagtcaaacaataattgagtagcagcttttataacatttaaaatttgcacatgagtgtgttgtcatatggagtgtctgaatctgttgctgggacataccaatccatgtattcattagagccatagaagttattattcattagttcatagtgtttgagttctttatgtcactctgttagaaacaagaactgagtcgtgaagaaataagaattggatttttataaaaacctctgaaggatatttacctatgaaaaagttgttaagaataaaaattagaagtccatggttaacttttccttcaatttatattattcctgaatcatagggaatctttctagaatgtgtttataatttccttgtacagtttctttggaaatacgttaaagatagtggcaatttcatatatttcatggatacttgagtttgtgcttttaaggtgtttgtttagggatacaatgaccactagatgtcgctgtttatccagtagactaagattgagtgttctttttgttcagcaactcttctaaaatgtttcaagcaaagatagtaatgacctcagtttctgaaataagggcatcttcatcagattattcttctgttttaaaaaaaagcttgaggcaaatgtgagtgatttccagtgctttgaaagggattacagtatcacacaatgtcaagctagagttaaacacagtattagctaaataggcacttatgtgtattttctttttcatgattatcggtgactggtcagtgtactcatcaatttccaaaatttgtataaatatcacaattagaaaaatgcctgaggtactaaagttatgttggctttttgtgtcttaacacacataaatactattgttattgcagcagatgccttttgaatccattttccataattgcggatagtcataaattgcttgctcaatttttagtaattattgctgttgacaccagcgttgtagatttttggtgttgttgaatgcagtagagagaccaagacactattctgtaagatcaataaaagtaattggaaaataaatatgaacccta

SEQ ID NO: 28158 - DNA, 3371 bp, Homo sapiens
ggctggtacggtctgggagttaaggatcgcctgggccagcgccgcgcgcgagaggacagcccaggttcccgagcggaccttcagctgctcccgcccgcccacaaagaacacccaggttaatgcctgataaagaaagcatgtattacccacgggtacaacattaccgagagctgcttgactccttgccaatggatgcctatacacatggctgcattttacatcctgagttaactgtggactccatgatcccggcttatgcaactacaaggattcgtagccaaattggaaacacagagtctgagctgaagaaacttgctgaagaaaacccagatttacaagaagcatacattgcaaaacagaaacgacttaaatcaaagctgcttgatcatgacaatgtcaagtatttgaagaaaattcttgatgagttggagaaagtcttggatcaggttgaaactgaattgcaaagaagaaatgaagaaaccccagaagagggccagcaaccttggctctgcggtgaatccttcaccctggcagacgtctcactcgctgtcacattgcatcgactgaagttcctggggtttgcaaggagaaactggggaaacggaaagcgaccaaacttggaaacctattacgagcgtgtcttgaagagaaaaacatttaacaaggttttaggacatgtcaacaatatattaatctctgcagtgctgccaacagcattccgggtggccaagaaaagggccccaaaagttcttggcacgacccttgtggttggtttgcttgcaggagtgggatattttgcttttatgcttttcagaaagaggcttggcagcatgatattagcatttagacccagaccaaattatttctaggtttgttgggatcttgtcgtggcagctcatccaagcatttagctagaccctgtgattgcccgtggctctctgagtctgtcttattgagtagttagcagtattttttcctaaaattcagaagtcatctttgttacacaacacaggggttcaggtagcaataggacacaaaattgctttattctacaactgccagctccaggcagaaataggaaggcaaagagataagagaaggaaaaatgagagaatgaagtctgtatagggtagagcaatagaaagtaagcttcgggtgcctccaacgttcatggctgcctgtctcattggtaaacctcacatttagttacttgtggctactgcccacacatacacttctgtaattgagaactcttaggagaggactagggaatcactggggatagtgggctggagagaaccccaggctttatatgtatactttgacctcagtgttaattttaaatgcttatgaatcacacacattgctttagtaagattaagtgcttatatactagaaatttgatgctcattggaacacatctgcctagcatttctgtaaaagtcttaagtgatattaagatgattccttaccatttcagatggtccgcaatttgaattaccaagtggtaatggttccttactgttttagatggtgcctgtgagataccattcctctggatggtcatgtccagtcagtgggaggtagaaagggtggcatctgtagccctcttcatacacataagtggcatttaggtgaatgtcccagctaatcactagcatgtctgggtattggctgggtagtgggtattttgatgatctgggagcaccaaatatgttcattcttcgtttggggaggctggtctgtaaacacaaaaattgttgtccagatctttcatctgtttatgatcatcaacaaagacttgttagaaaggtctagtcttagcacttggcagttaatctagggaagatgaattaaatgggtagatagtgatgcatacctgtattcactgatgtatgtttaagggatttgggggggatacctcagttcatgtggaagggacagtctcggtgtgtcccatgaataaccttggaactgcaacaaatggtttgtgctcagaaaaagtctttcatggtgacaggaagacagtttccctggagctggccatgaaggccttagaagccatttctggtgtctggtgggtagcaggcatagagatgatgtgccgaggtcccagtgaacaacagtagccaaagaatgtactaactttatcattaataggaaagtcatacctaggaaacaatgactttttgatggcaaaatgattttttaattctattttgatgctgtaattccatttcatgacctagttgtattagaaaaccttgatgaactatatgttcccgatttacaaaaaaattaataaaacctccagagtaaactcagtcaaacaataattgagtagcagcttttataacatttaaaatttgcacatgagtgtgttgtcatatggagtgtctgaatctgttgctgggacataccaatccatgtattcattagagccatagaagttattattcattagttcatagtgtttgagttctttatgtcactctgttagaaacaagaactgagtcgtgaagaaataagaattggatttttataaaaacctctgaaggatatttacctatgaaaaagttgttaagaataaaaattagaagtccatggttaacttttccttcaatttatattattcctgaatcatagggaatctttctagaatgtgtttataatttccttgtacagtttctttggaaatacgttaaagatagtggcaatttcatatatttcatggatacttgagtttgtgcttttaaggtgtttgtttagggatacaatgaccactagatgtcgctgtttatccagtagactaagattgagtgttctttttgttcagcaactcttctaaaatgtttcaagcaaagatagtaatgacctcagtttctgaaataagggcatcttcatcagattattcttctgttttaaaaaaaagcttgaggcaaatgtgagtgatttccagtgctttgaaagggattacagtatcacacaatgtcaagctagagttaaacacagtattagctaaataggcacttatgtgtattttctttttcatgattatcggtgactggtcagtgtactcatcaatttccaaaatttgtataaatatcacaattagaaaaatgcctgaggtactaaagttatgttggctttttgtgtcttaacacacataaatactattgttattgcagcagatgccttttgaatccattttccataattgcggatagtcataaattgcttgctcaatttttagtaattattgctgttgacaccagcgttgtagatttttggtgttgttgaatgcagtagagagaccaagacactattctgtaagatcaataaaagtaattggaaaataaatatgaacccta

SEQ ID NO: 28159 - DNA, 2526 bp, Homo sapiens
acccggaaacgccttgcggggcagtgtgggagggagaagtccagggcggacaggctgggcgcacccgtgctcgcgcaccccaagatggctgagaggcaggaagagcagagagggagcccgcccttgagggcggaaggcaaggccgacgcggaggttaagctcattctgtaccattggacgcattccttcagctctcaaaaggtgcgcttggtaattgctgaaaaggcattgaagtgcgaggaacatgatgtaagtctgcccttgagtgagcacaatgagccttggtttatgcgtttgaactcaactggagaagtgcctgtccttatccacggggaaaacataatttgtgaggccactcagatcattgattatcttgaacagactttcctggatgaaagaacacccaggttaatgcctgataaagaaagcatgtattacccacgggtacaacattaccgagagctgcttgactccttgccaatggatgcctatacacatggctgcattttacatcctgagttaactgtggactccatgatcccggcttatgcaactacaaggattcgtagccaaattggaaacacagagtctgagctgaagaaacttgctgaagaaaacccagatttacaagaagcatacattgcaaaacagaaacgacttaaatcaaagctgcttgatcatgacaatgtcaagtatttgaagaaaattcttgatgagttggagaaagtcttggatcaggttgaaactgaattgcaaagaagaaatgaagaaaccccagaagagggccagcaaccttggctctgcggtgaatccttcaccctggcagacgtctcactcgctgtcacattgcatcgactgaagttcctggggtttgcaaggagaaactggggaaacggaaagcgaccaaacttggaaacctattacgagcgtgtcttgaagagaaaaacatttaacaaggttttaggacatgtcaacaatatattaatctctgcagtgctgccaacagcattccgggtggccaagaaaagggccccaaaagttcttggcacgacccttgtggttggtttgcttgcaggagtgggatattttgcttttatgcttttcagaaagaggcttggcagcatgatattagcatttagacccagaccaaattatttctaggtttgttgggatcttgtcgtggcagctcatccaagcatttagctagaccctgtgattgcccgtggctctctgagtctgtcttattgagtagttagcagtattttttcctaaaattcagaagtcatctttgttacacaacacaggggttcaggtagcaataggacacaaaattgctttattctacaactgccagctccaggcagaaataggaaggcaaagagataagagaaggaaaaatgagagaatgaagtctgtatagggtagagcaatagaaagtaagcttcgggtgcctccaacgttcatggctgcctgtctcattggtaaacctcacatttagttacttgtggctactgcccacacatacacttctgtaattgagaactcttaggagaggactagggaatcactggggatagtgggctggagagaaccccaggctttatatgtatactttgacctcagtgttaattttaaatgcttatgaatcacacacattgctttagtaagattaagtgcttatatactagaaatttgatgctcattggaacacatctgcctagcatttctgtaaaagtcttaagtgatattaagatgattccttaccatttcagatggtccgcaatttgaattaccaagtggtaatggttccttactgttttagatggtgcctgtgagataccattcctctggatggtcatgtccagtcagtgggaggtagaaagggtggcatctgtagccctcttcatacacataagtggcatttaggtgaatgtcccagctaatcactagcatgtctgggtattggctgggtagtgggtattttgatgatctgggagcaccaaatatgttcattcttcgtttggggaggctggtctgtaaacacaaaaattgttgtccagatctttcatctgtttatgatcatcaacaaagacttgttagaaaggtctagtcttagcacttggcagttaatctagggaagatgaattaaatgggtagatagtgatgcatacctgtattcactgatgtatgtttaagggatttgggggggatacctcagttcatgtggaagggacagtctcggtgtgtcccatgaataaccttggaactgcaacaaatggtttgtgctcagaaaaagtctttcatggtgacaggaagacagtttccctggagctggccatgaaggccttagaagccatttctggtgtctggcgctacagcttataatagttacttggaccagtctttttttgtgaagagttttaatcctattgtgggtgatcccttctgactatctcttgaaccttggtacaattgccgtatacacaatttaacatttcctgtacttgtcactatggtcgtttttca

SEQ ID NO: 28160 - DNA, 4783 bp, Homo sapiens
cgggagcccaggcgggcaggccgctggggtcggggctgcacgtacgagagccgggacgcccgggttcagagcgaaggaggaggcatggcttcggtgttcatgtgtggcgtggaggacctgctgttcagcggcagccgcttcgtatggaacttgaccgtgtccacgctgcggagatggtacacggagaggctgcgggcttgccaccaggtgctgcggacgtggtgcgggctgcaggacgtgtaccagatgacagaaggcaggcactgccaggtgcacctcctggatgataggagactggagctgctggttcagcccaaacttctagcaagagagttgctggacctagtggcttcacatttcaacctgaaagaaaaggagtattttggaataacattcatagatgacacaggtcagcagaactggctgcagttagatcaccgagttcttgaccacgatttgcccaagaaaccaggcccaaccattttgcactttgctgtgaggttttacattgagagcatatcgtttttaaaggataaaaccaccgtggagctgtttttcctgaatgcaaaggcctgtgtgcacaaggggcaaatcgaagtagagagcgaaaccatcttcaagttagcagcgtttattttacaggaagccaagggagattataccagtgatgaaaatgccaggaaagatttaaagacattaccagcctttccaaccaaaactcttcaggagcatccatcccttgcctactgtgaggacagggtaattgagcattatttgaaaatcaaaggtctcactcgaggtcaagctgtggttcagtatatgaaaatagtagaagctctaccgacttacggtgtccattattatgcagtaaaggataagcaaggacttccttggtggcttggaataagctataagggaattggccaatatgatatacaagacaaggtgaagcctcggaagttattccaatggaaacagctggagaacttatatttccgtgagaaaaaatttgctgttgaagttcatgatccacgaaggatttcagtttcaagaagaacctttgggcaaagtggcctgtttgtgcaaacatggtatgctaactcttctctcatcaagtccatttgggtaatggcaattagtcagcatcagttttacttggaccggaagcaaagcaaagcaaaaattccttcagccaggagtttagatgagattgcaatggatttgacagagacaggaacacaaagggcctccaagctggtgacactggaggcgaaaagtcagttcatcatggcaagtaatggcagtttaatctcctcaggttctcaagactcagaagttagtgaagagcaaaagagagaaaaaatccttgaactaaagaagaaggagaaactattacaagaaaaacttctgaaaaaagttgaggagcttaagaagatctgtctgcgggaggctgagctcacaggcaaaatgccaaaggagtatcccctgaacataggcgagaagcctcctcaggtcagaagacgtgtgggtactgcgttcaaattagatgacaacttgctgccgagtgaagaagatcctgctttgcaagaactggagagtaattttctaatacaacaaaagctggtggaagctgcaaagaaacttgccaatgagccagacctttgtaaaactgtgaagaaaaagcgaaagcaagattacacagatgcgatgaaaaagcttcaggagattgaaaatgcaataaacgaataccgaattaggtgtggaaagaaacccagccagaaagcaacagtgttaccagaagacataatcccctcagagagtagctctttgtctgacaccaccacctatgatgatcccagtgatgccttcacttttcctgggcagcgatcaagttcagtacctcattctccaagaattcttccccccaagtctcttggtattgagcgaatccatttcagaaagtcgtccatcaatgaacagtttgtggataccaggcagtccagagaaatgctgtccacacacagcagcccttacaaaactctggagaggcggccccagggaggacgaagcatgcccaccacgccagttcttacccgaaacgcctacagcagcagccacttggaacccgaatcttcatctcagcactgccgccagcggagtggaagcctggagtcccagtcccatctgctctccgagatggacagcgataagccatttttctccctctccaaatcccaaagaagcagcagcacagaaatcctcgatgacgggtcttcttatacaagccaatcaagcacagagtattactgtgtgacaccagttaccggcccctattacaccacccagaccctggacactcgcaccaggggtcggaggaggtcaaagaaacagaatgtttctacttcaaattcaggaagcatgcccaacctagcacaaaaggatagtttgaggaatggtgtttactcaaagagtcaggagccaccgtcttccagttactacattgccgggtacacaccctatgcagagtgtgacttttattacagtggtggttatgtctatgagaatgacaccgagggacagtatagtgtcaacccttcctaccggtcctcagcccactatggatatgagcgccagagggactacagcagatcctttcacgaagatgaggtcgaccgggtaccccataacccatatgcaactctccggctgccaaggaaggctgctgcaaaatcggagcacatcaccaaaaacatccacaaggccttagttgccgagcacttgcgtggctggtaccagcgggcctctgggcagaaggatcagggacacagcccgcagaccagctttgactcagacaggggatcacagagatgcctggggtttgcggggctgcaagtaccttgttctccaagcagtcgtgcatccttgtactcttcagtgtcttctacaaatgcttctgggaactggaggacccagttaaccatagggctgtcggattacgagactccagcacattcttcttacaccagctgctatggcaatgtctataatcctttaccctctccaagcagacaatacacagaaatcagtcaactggatggtacagatggaaaccagctggaagacaacctggagagtagtgagcagagactcttttggcatgaagattcaaagcctggaacattagtctgaactgcagttggacctcctgaccaagcactgcgttctcacactagtgtgccttgcaaattgtatttgtcttccgagaggatgttcgttttagaaacctaaagacatcaaaggttgaagagaagacttagttgccctggaagtgaatcagtgaatcacacaccaagccccacaaagcccctaaaggaggatttggcctttcaaactctaggcactaacgtaactgtagggtctgcccacatgttgaagtattgccaagagaggactcagtgtgaagccttcatcaatagcaagcactttttaagggagtaaaagttgttaaaggcaaacgtcaaaaacatgaaagggcattcaggatgtcccatggcaataagaacaggggaaatctcagagcacaattcagcaggatgagagaaggggaaccagaagctccggagtcattgctcacttcagagtttgaattcgtgagctgacaaagagtaacatgctctttctacacagacatggacaatttagacagtattggaaaattacttgaagctggattttcatgaagttctgaatgagtgtaaatgttttttaggatactataaagagtgatgtttttcataagcaccataaaatgggttctggaaaaactgattaccttagcatcctgtaatataacttatggtagcagattggggaaaatgaagcagcccactgaataattgacaaagtctgcttggagaacattctaaggtacaatatcatggagctcctttttcctttctccactaattgcgtgatgagctattgttctggctggtaattctccaactcggctgtcatttgaagtggcagacttaatatggaaagtttttataattatgagtttgaaaaagcattttaagatgatacagaaagtatccaaaacaacagaaaaaaaaagccacgtcattttagatgaattgcgtgccttaaaatggtgaacgttagaaaattaaacaagtctggattccacaagtagttccaagtcaccaagtgacaaaaacaaggttaacattaaaaaagaaaaacaacaacaacgacaaaaagctccaagctgcagtggatttaattatgaggctaaaactacctcatactttccttggaagaactaattagctatggtttattgtagggttttgtttgtttgttttttaaagcaaatgatttccatattcctgattgatcttttttgtcatctttgcttcaaaattacataaaaggtgctcctttcccccttcttttatacaagtttcttgttcatattgtgaatagaaaagtttctgaacaacttttttggaacattttctatctatattccaaagcatgtaatatatacataaaaacgatttgttaaactggtccttagtcatttgtataattagaaatgaagtttgggaaaaaattttggaaaaaagacaagcaaaaaaaaaataacttattccttttttgcatatttgtatagccttctagaatcagaaataacctttttgcatattcttttattgttctgacttttcaagacctattatttttttacataggtcaataaacaaaaggtgtgctactg

SEQ ID NO: 28161 - DNA, 2161 bp, Homo sapiens
  misc_feature (1445)..(1445): n is a, c, g, or t
  misc_feature (1449)..(1449): n is a, c, g, or t
  misc_feature (1456)..(1456): n is a, c, g, or t
  misc_feature (1460)..(1460): n is a, c, g, or t
  misc_feature (1468)..(1469): n is a, c, g, or t
  misc_feature (1484)..(1484): n is a, c, g, or t
  misc_feature (1486)..(1486): n is a, c, g, or t
  misc_feature (1493)..(1493): n is a, c, g, or t
  misc_feature (1500)..(1500): n is a, c, g, or t
  misc_feature (1502)..(1502): n is a, c, g, or t
  misc_feature (1506)..(1506): n is a, c, g, or t
  misc_feature (1510)..(1510): n is a, c, g, or t
  misc_feature (1518)..(1518): n is a, c, g, or t
  misc_feature (1526)..(1526): n is a, c, g, or t
  misc_feature (1537)..(1537): n is a, c, g, or t
  misc_feature (1546)..(1546): n is a, c, g, or t
  misc_feature (1548)..(1549): n is a, c, g, or t
  misc_feature (1556)..(1556): n is a, c, g, or t
  misc_feature (1560)..(1561): n is a, c, g, or t
  misc_feature (1571)..(1571): n is a, c, g, or t
  misc_feature (1573)..(1573): n is a, c, g, or t
  misc_feature (1588)..(1588): n is a, c, g, or t
  misc_feature (1591)..(1591): n is a, c, g, or t
  misc_feature (1595)..(1595): n is a, c, g, or t
  misc_feature (1604)..(1604): n is a, c, g, or t
  misc_feature (1641)..(1641): n is a, c, g, or t
  misc_feature (1647)..(1647): n is a, c, g, or t
  misc_feature (1651)..(1651): n is a, c, g, or t
  misc_feature (1884)..(1884): n is a, c, g, or t
  misc_feature (1888)..(1888): n is a, c, g, or t
  misc_feature (1899)..(1899): n is a, c, g, or t
  misc_feature (1909)..(1909): n is a, c, g, or t
  misc_feature (1932)..(1933): n is a, c, g, or t
  misc_feature (1937)..(1937): n is a, c, g, or t
  misc_feature (1964)..(1964): n is a, c, g, or t
  misc_feature (1971)..(1971): n is a, c, g, or t
  misc_feature (1976)..(1976): n is a, c, g, or t
  misc_feature (1979)..(1979): n is a, c, g, or t
  misc_feature (1982)..(1982): n is a, c, g, or t
  misc_feature (2014)..(2017): n is a, c, g, or t
  misc_feature (2020)..(2020): n is a, c, g, or t
  misc_feature (2027)..(2027): n is a, c, g, or t
  misc_feature (2032)..(2034): n is a, c, g, or t
  misc_feature (2039)..(2039): n is a, c, g, or t
  misc_feature (2050)..(2050): n is a, c, g, or t
  misc_feature (2052)..(2053): n is a, c, g, or t
  misc_feature (2064)..(2064): n is a, c, g, or t
  misc_feature (2070)..(2070): n is a, c, g, or t
  misc_feature (2073)..(2073): n is a, c, g, or t
  misc_feature (2081)..(2082): n is a, c, g, or t
  misc_feature (2088)..(2088): n is a, c, g, or t
  misc_feature (2092)..(2093): n is a, c, g, or t
  misc_feature (2105)..(2105): n is a, c, g, or t
  misc_feature (2111)..(2111): n is a, c, g, or t
  misc_feature (2113)..(2113): n is a, c, g, or t
  misc_feature (2115)..(2115): n is a, c, g, or t
  misc_feature (2117)..(2117): n is a, c, g, or t
  misc_feature (2129)..(2129): n is a, c, g, or t
  misc_feature (2133)..(2135): n is a, c, g, or t
  misc_feature (2138)..(2138): n is a, c, g, or t
  misc_feature (2142)..(2142): n is a, c, g, or t
  misc_feature (2151)..(2151): n is a, c, g, or t
  misc_feature (2154)..(2154): n is a, c, g, or t
  misc_feature (2157)..(2161): n is a, c, g, or t
actctgaggactgactcttaccagctggggagcaaacaggccagctggagaccgagatgacagaaggcaggcactgccaggtgcacctcctggatgataggagactggagctgctggttcagcccaaacttctagcaagagagttgctggacctagtggcttcacatttcaacctgaaagaaaaggagtattttggaataacattcatagatgacacaggtcagcagaactggctgcagttagatcaccgagttcttgaccacgatttgcccaagaaaccaggcccaaccattttgcactttgctgtgaggttttacattgagagcatatcgtttttaaaggataaaaccaccgtggagctgtttttcctgaatgcaaaggcctgtgtgcacaaggggcaaatcgaagtagagagcgaaaccatcttcaagttagcagcgtttattttacaggaagccaagggagattataccagtgatgaaaatgccaggaaagatttaaagacattaccagcctttccaaccaaaactcttcaggagcatccatcccttgcctactgtgaggacagggtaattgagcattatttgaaaatcaaaggtctcactcgaggtcaagctgtggttcagtatatgaaaatagtagaagctctaccgacttacggtgtccattattatgcagtaaaggataagcaaggacttccttggtggcttggaataagctataagggaattggccaatatgatatacaagacaaggtgaagcctcggaagttattccaatggaaacggctggagaacttatatttccgtgagaaaaaatttgctgttgaagttcatgatccacgaaggtgaggatcaaagacgtttctctgtatgacacagttactatacaaataacgctgctatcaacatttgtgtacaagtttttatatgaacatatgttttcatttctcttgggtgtatacctaggaatggaattgctgggtcaaatggtaactatctttaaccctctgaggaatggcaaggctacttttcaaagtgctgcaccattttacatcccaagcagcagtatatgtggttccaatgccgacacatcctcaccgacacttgttatttttagttttgtgtgcatgtatagtttatgccatcctagtgggttgaagtggtaccttcttgtggttttgatttgcacttccctcatgactaatgatggctgagcatcttttcatgtgctgcttagctattcctatatctttagtagagaaatgtctattcagatcttttgctcatttaaaatgttggtgttcttggtcatttaaaaaaaaaaaagtcaaattaccaacatgaactgaagtcaggatgtgggttctcaaatatcttagaagaaatcccgcccccctccgcccgcccccaactgccagacagagtcttactctgtcacccagnctgnagtgcantggngcaatctnngctcactgcaacctncncctcccnggttcangngatnctcntgcctcancctcccangtagctgggantacaggcangnnccaccangccnngctaattttntntttttagtagagacnggntttnaccatgttngccaggctggtctcaaactcctgacctcaggtgatcngcccgnctcngcctcccaaagtgctgagccgtggcacccggccttaagagaaattcttaatcagtccttagtgggtacttttcagtcccgagatggttatggatgtttagaggccagagggatgggaggaaatacctgtgataaaaaggtgacctgaagagataagccgaattcctacaaagaactacttgcacagacaccaaagccaaaaatatctggcctttaagaaaaagtttgctgccnggcncggtggctcangcctgtaatnccagcactttgggaggccgaggnnggcngatcatgaggtcaggagatgagaccancctggcnaacanggnganaccccatctctactaaaaatacaaaaattagnnnngcntggtggngggcnnntgtantcccagctacncnngaggctgaggnagaatngcntgaacccnngaggcngagnntgcagtgagccnagatcncncnantgcactccagcntggnnnacngagngagactccntcnccnnnnn

SEQ ID NO: 28162 - DNA, 1108 bp, Homo sapiens
tgagttctctctcccacttgacagccctgatttgcaactgagtgtagataactttgagcacttcagaatctcctcctacagagacagtagaagtctaaaacggtgtattcagtgacatgcatcctgtaagaagccaaatggctttgatgagaaatccagaagaaagagtgtatgaaagaaaaagatgacatctatgcatagcaaacaaaatctgaagattattacagtaaaaacaaaagaaaggcaagagaatacttactagttaaagagataaggtctcaccatgttgtccagactggacttgaactcctggcttcaagcaatctgcccacctccgcctcccaaagtcctgggatttataggcatgaaccaccgcacctggcctccccaccattttattttctcccgtggctatcacaaccaggaataagagagggagggggacctcagtggtgattttatgctaaggattatggataacaccatccccccattttacaaatgaagaaactggggctcaaaaagcttaattaaatgtctaaggccactgaggcagcaattaaagaggatgtgaagccagtctgctttgtcttcttctggagcctctccttgaggctgacacacctgatcatagccccattatcttaagagtgttagccatatccagtggccagcacactctagacacttctgttattgtagagagacctgttagagatggatgcaagagatttaccctttttcagccttgcctctgctgtcttggggaagtgggaaggttgctttaaatgacgtgtctcgtgatctgtaaataaaagaaaaataatttctggccacttcaattatggcataagttttggttatctgacacccaccctcaccctctccccaacaaaaatgtgtagtcactactttatcctcaagagcctggcacagagtaggtgctcaaaaaatagtcattcactggaaagcaaacaagacaatggatgaagccagcaaaatggaccacgttcacaatttgatggaaattgggtattttattatgtaatcagaagaaagaaatgataaaatagactaattgccaattatagggaaaaaacagtcccaa

SEQ ID NO: 28163 - DNA, 1168 bp, Homo sapiens
cgggagcccaggcgggcaggccgctggggtcggggctgcacgtacgagagccgggacgcccgggttcagagcgaaggaggaggcatggcttcggtgttcatgtgtggcgtggaggacctgctgttcagcggcagccgcttcgtatggaacttgaccgtgtccacgctgcggagatggtacacggagaggctgcgggcttgccaccaggtgctgcggacgtggtgcgggctgcaggacgtgtaccagataagtaccagtgcaaaagccttttggattatttctcattcttccacttttgcctcacccactccagtttggtctcctcacaagataaggtctcaccatgttgtccagactggacttgaactcctggcttcaagcaatctgcccacctccgcctcccaaagtcctgggatttataggcatgaaccaccgcacctggcctccccaccattttattttctcccgtggctatcacaaccaggaataagagagggagggggacctcagtggtgattttatgctaaggattatggataacaccatccccccattttacaaatgaagaaactggggctcaaaaagcttaattaaatgtctaaggccactgaggcagcaattaaagaggatgtgaagccagtctgctttgtcttcttctggagcctctccttgaggctgacacacctgatcatagccccattatcttaagagtgttagccatatccagtggccagcacactctagacacttctgttattgtagagagacctgttagagatggatgcaagagatttaccctttttcagccttgcctctgctgtcttggggaagtgggaaggttgctttaaatgacgtgtctcgtgatctgtaaataaaagaaaaataatttctggccacttcaattatggcataagttttggttatctgacacccaccctcaccctctccccaacaaaaatgtgtagtcactactttatcctcaagagcctggcacagagtaggtgctcaaaaaatagtcattcactggaaagcaaacaagacaatggatgaagccagcaaaatggaccacgttcacaatttgatggaaattgggtattttattatgtaatcagaagaaagaaatgataaaatagactaattgccaattatagggaaaaaacagtcccaa

SEQ ID NO: 28164 - DNA, 4638 bp, Homo sapiens
gcacacacacacacaccgcacaagtgcttaatacgtgtgtcttttgtcttaagcactctcttcagttcctttaaatgagccgaggtcatggtggttcggagatgacagaaggcaggcactgccaggtgcacctcctggatgataggagactggagctgctggttcagcccaaacttctagcaagagagttgctggacctagtggcttcacatttcaacctgaaagaaaaggagtattttggaataacattcatagatgacacaggtcagcagaactggctgcagttagatcaccgagttcttgaccacgatttgcccaagaaaccaggcccaaccattttgcactttgctgtgaggttttacattgagagcatatcgtttttaaaggataaaaccaccgtggagctgtttttcctgaatgcaaaggcctgtgtgcacaaggggcaaatcgaagtagagagcgaaaccatcttcaagttagcagcgtttattttacaggaagccaagggagattataccagtgatgaaaatgccaggaaagatttaaagacattaccagcctttccaaccaaaactcttcaggagcatccatcccttgcctactgtgaggacagggtaattgagcattatttgaaaatcaaaggtctcactcgaggtcaagctgtggttcagtatatgaaaatagtagaagctctaccgacttacggtgtccattattatgcagtaaaggataagcaaggacttccttggtggcttggaataagctataagggaattggccaatatgatatacaagacaaggtgaagcctcggaagttattccaatggaaacagctggagaacttatatttccgtgagaaaaaatttgctgttgaagttcatgatccacgaaggatttcagtttcaagaagaacctttgggcaaagtggcctgtttgtgcaaacatggtatgctaactcttctctcatcaagtccatttgggtaatggcaattagtcagcatcagttttacttggaccggaagcaaagcaaagcaaaaattccttcagccaggagtttagatgagattgcaatggatttgacagagacaggaacacaaagggcctccaagctggtgacactggaggcgaaaagtcagttcatcatggcaagtaatggcagtttaatctcctcaggttctcaagactcagaagttagtgaagagcaaaagagagaaaaaatccttgaactaaagaagaaggagaaactattacaagaaaaacttctgaaaaaagttgaggagcttaagaagatctgtctgcgggaggctgagctcacaggcaaaatgccaaaggagtatcccctgaacataggcgagaagcctcctcaggtcagaagacgtgtgggtactgcgttcaaattagatgacaacttgctgccgagtgaagaagatcctgctttgcaagaactggagagtaattttctaatacaacaaaagctggtggaagctgcaaagaaacttgccaatgagccagacctttgtaaaactgtgaagaaaaagcgaaagcaagattacacagatgcgatgaaaaagcttcaggagattgaaaatgcaataaacgaataccgaattaggtgtggaaagaaacccagccagaaagcaacagtgttaccagaagacataatcccctcagagagtagctctttgtctgacaccaccacctatgatgatcccagtgatgccttcacttttcctgggcagcgatcaagttcagtacctcattctccaagaattcttccccccaagtctcttggtattgagcgaatccatttcagaaagtcgtccatcaatgaacagtttgtggataccaggcagtccagagaaatgctgtccacacacagcagcccttacaaaactctggagaggcggccccagggaggacgaagcatgcccaccacgccagttcttacccgaaacgcctacagcagcagccacttggaacccgaatcttcatctcagcactgccgccagcggagtggaagcctggagtcccagtcccatctgctctccgagatggacagcgataagccatttttctccctctccaaatcccaaagaagcagcagcacagaaatcctcgatgacgggtcttcttatacaagccaatcaagcacagagtattactgtgtgacaccagttaccggcccctattacaccacccagaccctggacactcgcaccaggggtcggaggaggtcaaagaaacagaatgtttctacttcaaattcaggaagcatgcccaacctagcacaaaaggatagtttgaggaatggtgtttactcaaagagtcaggagccaccgtcttccagttactacattgccgggtacacaccctatgcagagtgtgacttttattacagtggtggttatgtctatgagaatgacaccgagggacagtatagtgtcaacccttcctaccggtcctcagcccactatggatatgagcgccagagggactacagcagatcctttcacgaagatgaggtcgaccgggtaccccataacccatatgcaactctccggctgccaaggaaggctgctgcaaaatcggagcacatcaccaaaaacatccacaaggccttagttgccgagcacttgcgtggctggtaccagcgggcctctgggcagaaggatcagggacacagcccgcagaccagctttgactcagacaggggatcacagagatgcctggggtttgcggggctgcaagtaccttgttctccaagcagtcgtgcatccttgtactcttcagtgtcttctacaaatgcttctgggaactggaggacccagttaaccatagggctgtcggattacgagactccagcacattcttcttacaccagctgctatggcaatgtctataatcctttaccctctccaagcagacaatacacagaaatcagtcaactggatggtacagatggaaaccagctggaagacaacctggagagtagtgagcagagactcttttggcatgaagattcaaagcctggaacattagtctgaactgcagttggacctcctgaccaagcactgcgttctcacactagtgtgccttgcaaattgtatttgtcttccgagaggatgttcgttttagaaacctaaagacatcaaaggttgaagagaagacttagttgccctggaagtgaatcagtgaatcacacaccaagccccacaaagcccctaaaggaggatttggcctttcaaactctaggcactaacgtaactgtagggtctgcccacatgttgaagtattgccaagagaggactcagtgtgaagccttcatcaatagcaagcactttttaagggagtaaaagttgttaaaggcaaacgtcaaaaacatgaaagggcattcaggatgtcccatggcaataagaacaggggaaatctcagagcacaattcagcaggatgagagaaggggaaccagaagctccggagtcattgctcacttcagagtttgaattcgtgagctgacaaagagtaacatgctctttctacacagacatggacaatttagacagtattggaaaattacttgaagctggattttcatgaagttctgaatgagtgtaaatgttttttaggatactataaagagtgatgtttttcataagcaccataaaatgggttctggaaaaactgattaccttagcatcctgtaatataacttatggtagcagattggggaaaatgaagcagcccactgaataattgacaaagtctgcttggagaacattctaaggtacaatatcatggagctcctttttcctttctccactaattgcgtgatgagctattgttctggctggtaattctccaactcggctgtcatttgaagtggcagacttaatatggaaagtttttataattatgagtttgaaaaagcattttaagatgatacagaaagtatccaaaacaacagaaaaaaaaagccacgtcattttagatgaattgcgtgccttaaaatggtgaacgttagaaaattaaacaagtctggattccacaagtagttccaagtcaccaagtgacaaaaacaaggttaacattaaaaaagaaaaacaacaacaacgacaaaaagctccaagctgcagtggatttaattatgaggctaaaactacctcatactttccttggaagaactaattagctatggtttattgtagggttttgtttgtttgttttttaaagcaaatgatttccatattcctgattgatcttttttgtcatctttgcttcaaaattacataaaaggtgctcctttcccccttcttttatacaagtttcttgttcatattgtgaatagaaaagtttctgaacaacttttttggaacattttctatctatattccaaagcatgtaatatatacataaaaacgatttgttaaactggtccttagtcatttgtataattagaaatgaagtttgggaaaaaattttggaaaaaagacaagcaaaaaaaaaataacttattccttttttgcatatttgtatagccttctagaatcagaaataacctttttgcatattcttttattgttctgacttttcaagacctattatttttttacataggtcaataaacaaaaggtgtgctactg

SEQ ID NO: 28165 - DNA, 374 bp, Homo sapiens
gattttaggtatacatacacatacatccatcacataaatacgtgcggtgcatatttcttttaaaacggaaaagaaagcacaaccttcctcaggtttctcaaaattcttgccctgcttttggggaacactgaatgaggaatgctgagaggtgaaaataaatctgaaggaacaaactcctctgctgtttttcaggttttacattgagagcatatcgtttttaaaggataaaaccaccgtggagctgtttttcctgaatgcaaaggcctgtgtgcacaaggtaggtgccccgtttgtcatgttcactggatgcctccagagcgactgggatgacaggaagaaatggttttgcctctcttcttgcattcaaactaaga

SEQ ID NO: 28166 - DNA, 533 bp, Homo sapiens
agctaatcctgacatttcttagattccataatgttaggagcatttaatcctgtattttacaagttaggaagcagaggatcagagatgggaaaggactaaccccaaggcccaacattaacaagcccctctaacaaaaactttacaatacatttatgttgaatggaactccaagatctcacctctcccatcccaggaatggagtcccatgtaatcaaagtgaacttaaaaataggacagtttcaacaagtcaggagattcacagcaactgatcaaagggagtccagtcaacgtgagcaagcgtgattatgatgaggaagccccctctgctttaatccacacaaggaacgtaacctgaagtaacctgatgttaaccaatctgctgtgtctactatgctgtttccttgttcctgctagtgctgctttacaaatgcagaccattctatcatacctggcggggcttctgttttattttgtaggctggatgctacccagttcatgaatcgctaataaaagccaattagatctttaaataa

SEQ ID NO: 28167 - DNA, 436 bp, Homo sapiens
ctgccttgtccacagagaggtgcctgtccgctgcttcgagcgtgtgccgacgtctcccgaatgtgtcccctttctcttcttccttgggatttcctaacgtctgacgatcccagcttgcgttggccccctgtgctgtggccccacgacgttttgtccagcttgatcagagcagaaaggggacctggtgggcagcccaaggggcaggaaacttccgggtggattccagcacagccccagccctgccggggtcttcatgccaaacccctggtcggccaggcttgaagctgggctgtggagccacagtcctggcctacaggcaggtgcttaagtcactcaggccactatgacacagttccacagcctgggcagcctacataacagacatgtacctctcacagttccagaggctggacgtccacagtgagacactgtctct

SEQ ID NO: 28168 - DNA, 209 bp, Homo sapiens
ttctgtttctctacaaaatgccaagggattttgatagggatttcattgaatctgtagatcactttaaatagtacaaacattttaacaatatgaagtctttaactctattaacatcaaacgtctttccatttgtttatgtcgtgtttaatttcttttatcagtgttttttagttttcattatataagtcgttcccccccttagttaaatt

SEQ ID NO: 28169 - DNA, 337 bp, Homo sapiens
tcccctaaaacttttaagataaagtcttacgtggattagatctgatttaagtctttcacagaagaaagagcctaatctgtctgtggaagttggaaataagcatcttcaggcctggcgcgggcctcacacctgtaatcccagcgctttgggaggccaaggcggatggatcacttgaggtcaagagtttgaaaccaacctggccaacatggtgaaacccagtgtctacaaaaatacaaaaattagctgggcgtggtggcatgtgcctgtaatcccagctacttgggagactgaggcaggaggattgcttgaacccgggaggcggaggttgcagtgagcc

SEQ ID NO: 28170 - DNA, 564 bp, Homo sapiens
agaatggattatgtttattcataccctggaatattaggttgcaatgagaatgagtgatgtgaagttacatgcaacaacatggatgaatctcaggaacatgtggaatgacgtaaagctgactaagaacacacactctatagttctatttgtatacagctgggcaatgcactcctgcagagccagccacagggcagtggctacatgtggatgggcaggtagcatgggaagcaggctcgggtggtttgggtactggcagtattatgcttcttaatctgtgctgttggctatgcagatgtgttcagattgtgaaaattccttgagctgtacacttcacctctctatcgtaaaaagtttttaaaaattagcaaactgagaataaaagatttgcaattcatattacaggtttaaagcccattcccctaatatataaacagttccaataaacaataagaaaaagaccaactaccccaaaattggaaacaatttatagaaaaagaaataaaaacgatcgttaaatgtacaacaaaaaatgttcatttttaatcatggaaagaaatgcagtgt

SEQ ID NO: 28171 - DNA, 372 bp, Homo sapiens
gctccctgggcaactgggagcctgtggtagagaatgccagagagcgttctctctaacacgtcacacatggctctttagaggggcacaaaagccttttctacatctgcacacttgatccagaaacccaatctgggtatcccagagggatacctggacacatatgcaaatgtgagggtacaaaggtgttcacagtacttgtttagattgcaaggactcctgcgctgacagtggaggacccatcaaaccagtggccctgcagccacctgctgtgtcacctgctcgggaggatgctgccgtatattgttaggtggaaaaaatgcatttgaaaaccacatatggtcgcatcccgttgtcgttaaaaaccaatctcat

SEQ ID NO: 28172 - DNA, 507 bp, Homo sapiens
ctacatctttctcccgtgctggatgcttcctgccctcaaacattggactctaatttcttcagttttggaactcggactgcctctccttgctcctcagcctgcagtcagcctattgtgggaccttgtgatcgtgtgagttaattcttaataaactcccctttatatatatatacatattcaattagttctgtcgctctagagaacattgactaatacgttcatccagtgtaaaagggaaagtaaaataattactgtaacaaaggagaatatctccaagccaacctgcattatttcataaaatatttatctttatacatggtgttcaagttttcctttgaaagaatggatatattttatttaaaggtattagcaggtttccatgactacgacctctggaggaaggggataactttttttaaaccttcctgtgtactactcagttccaattatgtaccaaaccagctggttcaatgcattctcaagaactttaaacatagcaataaaggc

SEQ ID NO: 28173 - DNA, 463 bp, Homo sapiens
gggttttgtttataatcatgttttgagcttatatagacatgctctttcttaaaattcatttatttgcttttcatccatggaaaaccagttttttttcaatgagttataaagtatttaataagaagagattctgatttaattatatccagagatggctttggatcatgttatttaagatggagaatgactatttagaaatattaatgtttggccgggtgcagtggcacacacctgtaatcctagtactttgggaggctgaggcaggcaggtcacttgaggtcaggagttcaagaccagcttggccaaacatgttgaaaccctgtctctaataaaaatacaaaaaatagccaggcatggtggtacacacctgtaatcccagctacttgggaggctgagggaggaaaatcacttgaacctgggaggaggttgcagtgagccaagatcatgccactgtactccagcc

SEQ ID NO: 28174 - DNA, 455 bp, Homo sapiens
  misc_feature (9)..(9): n is a, c, g, or t
  misc_feature (29)..(29): n is a, c, g, or t
  misc_feature (78)..(78): n is a, c, g, or t
  misc_feature (104)..(104): n is a, c, g, or t
  misc_feature (123)..(123): n is a, c, g, or t
cccaaagcntcggaaatttaacccccctnaccctaaaggggaaacaaaaaagctggaaagcttccccaccccggtggngggcccggcctcctaagaacctaagngggatccccccggggctgnagggaaattcgggcaaccgaggaaaatgttgaagaaaatgaacacaaacaatacctcataaatttagatgaagttaaactactataaaagtgaaatatcatagaatattttaaaactaacaacattagcttttttttttgagatggactctcactctgtcaccaggctggagtgcagtgtgcagtggcgcgatcttggctcactgcaatctccgcctccagggttcaagcgattcccctgcctcagcctcccgagtagctgggactacaggcgcgccccatcacgcccggctaattttttgtattttagtagagacaggctttcaccatgtt

SEQ ID NO: 28175 - DNA, 474 bp, Homo sapiens
ggtccacccacctcggcctcccaaagtgctgggatttccacctcctgggttcaagcgattcacatgcctcagccttccaagtagctgggattacaggcacccgccaccattcctggctaatttttataattttagtagaagtgggttttcggcatgttggctaggctgatctcgaacgcctgacctcaggtgatcctgcctcagcctccccagttgctggggttacagatgtgagccactgcacctggcctggaaaggcttctctcactgtccctcacaacaatttgggtcagaagcttttcctgtatactcccgtttccctttatcattagcccttaatatggagtgtcctaacactgtatttacagagagtttacttaactcccctactagattgtctagattgttaggattgtttttttttttaatttttgtggttttttttgtaaatggagtctcgctctgtcacccagg

SEQ ID NO: 28176 - DNA, 301 bp, Homo sapiens
tacttttgtattttcagtagtgacagggtttccccatgttgctcaggctggtgtagaactcctgggctcaagcaatcctcccacctcagccttccaaagtgctgggattacaagtgggagccactgtacccagcaaaataattacaatggagagatctggaagttcaccttggtcaagtgatcaaacttagtattacaggccatctgcagttacgaggcaggaaggatacatcacctatgcagtatttttcccaaaaatgcttaacttgaatttcgtcatgaggaaacagacaaatccggg

SEQ ID NO: 28177 - DNA, 623 bp, Homo sapiens
acagaagtggtggcagtaggcaactttgtctcattcttagtaacattcagtaattcaccatcaactgtgtttgtggaaaatttttgtagatactcttcatgaaataaaagatactccctttcatttttagttgactaagaattgttattaggaatgggtattgaattttatcaaatgcttcgttctatcaggatggatcatacgatttttcttcttttgttcctttgttcttttgttcctctgataaattttacacatttcttttcatctttattttgaatgttcagaattcttgaatatgatccttatgacttcaaaataatatttattgctcagaacatgtagcttttaaaatctattcttcattaaacactgattatctcatttgaagtatttcacataagtgagtatgcgtaagagtttttgaacacaggccaggtgcagttgttcaagcttctaatcccagcactttgggaggctgaggtgggtgggtcacttgaggccaggagtttaagaccagcctggccaacatggtgaaaccccatctttactaaaaatagaaaaattagctgggtgtgttggcacaagcctgtagtcccagctactagggaggctgagatgga

SEQ ID NO: 28178 - DNA, 1030 bp, Homo sapiens
gccattttttcagtgactatccaattactggaagtaagttattctattcagaggtgaacaccagtcacgcttaagtgttcccaccaaccggtgtgcagcgccccacacttggagccaccgcacaggacaaatactgcttttcctgagctcccctggagcttcattcattgaggcaacccaagatcccttgctaaaagcaaaactaaagcattccacgccgttttcattcaggtggcctccatttgactcccgacagcctgaactcgtcacgtaggtaagaaaactttttaaagaccatttggactttgctttgtttcagtgaaatgggtcgtgagaaaaagtgccttccaacgaccaactccctaaatcccaacaccccttctcttaacagcgtttttacatccaacctttacaaccaagactctatacctcaaactacagtgccttggaaaattactgccacatcggcagaaaaccgagttacctttcgagtcaggtttgattctgatgcaggcagccatgtgcggcagggctttcgcacggttgcaagcgcacacctggccggatgctggctgcaccacacactgccaagtacaaactccccgaaaaacaggtggattcggaaaccaacagcgcccgggtcagaactctgggccagtccaaaacctgacaacatctgcgttccttgcagctgttttcgaacgtaagcccgacgctaggcagtgctgttagaaagtgatttggaagagcgcttccgagccacggcgcgccctccgggggagcgcaccggagcaggtgcgggcgagccccgcgcccggggaggtcaggaattccccagccacaccagatccaaccggacgccccagaacggggacggtccccggagtccgcctcccaacctgggtgagaaaacacctccgtccctccgctgcctgagcgctcgaatttacaactcagggcgctttgtgccgcggaggcccggcggacgcgaggtcgggacaatgcacggggccggggtcccggcggccgc

SEQ ID NO: 28179 - DNA, 651 bp, Homo sapiens
gccattttttcagtgactatccaattactggaagtaagttattctattcagaggtgaacaccagtcacgcttaagtgttcccaccaaccggtgtgcagcgccccacacttggagccaccgcacaggacaaatactgcttttcctgagctcccctggagcttcattcattgaggcaacccaagatcccttgctaaaagcaaaactaaagcattccacgccgttttcattcaggtggcctccatttgactcccgacagcctgaactcgtcacgtaggtaagaaaactttttaaagaccatttggactttgctttgtttcagtgaaatgggtcgtgagaaaaagtgccttccaacgaccaactccctaaatcccaacaccccttctcttaacagcgtttttacatccaacctttacaaccaagactctatacctcaaactacagtgccttggaaaattactgccacatcggcagaaaaccgagttacctttcgagtcaggtttgattctgatgcaggcagccatgtgcggcagggctttcgcacggttgcaagcgcacacctgtaatcccagcactttgggaggctgaggcgggcggatcatgaggtcaggagttcgagactagcatgaccaacatggtgaaaccacgtctcta

SEQ ID NO: 28180 - DNA, 1511 bp, Homo sapiens
gccattttttcagtgactatccaattactggaagtaagttattctattcagaggtgaacaccagtcacgcttaagtgttcccaccaaccggtgtgcagcgccccacacttggagccaccgcacaggacaaatactgcttttcctgagctcccctggagcttcattcattgaggcaacccaagatcccttgctaaaagcaaaactaaagcattccacgccgttttcattcaggtggcctccatttgactcccgacagcctgaactcgtcacgtaggtaagaaaactttttaaagaccatttggactttgctttgtttcagtgaaatgggtcgtgagaaaaagtgccttccaacgaccaactccctaaatcccaacaccccttctcttaacagcgtttttacatccaacctttacaaccaagactctatacctcaaactacagtgccttggaaaattactgccacatcggcagaaaaccgagttacctttcgagtcaggtttgattctgatgcaggcagccatgtgcggcagggctttcgcacggttgcaagcgcacacctggccggatgctggctgcaccacacactgccaagtacaaactccccgaaaaacaggtggattcggaaaccaacagcgcccgggtcagaactctgggccagtccaaaacctgacaacatctgcgttccttgcagctgttttcgaacgtaagcccgacgctaggcagtgctgttagaaagtgatttggaagagcgcttccgagccacggcgcgccctccgggggagcgcaccggagcaggtgcgggcgagccccgcgcccggggaggtcaggaattccccagccacaccagatccaaccggacgccccagaacggggacggtccccggagtccgcctcccaacctggaagcaccttgaggaagaaattgtcttgtctacagctctatcctcagtacagcaccaagcttacagtggatgctcagtgaagatttgccgatttgccgaatgaatgctttcacccctgcaactgtttactgcctgctaggagctcagagcctctgggatacaggctgggaatgacagtgcctgctcgcttggaaggcctctcttctggagtcaataaaacagcacttctttgcttcttcctggctggtccacatctttcactgaggagtggatagtggagggagagttcatttctagggcaccacagctatgagaaaagcaagaccagtgcccttggaggcccactaaaaaggcccccactggattattccagcaggctcggctggcctgttttcttcctcccctggtagaattgtgcctgcattggctataaagtccatttgcacacagaaggggtgtgtgtggaaggactctgcagaagtgaatccgctgagtaatgcctgcttcctcagagggtgaatgccaagatgcctccaaaggacatgaagggctctgaaggggaagatgactgagggcaccatttttgatcactgccaattaaaaaaaaaa

SEQ ID NO: 28181 - DNA, 5019 bp, Homo sapiens
gaggaaaaacagtacagatgggccaagagcttcaaggagaagtagttataataattacagatcagtacggaaatcagattcaagcattttcaccaagttctttatcttctttgtcaattgctggggttggacttgatagctcaaatttgaaaacaacctttcaggaaaacacacagagtataagtgtaagaggcatcaaatttattccaggtcctcctggaaataaggatctttgttttacttggcgtgagttttctgactttattcgagtgcaactaatttctggacctcctgctaaacttctccttatagactggccagaactaaaggagtccattccagtgattaatggaagagatttacagaaccctattattgttcaactttgtgatcagtgggataatccagcaccggtacaacatgttaaaataagtcttacaaaagctagcaatttaaagctcatgccttcaaaccaacagcataaaacagatgagaaaggcagggctaatttgggagtattcagtgtttttgcccctaggggagagcatactcttcaggttaaagccatctataacaaaagtatcatagaaggacctataattaagttaatgattcttccagacccagaaaaacccgttcgtctcaatgttaaatatgacaaagatgcatccttcttagcagggggtcttttcactgattttatgattagtgttatttctgaagatgacagtatcattaaaaacattaatccagcacgtatttccatgaaaatgtggaagctgtctaccagtgggaaccgacccccagcaaatgcagaaacatttagttgtaataaaataaaagataatgacaaagaagatggctgcttctatttcagggataaagtaattcctaataaagtggggacatattgtatccagtttggttttatgatggataaaacaaatattctcaacagtgaacaggttatagttgaagtcctgcctaatcaacctgtgaagttagtacctaaaattaaaccacctacaccagctgtttcaaatgttcgctcagttgccagtaggaccttggtcagagatctacatcttagtatcacggatgactacgacaaccatactggaattgatttggttggcactataatagccaccattaaaggctctaatgaggaagatactgataccccactttttattgggaaagttagaacacttgaattccccttcgtgaatggttcggctgaaatcatgagtctggtgctggcagaaagtagtcctggaagggatagtactgaatattttattgtatttgagccccggctaccacttttatcaagaaccttagaaccatatatcctaccgttcatgttttacaatgatgttaagaagcagcaacaaatggcagcacttacaaaagaaaaggaccaattatctcagtctattgttatgtataaaagtttatttgaagccagccaacagcttcttaatgaaatgaaatgtcaagttgaagaagcaagattaaaagaggcccaattgcgaaatgaactaaaaatacataatattgacattcctacaacacaacaggtgccacacattgaagcacttctgaaaagaaagctatcagaacaagaagaactgaagaaaaaacctagaagatcgtgtactcttccaaactatactaaaggcagtggagatgttttgggaaagattgcacatctagcacaaattgaagatgatagagctgcgatggttatttcttggcatctggcaagtgacatggactgtgtagtcaccctaaccactgacgctgcacgtcgtatctatgatgaaacccaaggtcgtcagcaggtgttgccccttgattctatttacaagaagactcttccagattggaaaagatctctacctcatttccgaaatggaaaattgtattttaaacccattggagatccagtctttgctcgagacttgttaacatttccagataatgtagaacattgtgaaacagtatttggtatgctgttaggagacaccattattttggataatctggatgcggccaatcattatagaaaagaggttgttaaaattacacactgtcctacactgctgaccagagatggagatcgaattcgaagtaatggaaagtttgggggccttcagaataaagctcctccaatggataaacttcggggaatggtatttggagctccagttccaaaacagtgtctgatcttaggggaacaaatagatcttcttcagcagtatcgttctgctgtgtgcaaactagacagtgtgaataaggatcttaacagtcaattagagtaccttcgcactccggatatgaggaagaaaaagcaagaacttgatgaacatgagaaaaatctcaaactaatagaggaaaaactaggtatgactcccatacgtaagtgtaatgactcattgcgtcattcaccaaaggttgagacgacagattgtccagttcctcctaaaagaatgagacgagaagctacaagacaaaataggattataaccaaaacagatgtatgagaggtgacagagagaagaggccattggtctcagtaagaatgccctgctttctgcatctctgtttcagaagaccaagagggtgacttaccagactgagtatttctggggacaatacaagtacctgggcatgaatttccatttcgattcagatgggactggaaacaaccattcaattttatgaatcttactggacattatggatttactggaattattccagacattatgccctttggttgtcactaccttgcaaatgtgtaagaggaaaatgtgctaatgtggcagtgactgtaaaactggcacatggcatttattaatcctgaagaaaagtacatgtactatttttcagtataaatataatgaacatgtcagaactatttcttgaaaacctttttattacttttgcgtgaatttatttaacaaagatgttttgtcttttgtgtaagggaggttctagaggctagatgtttaattgtaaatatgtgaggaaactcaatgcagaattcaggataaaaattttaaaagcacaggtatttgggaattgaaatgttaagatacccagaacaacattaaatcaatgagtgaacttgtgacagtggtagcatttcaaatttcaaaagacttatcctgtgtgtgtgtgtgtgtgtatatatatatatatatataaatatatatatataaaatattcagcagcaccaagttttataactattgtttgtttgactttattaatactagaatatgtagtctcagccttaattttacatttacattattttgtaattttttattactatttttaaggggttaaagagaacatacattctcacattagtgtactttctggtagaaagttgctgcaaaaacatttgaaatgtatattaacctaatgtatgtcatatatatgtctttgtgtaagttcaagactattgatctgtgaagttattttgtaaggacatacatttggtaagtaagtttgtgtcccaggaaatgtatgtgtttttaaaccctttctaaatatgcaggccattaataaataagattgtttcttccctactgaatagataagtgtttttcttttttaaaattggaagcttcataaaagttatcttgttaaaaaacgatgatgatgttaacctatctttataattggaaattatttaaactgtttgttgttacagaagaaacaaaatggtaattacagaattagctgtggggaagattggctcccatggtactacaggttgagtatcccttattcaaaatggttgggacctgaagtgttttggattttggttttttgtggggtttttaaattattattttggaatatttgcattatatttaccaatttagcatccctaatccaaaaatctttcattagaaattggaaatgcttcaatgagcatttcccttatgtgtcatatctgcgctcaaatgttttgaattttggaacatttcttgtttctgacttttagattagggatactcaccccgtaccaatatttggagtccttagacattagattatatgaaaatgattgattgataggtaagaaaggttaaagagaaatgactttttaggaactagacttgaacgtataattaatatgtggaactagtttgcttttataattcattgtatcaagaaggagtcatgttttaaatccaaggcattgagactatctagaagcaaaaaagttggttttaaaaattctttttattagaagtgtgtttaaaaacatgtctttttttcccttgagcgacagtggcctcactacattgcccaggctagtcttgaactcctgggttcaagcagtcttcctgccttggcctcctaagtagcagggattacaggcatgcacccacatgccaatttttattgcttaaaatggcgagttctatggatattatctagccccaagcccatatctgtacacttttgttcattttataataccagaaagaatgttctatcagtaaaagaaggttttaagtatgaatctccatttttgtggagtttttctaccctgtaaaaattaactttgtggttcccagtaattacagtaaggagtttttctatattttcacagttggatttatctaaggatatttctcagcatattaaggaatccttttctacatttgagcaaatactgaggttcatgttgtaccaaataataataaattgcttttgtgtttaatatgtaacacgtaagaacaattgaaattttcttctaagatttaatactagtcttttagtataaaggaatgtaactggagaaaaaaattaatgctacagccatttatcctgtgttatgtgttatataatctgaaatttgtcacaatgttacaatcaggaagttttttttctggtttcttcttccaaaggaaaataatagcctacttgtattttgaagtaactgaaataaaactctctccaagcctttttgcacattaaaaaaaaaag

SEQ ID NO: 28182 - DNA, 740 bp, Homo sapiens
gatgttctataattttgaaatacaaaactgtcgcttagaaattcataaagtagaaatgaagcaaaatttacttgacatgtaattcagcattttttacgtatttactgctttctcaacttcatattcctgttctttcaatttttaccatatccagcacgtttattctggatgttttgtaaaagaatgtacaggtaagaggaacctgggagtaagcaagaaatatttgttgaacgaatgaaggtcaatatactattagtagttctattcttcctactcatttatttttgtggaaagaacagaaatgttgactctttgaattccttccccctttatacaaacattgtcagtaatcttaactttcttttaaatttagggataaagtaattcctaataaagtggggacatattgtatccagtttggttttatgatggataaaacaaatattctcaacagtgaacaggtttgcttactttttttatataccacagttagctttacattttctttttttttccctcttggttctgcattacatgaaatagcttcacattttctcatttagtttatgaatgaaatattttgtttaaaagtgaagtaattattggatgtgaaatataaataattcaattttcaggaaaattagtatataatatgtttaaatttgttcaataatttgacctgttacaggagtcacatttccatttctctttatatcaaagactcagcattttagtgtgta

SEQ ID NO: 28183 - DNA, 141 bp, Homo sapiens
atatattttgttgctgaagtaacaactaacagttgttaacagtaaaaataacaaaaaagcaaggtaatgtgagtcttaatactttgttatttgattcatcattgtgtcctcatttgttaaaaataatgagtgtaataattc

SEQ ID NO: 28184 - DNA, 3605 bp, Homo sapiens
gaggaaaaacagtacagatgggccaagagcttcaaggagaagtagttataataattacagatcagtacggaaatcagattcaagcattttcaccaagttctttatcttctttgtcaattgctggggttggacttgatagctcaaatttgaaaacaacctttcaggaaaacacacagagtataagtgtaagaggcatcaaatttattccaggtcctcctggaaataaggatctttgttttacttggcgtgagttttctgactttattcgagtgcaactaatttctggacctcctgctaaacttctccttatagactggccagaactaaaggagtccattccagtgattaatggaagagatttacagaaccctattattgttcaactttgtgatcagtgggataatccagcaccggtacaacatgttaaaataagtcttacaaaagctagcaatttaaagctcatgccttcaaaccaacagcataaaacagatgagaaaggcagggctaatttgggagtattcagtgtttttgcccctaggggagagcatactcttcaggttaaagccatctataacaaaagtatcatagaaggacctataattaagttaatgattcttccagacccagaaaaacccgttcgtctcaatgttaaatatgacaaagatgcatccttcttagcagggggtcttttcactgattttatgattagtgttatttctgaagatgacagtatcattaaaaacattaatccagcacgtatttccatgaaaatgtggaagctgtctaccagtgggaaccgacccccagcaaatgcagaaacatttagttgtaataaaataaaagataatgacaaagaagatggctgcttctatttcagggataaagtaattcctaataaagtggggacatattgtatccagtttggttttatgatggataaaacaaatattctcaacagtgaacaggttatagttgaagtcctgcctaatcaacctgtgaagttagtacctaaaattaaaccacctacaccagctgtttcaaatgttcgctcagttgccagtaggaccttggtcagagatctacatcttagtatcacggatgactacgacaaccatactggaattgatttggttggcactataatagccaccattaaaggctctaatgaggaagatactgataccccactttttattgggaaagttagaacacttgaattccccttcgtgaatggttcggctgaaatcatgagtctggtgctggcagaaagtagtcctggaagggatagtactgaatattttattgtatttgagccccggctaccacttttatcaagaaccttagaaccatatatcctaccgttcatgttttacaatgatgttaagaagcagcaacaaatggcagcacttacaaaagaaaaggaccaattatctcagtctattgttatgtataaaagtttatttgaagccagccaacagcttcttaatgaaatgaaatgtcaagttgaagaagcaagattaaaagaggcccaattgcgaaatgaactaaaaatacataatattgacattcctacaacacaacaggtgccacacattgaagcacttctgaaaagaaagctatcagaacaagaagaactgaagaaaaaacctagaagatcgtgtactcttccaaactatactaaaggcagtggagatgttttgggaaagattgcacatctagcacaaattgaagatgatagagctgcgatggttatttcttggcatctggcaagtgacatggactgtgtagtcaccctaaccactgacgctgcacgtcgtatctatgatgaaacccaaggtcgtcagcaggtgttgccccttgattctatttacaagaagactcttccagattggaaaagatctctacctcatttccgaaatggaaaattgtattttaaacccattggagatccagtctttgctcgagacttgttaacatttccagataatgtagaacattgtgaaacagtatttggtatgctgttaggagacaccattattttggataatctggatgcggccaatcattatagaaaagaggttgttaaaattacacactgtcctacactgctgaccagagatggagatcgaattcgaagtaatggaaagtttgggggccttcagaataaagctcctccaatggataaacttcggggaatggtatttggagctccagttccaaaacagtgtctgatcttaggggaacaaatagatcttcttcagcagtatcgttctgctgtgtgcaaactagacagtgtgaataaggatcttaacagtcaattagagtaccttcgcactccggatatgaggaagaaaaagcaagaacttgatgaacatgagaaaaatctcaaactaatagaggaaaaactaggtatgactcccatacgtaagtgtaatgactcattgcgtcattcaccaaaggttgagacgacagattgtccagttcctcctaaaagaatgagacgagaagctacaagacaaaataggattataaccaaaacagatgtatgagaggtgacagagagaagaggccattggtctcagtaagaatgccctgctttctgcatctctgtttcagaagaccaagagggtgacttaccagactgagtatttctggggacaatacaagtacctgggcatgaatttccatttcgattcagatgggactggaaacaaccattcaattttatgaatcttactggacattatggatttactggaattattccagacattatgccctttggttgtcactaccttgcaaatgtgtaagaggaaaatgtgctaatgtggcagtgactgtaaaactggcacatggcatttattaatcctgaagaaaagtacatgtactatttttcagtataaatataatgaacatgtcagaactatttcttgaaaacctttttattacttttgcgtgaatttatttaacaaagatgttttgtcttttgtgtaagggaggttctagaggctagatgtttaattgtaaatatgtgaggaaactcaatgcagaattcaggataaaaattttaaaagcacaggtatttgggaattgaaatgttaagatacccagaacaacattaaatcaatgagtgaacttgtgacagtggtagcatttcaaatttcaaaagacttatcctgtgtgtgtgtgtgtgtgtatatatatatatatatataaatatatatatataaaatattcagcagcaccaagttttataactattgtttgtttgactttattaatactagaatatgtagtctcagccttaattttacatttacattattttgtaattttttattactatttttaaggggttaaagagaacatacattctcacattagtgtactttctggtagaaagttgctgcaaaaacatttgaaatgtatattaacctaatgtatgtcatatatatgtctttgtgtaagttcaagactattgatctgtgaagttattttgtaaggacatacatttggtaagtaagtttgtgtcccaggaaatgtatgtgtttttaaaccctttctaaatatgcaggccattaataaataagattgtttcttcccta

SEQ ID NO: 28185 - DNA, 3033 bp, Homo sapiens
ttcatttattgacttttttagtatttggtatgctgttaggagacaccattattttggataatctggatgcggccaatcattatagaaaagaggttgttaaaattacacactgtcctacactgctgaccagagatggagatcgaattcgaagtaatggaaagtttgggggccttcagaataaagctcctccaatggataaacttcggggaatggtatttggagctccagttccaaaacagtgtctgatcttaggggaacaaatagatcttcttcagcagtatcgttctgctgtgtgcaaactagacagtgtgaataaggatcttaacagtcaattagagtaccttcgcactccggatatgaggaagaaaaagcaagaacttgatgaacatgagaaaaatctcaaactaatagaggaaaaactaggtatgactcccatacgtaagtgtaatgactcattgcgtcattcaccaaaggttgagacgacagattgtccagttcctcctaaaagaatgagacgagaagctacaagacaaaataggattataaccaaaacagatgtatgagaggtgacagagagaagaggccattggtctcagtaagaatgccctgctttctgcatctctgtttcagaagaccaagagggtgacttaccagactgagtatttctggggacaatacaagtacctgggcatgaatttccatttcgattcagatgggactggaaacaaccattcaattttatgaatcttactggacattatggatttactggaattattccagacattatgccctttggttgtcactaccttgcaaatgtgtaagaggaaaatgtgctaatgtggcagtgactgtaaaactggcacatggcatttattaatcctgaagaaaagtacatgtactatttttcagtataaatataatgaacatgtcagaactatttcttgaaaacctttttattacttttgcgtgaatttatttaacaaagatgttttgtcttttgtgtaagggaggttctagaggctagatgtttaattgtaaatatgtgaggaaactcaatgcagaattcaggataaaaattttaaaagcacaggtatttgggaattgaaatgttaagatacccagaacaacattaaatcaatgagtgaacttgtgacagtggtagcatttcaaatttcaaaagacttatcctgtgtgtgtgtgtgtgtgtatatatatatatatatataaatatatatatataaaatattcagcagcaccaagttttataactattgtttgtttgactttattaatactagaatatgtagtctcagccttaattttacatttacattattttgtaattttttattactatttttaaggggttaaagagaacatacattctcacattagtgtactttctggtagaaagttgctgcaaaaacatttgaaatgtatattaacctaatgtatgtcatatatatgtctttgtgtaagttcaagactattgatctgtgaagttattttgtaaggacatacatttggtaagtaagtttgtgtcccaggaaatgtatgtgtttttaaaccctttctaaatatgcaggccattaataaataagattgtttcttccctactgaatagataagtgtttttcttttttaaaattggaagcttcataaaagttatcttgttaaaaaacgatgatgatgttaacctatctttataattggaaattatttaaactgtttgttgttacagaagaaacaaaatggtaattacagaattagctgtggggaagattggctcccatggtactacaggttgagtatcccttattcaaaatggttgggacctgaagtgttttggattttggttttttgtggggtttttaaattattattttggaatatttgcattatatttaccaatttagcatccctaatccaaaaatctttcattagaaattggaaatgcttcaatgagcatttcccttatgtgtcatatctgcgctcaaatgttttgaattttggaacatttcttgtttctgacttttagattagggatactcaccccgtaccaatatttggagtccttagacattagattatatgaaaatgattgattgataggtaagaaaggttaaagagaaatgactttttaggaactagacttgaacgtataattaatatgtggaactagtttgcttttataattcattgtatcaagaaggagtcatgttttaaatccaaggcattgagactatctagaagcaaaaaagttggttttaaaaattctttttattagaagtgtgtttaaaaacatgtctttttttcccttgagcgacagtggcctcactacattgcccaggctagtcttgaactcctgggttcaagcagtcttcctgccttggcctcctaagtagcagggattacaggcatgcacccacatgccaatttttattgcttaaaatggcgagttctatggatattatctagccccaagcccatatctgtacacttttgttcattttataataccagaaagaatgttctatcagtaaaagaaggttttaagtatgaatctccatttttgtggagtttttctaccctgtaaaaattaactttgtggttcccagtaattacagtaaggagtttttctatattttcacagttggatttatctaaggatatttctcagcatattaaggaatccttttctacatttgagcaaatactgaggttcatgttgtaccaaataataataaattgcttttgtgtttaatatgtaacacgtaagaacaattgaaattttcttctaagatttaatactagtcttttagtataaaggaatgtaactggagaaaaaaattaatgctacagccatttatcctgtgttatgtgttatataatctgaaatttgtcacaatgttacaatcaggaagttttttttctggtttcttcttccaaaggaaaataatagcctacttgtattttgaagtaactgaaataaaactctctccaagcctttttgcacattaaaaaaaaaag

SEQ ID NO: 28186 - DNA, 2954 bp, Homo sapiens
gaggaaaaacagtacagatgggccaagagcttcaaggagaagtagttataataattacagatcagtacggaaatcagattcaagcattttcaccaagttctttatcttctttgtcaattgctggggttggacttgatagctcaaatttgaaaacaacctttcaggaaaacacacagagtataagtgtaagaggcatcaaatttattccaggtcctcctggaaataaggatctttgttttacttggcgtgagttttctgactttattcgagtgcaactaatttctggacctcctgctaaacttctccttatagactggccagaactaaaggagtccattccagtgattaatggaagagatttacagaaccctattattgttcaactttgtgatcagtgggataatccagcaccggtacaacatgttaaaataagtcttacaaaagctagcaatttaaagctcatgccttcaaaccaacagcataaaacagatgagaaaggcagggctaatttgggagtattcagtgtttttgcccctaggggagagcatactcttcaggttaaagccatctataacaaaagtatcatagaaggacctataattaagttaatgattcttccagacccagaaaaacccgttcgtctcaatgttaaatatgacaaagatgcatccttcttagcagggggtcttttcactgattttatgattagtgttatttctgaagatgacagtatcattaaaaacattaatccagcacgtatttccatgaaaatgtggaagctgtctaccagtgggaaccgacccccagcaaatgcagaaacatttagttgtaataaaataaaagataatgacaaagaagatggctgcttctatttcagggataaagtaattcctaataaagtggggacatattgtatccagtttggttttatgatggataaaacaaatattctcaacagtgaacaggttatagttgaagtcctgcctaatcaacctgtgaagttagtacctaaaattaaaccacctacaccagctgtttcaaatgttcgctcagttgccagtaggaccttggtcagagatctacatcttagtatcacggatgactacgacaaccatactggaattgatttggttggcactataatagccaccattaaaggctctaatgaggaagatactgataccccactttttattgggaaagttagaacacttgaattccccttcgtgaatggttcggctgaaatcatgagtctggtgctggcagaaagtagtcctggaagggatagtactgaatattttattgtatttgagccccggctaccacttttatcaagaaccttagaaccatatatcctaccgttcatgttttacaatgatgttaagaagcagcaacaaatggcagcacttacaaaagaaaaggaccaattatctcagtctattgttatgtataaaagtttatttgaagccagccaacagcttcttaatgaaatgaaatgtcaagttgaagaagcaagattaaaagaggcccaattgcgaaatgaactaaaaatacataatattgacattcctacaacacaacaggtgccacacattgaagcacttctgaaaagaaagctatcagaacaagaagaactgaagaaaaaacctagaagatcgtgtactcttccaaactatactaaaggcagtggagatgttttgggaaagattgcacatctagcacaaattgaagatgatagagctgcgatggttatttcttggcatctggcaagtgacatggactgtgtagtcaccctaaccactgacgctgcacgtcgtatctatgatgaaacccaaggtcgtcagcaggtgttgccccttgattctatttacaagaagactcttccagattggaaaagatctctacctcatttccgaaatggaaaattgtattttaaacccattggagatccagtctttgctcgagacttgttaacatttccagataatgtagaacattgtgaaacagtatttggtatgctgttaggagacaccattattttggataatctggatgcggccaatcattatagaaaagaggttgttaaaattacacactgtcctacactgctgaccagagatggagatcgaattcgaagtaatggaaagtttgggggccttcagaataaagctcctccaatggataaacttcggggaatggtatttggagctccagttccaaaacagtgtctgatcttaggggaacaaatagatcttcttcagcagtatcgttctgctgtgtgcaaactagacagtgtgaataaggatcttaacagtcaattagagtaccttcgcactccggatatgaggaagaaaaagcaagaacttgatgaacatgagaaaaatctcaaactaatagaggaaaaactaggtatgactcccatacgtaagtgtaatgactcattgcgtcattcaccaaaggttgagacgacagattgtccagttcctcctaaaagaatgagacgagaagctacaagacaaaataggattataaccaaaacagatgtatgagaggtgacagagagaagaggccattggtctcagtaagaatgccctgctttctgcatctctgtttcagaagaccaagagggtgacttaccagactgagtatttctggggacaatacaagtacctgggcatgaatttccatttcgattcagatgggactggaaacaaccattcaattttatgaatcttactggacattatggatttactggaattattccagacattatgccctttggttgtcactaccttgcaaatgtgtaagaggaaaatgtgctaatgtggcagtgactgtaaaactggcacatggcatttattaatcctgaagaaaagtacatgtactatttttcagtataaatataatgaacatgtcagaactatttcttggtgtaggggggttctagagct

SEQ ID NO: 28187 - DNA, 722 bp, Homo sapiens
cttgtccacattagatgctgcagtggtgttttgtcagcagcagctggtggtgtatctactgatataagcagtcttcctgccttggcctcctaagtagcagggattacaggcatgcacccacatgccaatttttattgcttaaaatggcgagttctatggatattatctagccccaagcccatatctgtacacttttgttcattttataataccagaaagaatgttctatcagtaaaagaaggttttaagtatgaatctccatttttgtggagtttttctaccctgtaaaaattaactttgtggttcccagtaattacagtaaggagtttttctatattttcacagttggatttatctaaggatatttctcagcatattaaggaatccttttctacatttgagcaaatactgaggttcatgttgtaccaaataataataaattgcttttgtgtttaatatgtaacacgtaagaacaattgaaattttcttctaagatttaatactagtcttttagtataaaggaatgtaactggagaaaaaaattaatgctacagccatttatcctgtgttatgtgttatataatctgaaatttgtcacaatgttacaatcaggaagttttttttctggtttcttcttccaaaggaaaataatagcctacttgtattttgaagtaactgaaataaaactctctccaagcctttttgcacattaaaaaaaaaag

SEQ ID NO: 28188 - DNA, 501 bp, Homo sapiens
aaaacattttattttgtttttctgaacactaagtgataccccctgtctttctcaatgtacttttcctcactaggaaaacacacagagtataagtgtaagaggcatcaaatttattccaggtcctcctggaaataaggatctttgttttacttggcgtgagttttctgactttattcgagtgcaactaatttctggacctcctgctaaacttctccttatagactggccagaactaaaggaggtaagtcacttcatgtcttcactgaaagaatttaatatcatatggcttattactttcagattgtcagtgaatcagaatagatatattttgttgctgaagtaacaactaacagttgttaacagtaaaaataacaaaaaagcaaggtaatgtgagtcttaatactttgttatttgattcatcattgtgtcctcatttgttaaaaataatgagtgtaataattcagatcttaaaaactacattacagaggatttcaagcatgc

SEQ ID NO: 28189 - DNA, 4515 bp, Homo sapiens
gatgttctataattttgaaatacaaaactgtcgcttagaaattcataaagtagaaatgaagcaaaatttacttgacatgtaattcagcattttttacgtatttactgctttctcaacttcatattcctgttctttcaatttttaccatatccagcacgtttattctggatgttttgtaaaagaatgtacaggtaagaggaacctgggagtaagcaagaaatatttgttgaacgaatgaaggtcaatatactattagtagttctattcttcctactcatttatttttgtggaaagaacagaaatgttgactctttgaattccttccccctttatacaaacattgtcagtaatcttaactttcttttaaatttagggataaagtaattcctaataaagtggggacatattgtatccagtttggttttatgatggataaaacaaatattctcaacagtgaacaggttatagttgaagtcctgcctaatcaacctgtgaagttagtacctaaaattaaaccacctacaccagctgtttcaaatgttcgctcagttgccagtaggaccttggtcagagatctacatcttagtatcacggatgactacgacaaccatactggaattgatttggttggcactataatagccaccattaaaggctctaatgaggaagatactgataccccactttttattgggaaagttagaacacttgaattccccttcgtgaatggttcggctgaaatcatgagtctggtgctggcagaaagtagtcctggaagggatagtactgaatattttattgtatttgagccccggctaccacttttatcaagaaccttagaaccatatatcctaccgttcatgttttacaatgatgttaagaagcagcaacaaatggcagcacttacaaaagaaaaggaccaattatctcagtctattgttatgtataaaagtttatttgaagccagccaacagcttcttaatgaaatgaaatgtcaagttgaagaagcaagattaaaagaggcccaattgcgaaatgaactaaaaatacataatattgacattcctacaacacaacaggtgccacacattgaagcacttctgaaaagaaagctatcagaacaagaagaactgaagaaaaaacctagaagatcgtgtactcttccaaactatactaaaggcagtggagatgttttgggaaagattgcacatctagcacaaattgaagatgatagagctgcgatggttatttcttggcatctggcaagtgacatggactgtgtagtcaccctaaccactgacgctgcacgtcgtatctatgatgaaacccaaggtcgtcagcaggtgttgccccttgattctatttacaagaagactcttccagattggaaaagatctctacctcatttccgaaatggaaaattgtattttaaacccattggagatccagtctttgctcgagacttgttaacatttccagataatgtagaacattgtgaaacagtatttggtatgctgttaggagacaccattattttggataatctggatgcggccaatcattatagaaaagaggttgttaaaattacacactgtcctacactgctgaccagagatggagatcgaattcgaagtaatggaaagtttgggggccttcagaataaagctcctccaatggataaacttcggggaatggtatttggagctccagttccaaaacagtgtctgatcttaggggaacaaatagatcttcttcagcagtatcgttctgctgtgtgcaaactagacagtgtgaataaggatcttaacagtcaattagagtaccttcgcactccggatatgaggaagaaaaagcaagaacttgatgaacatgagaaaaatctcaaactaatagaggaaaaactaggtatgactcccatacgtaagtgtaatgactcattgcgtcattcaccaaaggttgagacgacagattgtccagttcctcctaaaagaatgagacgagaagctacaagacaaaataggattataaccaaaacagatgtatgagaggtgacagagagaagaggccattggtctcagtaagaatgccctgctttctgcatctctgtttcagaagaccaagagggtgacttaccagactgagtatttctggggacaatacaagtacctgggcatgaatttccatttcgattcagatgggactggaaacaaccattcaattttatgaatcttactggacattatggatttactggaattattccagacattatgccctttggttgtcactaccttgcaaatgtgtaagaggaaaatgtgctaatgtggcagtgactgtaaaactggcacatggcatttattaatcctgaagaaaagtacatgtactatttttcagtataaatataatgaacatgtcagaactatttcttgaaaacctttttattacttttgcgtgaatttatttaacaaagatgttttgtcttttgtgtaagggaggttctagaggctagatgtttaattgtaaatatgtgaggaaactcaatgcagaattcaggataaaaattttaaaagcacaggtatttgggaattgaaatgttaagatacccagaacaacattaaatcaatgagtgaacttgtgacagtggtagcatttcaaatttcaaaagacttatcctgtgtgtgtgtgtgtgtgtatatatatatatatatataaatatatatatataaaatattcagcagcaccaagttttataactattgtttgtttgactttattaatactagaatatgtagtctcagccttaattttacatttacattattttgtaattttttattactatttttaaggggttaaagagaacatacattctcacattagtgtactttctggtagaaagttgctgcaaaaacatttgaaatgtatattaacctaatgtatgtcatatatatgtctttgtgtaagttcaagactattgatctgtgaagttattttgtaaggacatacatttggtaagtaagtttgtgtcccaggaaatgtatgtgtttttaaaccctttctaaatatgcaggccattaataaataagattgtttcttccctactgaatagataagtgtttttcttttttaaaattggaagcttcataaaagttatcttgttaaaaaacgatgatgatgttaacctatctttataattggaaattatttaaactgtttgttgttacagaagaaacaaaatggtaattacagaattagctgtggggaagattggctcccatggtactacaggttgagtatcccttattcaaaatggttgggacctgaagtgttttggattttggttttttgtggggtttttaaattattattttggaatatttgcattatatttaccaatttagcatccctaatccaaaaatctttcattagaaattggaaatgcttcaatgagcatttcccttatgtgtcatatctgcgctcaaatgttttgaattttggaacatttcttgtttctgacttttagattagggatactcaccccgtaccaatatttggagtccttagacattagattatatgaaaatgattgattgataggtaagaaaggttaaagagaaatgactttttaggaactagacttgaacgtataattaatatgtggaactagtttgcttttataattcattgtatcaagaaggagtcatgttttaaatccaaggcattgagactatctagaagcaaaaaagttggttttaaaaattctttttattagaagtgtgtttaaaaacatgtctttttttcccttgagcgacagtggcctcactacattgcccaggctagtcttgaactcctgggttcaagcagtcttcctgccttggcctcctaagtagcagggattacaggcatgcacccacatgccaatttttattgcttaaaatggcgagttctatggatattatctagccccaagcccatatctgtacacttttgttcattttataataccagaaagaatgttctatcagtaaaagaaggttttaagtatgaatctccatttttgtggagtttttctaccctgtaaaaattaactttgtggttcccagtaattacagtaaggagtttttctatattttcacagttggatttatctaaggatatttctcagcatattaaggaatccttttctacatttgagcaaatactgaggttcatgttgtaccaaataataataaattgcttttgtgtttaatatgtaacacgtaagaacaattgaaattttcttctaagatttaatactagtcttttagtataaaggaatgtaactggagaaaaaaattaatgctacagccatttatcctgtgttatgtgttatataatctgaaatttgtcacaatgttacaatcaggaagttttttttctggtttcttcttccaaaggaaaataatagcctacttgtattttgaagtaactgaaataaaactctctccaagcctttttgcacattaaaaaaaaaag

SEQ ID NO: 28190 - DNA, 4782 bp, Homo sapiens
gaggaaaaacagtacagatgggccaagagcttcaaggagaagtagttataataattacagatcagtacggaaatcagattcaagcattttcaccaagttctttatcttctttgtcaattgctggggttggacttgatagctcaaatttgaaaacaacctttcaggaaaacacacagagtataagtgtaagaggcatcaaatttattccaggtcctcctggaaataaggatctttgttttacttggcgtgagttttctgactttattcgagtgcaactaatttctggacctcctgctaaacttctccttatagactggccagaactaaaggagtccattccagtgattaatggaagagatttacagaaccctattattgttcaactttgtgatcagtgggataatccagcaccggtacaacatgttaaaataagtcttacaaaagctagcaatttaaagctcatgccttcaaaccaacagcataaaacagatgagaaaggcagggctaatttgggagtattcagtgtttttgcccctaggggagagcatactcttcaggttaaagccatctataacaaaagtatcatagaaggacctataattaagttaatgattcttccagacccagaaaaacccgttcgtctcaatgttaaatatgacaaagatgcatccttcttagcagggggtcttttcactgattttatgattagtgttatttctgaagatgacagtatcattaaaaacattaatccagcacgtatttccatgaaaatgtggaagctgtctaccagtgggaaccgacccccagcaaatgcagaaacatttagttgtaataaaataaaagataatgacaaagaagatggctgcttctatttcagggataaagtaattcctaataaagtggggacatattgtatccagtttggttttatgatggataaaacaaatattctcaacagtgaacaggttatagttgaagtcctgcctaatcaacctgtgaagttagtacctaaaattaaaccacctacaccagctgtttcaaatgttcgctcagttgccagtaggaccttggtcagagatctacatcttagtatcacggatgactacgacaaccatactggaattgatttggttggcactataatagccaccattaaaggctctaatgaggaagatactgataccccactttttattgggaaagttagaacacttgaattccccttcgtgaatggttcggctgaaatcatgagtctggtgctggcagaaagtagtcctggaagggatagtactgaatattttattgtatttgagccccggctaccacttttatcaagaaccttagaaccatatatcctaccgttcatgttttacaatgatgttaagaagcagcaacaaatggcagcacttacaaaagaaaaggaccaattatctcagtctattgttatgtataaaagtttatttgaagccagccaacagcttcttaatgaaatgaaatgtcaagttgaagaagcaagattaaaagaggcccaattgcgaaatgaactaaaaatacataatattgacattcctacaacacaacaggtgccacacattgaagcacttctgaaaagaaagctatcagaacaagaagaactgaagaaaaaacctagaagatcgtgtactcttccaaactatactaaaggcagtggagatgttttgggaaagattgcacatctagcacaaattgaagatgatagagctgcgatggttatttcttggcatctggcaagtgacatggactgtgtagtcaccctaaccactgacgctgcacgtcgtatctatgatgaaacccaaggtcgtcagcaggtgttgccccttgattctatttacaagaagactcttccagattggaaaagatctctacctcatttccgaaatggaaaattgtattttaaacccattggagatccagtctttgctcgagacttgttaacatttccagataatgtagaacattgtgaaacagtatttggtatgctgttaggagacaccattattttggataatctggatgcggccaatcattatagaaaagaggttgttaaaattacacactgtcctacactgctgaccagagatggagatcgaattcgaagtaatggaaagtttgggggccttcagaataaagctcctccaatggataaacttcggggaatggtatttggagctccagttccaaaacagtgtctgatcttaggggaacaaatagatcttcttcagcagtatcgttctgctgtgtgcaaactagacagtgtgaataaggatcttaacagtcaattagagtaccttcgcactccggatatgaggaagaaaaagcaagaacttgatgaacatgagaaaaatctcaaactaatagaggaaaaactaggtatgactcccatacgtaagtgtaatgactcattgcgtcattcaccaaaggttgagacgacagattgtccagttcctcctaaaagaatgagacgagaagctacaagacaaaataggattataaccaaaacagatgtatgagaggtgacagagagaagaggccattggtctcagtaagaatgccctgctttctgcatctctgtttcagaagaccaagagggtgacttaccagactgagtatttctggggacaatacaagtacctgggcatgaatttccatttcgattcagatgggactggaaacaaccattcaattttatgaatcttactggacattatggatttactggaattattccagacattatgccctttggttgtcactaccttgcaaatgtgtaagaggaaaatgtgctaatgtggcagtgactgtaaaactggcacatggcatttattaatcctgaagaaaagtacatgtactatttttcagtataaatataatgaacatgtcagaactatttcttgaaaacctttttattacttttgcgtgaatttatttaacaaagatgttttgtcttttgtgtaagggaggttctagaggctagatgtttaattgtaaatatgtgaggaaactcaatgcagaattcaggataaaaattttaaaagcacaggtatttgggaattgaaatgttaagatacccagaacaacattaaatcaatgagtgaacttgtgacagtggtagcatttcaaatttcaaaagacttatcctgtgtgtgtgtgtgtgtgtatatatatatatatatataaatatatatatataaaatattcagcagcaccaagttttataactattgtttgtttgactttattaatactagaatatgtagtctcagccttaattttacatttacattattttgtaattttttattactatttttaaggggttaaagagaacatacattctcacattagtgtactttctggtagaaagttgctgcaaaaacatttgaaatgtatattaacctaatgtatgtcatatatatgtctttgtgtaagttcaagactattgatctgtgaagttattttgtaaggacatacatttggtaagtaagtttgtgtcccaggaaatgtatgtgtttttaaaccctttctaaatatgcaggccattaataaataagattgtttcttccctactgaatagataagtgtttttcttttttaaaattggaagcttcataaaagttatcttgttaaaaaacgatgatgatgttaacctatctttataattggaaattatttaaactgtttgttgttacagaagaaacaaaatggtaattacagaattagctgtggggaagattggctcccatggtactacaggttgagtatcccttattcaaaatggttgggacctgaagtgttttggattttggttttttgtggggtttttaaattattattttggaatatttgcattatatttaccaatttagcatccctaatccaaaaatctttcattagaaattggaaatgcttcaatgagcatttcccttatgtgtcatatctgcgctcaaatgttttgaattttggaacatttcttgtttctgacttttagattagggatactcaccccgtaccaatatttggagtccttagacattagattatatgaaaatgattgattgataggtaagaaaggttaaagagaaatgactttttaggaactagacttgaacgtataattaatatgtggaactagtttgcttttataattcattgtatcaagaaggagtcatgttttaaatccaaggcattgagactatctagaagcaaaaaagttggttttaaaaattctttttattagaagtgtgtttaaaaacatgtctttttttcccttgagcgacagagtgagactccgtctcaaaaaaaaaaaaaaaaaaaaaaaaaaaaaaaaaatttttaattaaaattttacgggatgggggtttatatatccgttttatatttataaaagcaaaattttacgttggggtcatcgtgagacgtatgttggcagcttcttaaaaccacctttatgcataaatttgatcactttattaagcttgatctctttttggggttttaaagggctctaattattacctgttaaaacagaatctgggtgaaaagtgtggttttcttttttttaaagtgttgggggaaaccatattaccgccgagattattatttaagccaatttataattccagaacccattaaaaattattaaccgggtgagggacctctcataattaggtgcagggaaggtggacagaattattcaaagaatttataattccaaaaagccaccacctttttacccgtgattag

SEQ ID NO: 28191 - DNA, 1468 bp, Homo sapiens
gaggaaaaacagtacagatgggccaagagcttcaaggagaagtagttataataattacagatcagtacggaaatcagattcaagcattttcaccaagttctttatcttctttgtcaattgctggggttggacttgatagctcaaatttgaaaacaacctttcaggaaaacacacagagtataagtgtaagaggcatcaaatttattccaggtcctcctggaaataaggatctttgttttacttggcgtgagttttctgactttattcgagtgcaactaatttctggacctcctgctaaacttctccttatagactggccagaactaaaggagtccattccagtgattaatggaagagatttacagaaccctattattgttcaactttgtgatcagtgggataatccagcaccggtacaacatgttaaaataagtcttacaaaagctagcaatttaaagctcatgccttcaaaccaacagcataaaacagatgagaaaggcagggctaatttgggagtattcagtgtttttgcccctaggggagagcatactcttcaggttaaagccatctataacaaaagtatcatagaaggacctataattaagttaatgattcttccagacccagaaaaacccgttcgtctcaatgttaaatatgacaaagatgcatccttcttagcagggggtcttttcactgattttatgattagtgttatttctgaagatgacagtatcattaaaaacattaatccagcacgtatttccatgaaaatgtggaagctgtctaccagtgggaaccgacccccagcaaatgcagaaacatttagttgtaataaaataaaagataatgacaaagaagatggctgcttctatttcaggtatttctcaaaacatttcatattttgaatacatatcttgttacaaagtaattcaaccctggagatatatgtgggctcacctgaggaaaagtaatttatgatcaaatagaaatgttagtgtctctaaatttttctcagttttttgggaaaaggtgtgttttcgtttttaagcattaaattggttttaagctttgtaaattgtaattgtatttgcttttgaaactatcgaagccatcagaagaattcttttatgttgtcagggcactttataacttcttattatataggaggtttctataaagattagactggcttttaacatttctgtgactttgagcatgttgctgcttcattctggacctccattttcaaatctaaaaacattatgtgttaagtttctttacaaatcctttatcatcaatagggtcaaaatgctcattatatttgttcagtgctttttcagactaattggtaaaggaccaatcatggaagctccaccccttacctcttccagttattaccgtcttccttcctgttgtgcatgccatgcacacactcatgtagacacacacatgcacacaccacaaaccc

SEQ ID NO: 28192 - DNA, 392 bp, Homo sapiens
gcactcataaagcagatcttggcgactcttactggtttggccttttcctaagctttggtgggtggtgtgcttgccacactagactgactgccatggctatggtgcaggtgctaagctctgcagttacatcatcattcatgggttctggaaggcacattttctcatatgtcaactctgaaatcagaatacctcatttttagttaaggtaatgaagtgacattgtcctcatctgggatacagtaggtgaagagtgagaaaacatgtctaggtgtattgggactagagggcttcggcagagcagcttcctcctcctcctcaccccttccctgtcatggaaacacatgctcatataaattaaacattccaacagttcataaaggtataaaatgaca

SEQ ID NO: 28193 - DNA, 513 bp, Homo sapiens
  misc_feature (483)..(483): n is a, c, g, or t
  misc_feature (486)..(487): n is a, c, g, or t
  misc_feature (492)..(492): n is a, c, g, or t
  misc_feature (494)..(494): n is a, c, g, or t
ccattaatccaggaatcttagctttagcgtttctcaacacttagtaacccaaccggcatttcccgccctggattttggagtaggaggtttctaaccactttttctttacgatactttccaaaaacatggtttctatttaatgtatgataatttccaaaaacaggttgcaaaagaagactccttcttgttggtgactgatatgaataactagatgaaagcttaccaaggacataaagtttgcgcggttagtaatttttgacgactgccttactcccacctcccttattttacagacatgaggattctagcttgaatgatgaagacatctgctcaagggcccacactgtgggtcgatattacacatctacttttagaaccctagtttccaagattcccgagggatcttcaaccctgtagagggcgcgccgtgcgcgttagggaccgcgggcggagactgcaccctcgcagctcgcggccctggtnaanngtggngngttcgccggtcgtccgcgc

SEQ ID NO: 28194 - DNA, 487 bp, Homo sapiens
caccacagaggcaaagagaacaggatgatgctttggtgctagctgctggggcttggagttgggtgagagctgtaagcatcaaatcttctgaagggatcaaccctcatgtagttacaacacgggctcatttttctcttgaaagggctctaagagtccttcacacagtgtccatccagctcttctcagtagagggctcactcccacaggactgctgccactttgcaagcaattggttgtcacctatacttctgatcaactggctataaaccggggttcccaccacccactcctccagtttgattaatttgctaggatggctcacagaactcaatgaagcacatttcgtgaatagccagatgaagaggtggatggggcagggtatgggggaggtgctaccgagctcccaagtgctctccaggaacaccaccctcccagcacctatgcatgttcagtgacccggaagctcactgaggattgttcaagagtt

SEQ ID NO: 28195 - DNA, 439 bp, Homo sapiens
gattaatacactttcattaagtatctactgagaaatttttataaggaatataaaaaggtaaaatactctctgtctttgggaaaactaatctgattagaaatattagacagatgtttgaaacaactgaaaaacttggtaagtttaaaatgtagctcaaaggagaaagagaatgagaggttaggatcgcaaatgctaaagatgttggatgtaatagttgctgcagggcagtttgagtgagaaaagtcaatgggttagtgcaggagttgaaggatttgggaacacttgagagcactagttcctagtttgggacctcagacttatgcagtctataaagccatgtctaccaaatattgtttatgcactgaacaaaggttcagctaccatcatttaagggttatctggagtaatttttggcattgaaaagagtgttttagctgtg

SEQ ID NO: 28196 - DNA, 414 bp, Homo sapiens
ctgactgcaacatagtgtgtcttgttgtctgtgtgacctgcgtagaattactttcctttctcattgggctccagtctgaaacacccttgaattttagaaacattgtaaggttaccccttcctcttttttttgtttttgtgttttttgtttttagaggcaaggtcttgctctgtcacccaggctggagggtaatggcacaattatagctcactgaagccttgacctcctgggcccatgagatcctcatgcttcagcctcccaaatagctgggacgataggttcctgctaccacatctgactccttttttttaagccatctttgtctttgtgtacactcatttacatttgtctagatacacatgaatgcatgcagagatagactcactagtcttacatgtctctttccccccatcc

SEQ ID NO: 28197 - DNA, 751 bp, Homo sapiens
ccaacatacgtagaagagtacttgtgtttaactttgaatgtttcaagaaacccaaaacttaacaccatgtcttatgacagaggcatttactgctaagtacccatgcactatcccaagatcatgtcactgcactccagtctgggcaacagagtgagactccgtctcaaaaaaaaaaaataatttgatcctcataaaattcagcattccaaagaattgggggtaggaaacttgagccccactttgagatggggtgggattcctcttgagatactctacagcacacatactcttgaccttttcatgtatctctgtctcctaatttggcaggaaatataggaaaaggaacaagggaaaaacatagtgacagccaggaatattgaatgtcaccttataatctgaaaatatgtggtagaattagtttggatgttttccccactatatagaagaagtgacttgttcaggaagaagaaatcccacatccccttcaaatgtctagttcttggtctacacatgggaacaatacatggtgactggttaataaccaatggtccacacctaggagtctgcccaggacccactagtctggctaaataaggtggttattgtatatcttctggtgaagagttctccagttgggtgtggtggctcacacctgtaatctcagcactttgagaggctgagtctggctgatggcttgagctcaggagtttgagaccaggctggtcaacatggcgaaacctcatctctacaa

SEQ ID NO: 28198 - DNA, 466 bp, Homo sapiens
taatattctttgttattataatgaagatgcacagaatacttttaattctgctatgtagttgagataacaaagacttaaaaatgactatataactgtgccaatagattcacaatacaaaatgatgtaattcgcgacatcaataaaacacataggcagccataaagaggcagggttttatatgctatagtagttatttttggtaatatctatagtaacaacaaagaaaatacctatagtacttaggattttgagactagtctggtcaacatggcaaaaccctgtctctatgaaaaataacaaaaattagccaggagtactggtgcacatctgtggtcccaggtactcagaaggctgtggtgggaggattgtttgagttgagcctgagaggcagagcttgcaataagcagagattgtgccactgccctccagcctgggtgacagagcaaaaccctgtcaaaaaaaaaaa

SEQ ID NO: 28199 - DNA, 445 bp, Homo sapiens
actactaaattcgcggccgcgtcgacccctttcattagggcccctatatccaatacctaatattattaaaattgctgattccgttcaatcaacaactggtaaatattttgctcttgtggatttggctaacgtgctgtttcaatagcgtcttcactgcagttcgcctcctcctctaaaagaacacagtacaccttttcagacctctgcagctgtgtcatcacatgcaatctttaattaatcttaacgacatccaccttctccaggagcactggtatgagagtacatccaggacattctcagccaaggagactcacttaatacatacattgatgacattcgagaccaatatttcttagtacttttgggttttggtggcaacatattcctcatttataaattttacttctaaattaaagtctacagacactcctgtaagtgacttctt

SEQ ID NO: 28200 - DNA, 563 bp, Homo sapiens
actactaaattcgcggccgcgtcgacccctttcattagggcccctatatccaatacctaatattattaaaattgctgattccgttcaatcaacaactggtaaatattttgctcttgtggatttggctaacgtgctgtttcaatagcgtcttcactgcagttcgcctcctcctctaaaagaacacagtacaccttttcagacctctgcagctgtgtcatcacatgcaatctttaattaatcttaacgacatccaccttctccaggagcactggtatgagagtacatccaggacattctcagccaaggagactcacttaatacatacattgatgacattcgagaccaatatttcttagtacttttgggttttggtggcaacatattcctcatttataaattttacttctaaattaaagtctacagacactcctgtaagtgacttcttaaaaaaaaaaaaagcctttactgtagagtcttctcaaccttttcaaatgcctcctgcaatctctggatatttaggatagctatcagttgccccaggatttctgatacgagatattgcc

SEQ ID NO: 28201 - DNA, 774 bp, Homo sapiens
ggacaactggcacaagggccgcaaagctgggggcaagagaaggccctgccacaagaagcggaagtatgagttggggcgcccagctgccaacagcaagactgacccgtgccgcatccacacagtccgtgtgcgaggaggtaacaagaaatactgtgccccgaggctggacgtggggaatttctcctggggctcacgagtgattgtagctccgtaataaccaagagatcatctgagtgtgggtcgtatcaactgcgaagtactacatagacgcagcatgtgtgtcgtcaccgagagcacccgtggctgacagcaattgctagtcagtcgcgtccatcagaggcaggcagcacgcagtacgcgacgagtgtgtagcgaggttcccccactattgtcggctggccccctggggaccgtacagcaagggcagcatgaagcttgatctgcgctgtaggaacgacagaggatgttttgagaatcaaaaagaaggatgcttaaagaaaaatttcacgagagaaactattgagtgaacagggacaaaagaaatgccaaaatgagcagtctcctgggggagcagttccagcagggcaagcttcttgcgtgcatcgcttcaaggccgggacagtgtggccgagcagatggctatgtgctagagggcaaagagttggagttctatcttaggaaaatcaaggccgcaaagggcaaataaatccttgttttgtcttcacccatgtaataaaggtgtttattgttttgttcccaaaaaaaaaaaagaaa

SEQ ID NO: 28202 - DNA, 843 bp, Homo sapiens
ctcttcttagtaaactaatgtattcgttcattatcagataaatggaatgtaaaccagttatgtaaaaatatcacatatactaatgcatttttccaaaccttaaagccctacagaaattataaagaaacattattctcgtgttatcatgaagctagaagggtccaaagaaatacaaagtgaaacctcttgtatttaaaacaaaacttgcaccaccaccaccaccccaaaatagttttttttttttttttagaatatctcttccaagttttaaagttcaagtaaaattgatgtaatagcaataagtgtagtaacagtaaagtagggaatggtgactattctatagcaaagatctacagatgttggaattgtgttagaaaccttcagagccacaccacagccttctattacatttaaatgtcgtaggaaaaactgcaattttccggaaaattgtattaaggaccaggtgctctaataccaagagctgttttgacacatcaaaggttaagtttgggtctttgaaaatcctgcctcttactgaacactttaaaagtcattcatgttaaaacacacacattcttgcctttgactatacactgtaaaagtactacatgttaaaatggagatggggacatttttgttgtttaagtttatggaagtatgactccattttagtatagctacaatgtcgcaaacgatggaataaggtactcatcaatacattacctggtaagtataaatagttcaacttgccggctttgaaaagcttaatcctatttcttatggtgaaccttaaataaaatgaaaatacacaactgacaatgtttaacgtgcacttaaacaaac

SEQ ID NO: 28203 - DNA, 399 bp, Homo sapiens
ctttccctggctgacagaactctgccttcgagtaggtgttgggggtcatgcccttcatgaaaggaggagtttctctctcatctcgtcaaaaaacaaattattctgccaagcaaggagcatgttttagcttagtcaccacagaagaaacagatcacttttaattatgacatttcatcaacacttggcaagtaagaaagatgggttgaaagactgcatcagaaatattctagagttattttcctgctaacatggaaacaaaaagattcaatgtgagaagaaaaaatagattcctaatggtcaagagaacaagaaaattagatagaaacttaaatataaagtacccggaagtcaaaatgtttgaaatgacacttagagccttaattaaccagattttaagat

SEQ ID NO: 28204 - DNA, 320 bp, Homo sapiens
attttttaccatacacaaaatttaactgaagatggattaaagacttaaatgtaagacctgaaactactagaagaaaacataggtgaaatgcttcataacactggactggacaaagttttgttaataagactttaaaagcacaggcaaaaaatgaaaagtagacaatgggattacatcaaaatacaaggcttctgcactgcaaaggaaacagtcaacaagtgaaaagacaacctgcaaaatgggagaatatatttgcaaacactacatctaacaagaggaggatattcaaaatatataagaaactcaaacaactcaatagc

SEQ ID NO: 28205 - DNA, 152 bp, Homo sapiens
acacactaacatcccagggactaaaactatagatggcagtgtagttctgccaagagcgtgggtgtttacattacgttgaaattcatttcctgttgatggatttaagaaaattattatatcagttaataaaacttctgttaaatagggtcaaa

SEQ ID NO: 28206 - DNA, 2781 bp, Homo sapiens
ggcgcgggcgcactggccgcatagagacgcagcgcacgcgcagtcgcgtatccgtgtgatgggcgggctgttgacggcgctgcgatggctgcctgcgagggcaggagaagcggagctctcggttcctctcagtcggacttcctgacgccgccagtgggcggggccccttgggccgtcgccaccactgtagtcatgtacccaccgccgccgccgccgcctcatcgggacttcatctcggtgacgctgagctttggcgagagctatgacaacagcaagagttggcggcggcgctcgtgctggaggaaatggaagcaactgtcgagattgcagcggaatatgattctcttcctccttgcctttctgcttttctgtggactcctcttctacatcaacttggctgaccattggaaagctctggctttcaggctagaggaagagcagaagatgaggccagaaattgctgggttaaaaccagcaaatccacccgtcttaccagctcctcagaaggcggacaccgaccctgagaacttacctgagatttcgtcacagaagacacaaagacacatccagcggggaccacctcacctgcagattagacccccaagccaagacctgaaggatgggacccaggaggaggccacaaaaaggcaagaagcccctgtggatccccgcccggaaggagatccgcagaggacagtcatcagctggaggggagcggtgatcgagcctgagcagggcaccgagctcccttcaagaagagcagaagtgcccaccaagcctcccctgccaccggccaggacacagggcacaccagtgcatctgaactatcgccagaagggcgtgattgacgtcttcctgcatgcatggaaaggataccgcaagtttgcatggggccatgacgagctgaagcctgtgtccaggtccttcagtgagtggtttggcctcggtctcacactgatcgacgcgctggacaccatgtggatcttgggtctgaggaaagaatttgaggaagccaggaagtgggtgtcgaagaagttacactttgaaaaggacgtggacgtcaacctgtttgagagcacgatccgcatcctgggggggctcctgagtgcctaccacctgtctggggacagcctcttcctgaggaaagctgaggattttggaaatcggctaatgcctgccttcagaacaccatccaagattccttactcggatgtgaacatcggtactggagttgcccacccgccacggtggacctccgacagcactgtggccgaggtgaccagcattcagctggagttccgggagctctcccgtctcacaggggataagaagtttcaggaggcagtggagaaggtgacacagcacatccacggcctgtctgggaagaaggatgggctggtgcccatgttcatcaatacccacagtggcctcttcacccacctgggcgtattcacgctgggcgccagggccgacagctactatgagtacctgctgaagcagtggatccagggcgggaagcaggagacacagctgctggaagactacgtggaagccatcgagggtgtcagaacgcacctgctgcggcactccgagcccagtaagctcacctttgtgggggagcttgcccacggccgcttcagtgccaagatggaccacctggtgtgcttcctgccagggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaagccagcagacaggcacaacctgctgcggccagagaccgtggagagcctgttctacctgtaccgcgtcacaggggaccgcaaataccaggactggggctgggagattctgcagagcttcagccgattcacacgggtcccctcgggtggctattcttccatcaacaatgtccaggatcctcagaagcccgagcctagggacaagatggagagcttcttcctgggggagacgctcaagtatctgttcttgctcttctccgatgacccaaacctgctcagcctggacgcctacgtgttcaacaccgaagcccaccctctgcctatctggacccctgcctagggtggatggctgctggtgtggggacttcgggtgggcagaggcaccttgctgggtctgtggcattttccaagggcccacgtagcaccggcaaccgccaagtggcccaggctctgaactggctctgggctcctcctcgtctctgctttaatcaggacaccgtgaggacaagtgaggccgtcagtcttggtgtgatgcggggtgggctgggccgctggagcctccgcctgcttcctccagaagacacgaatcatgactcacgattgctgaagcctgagcaggtctctgtgggccgaccagaggggggcttcgaggtggtccctggtactggggtgaccgagtggacagcccagggtgcagctctgcccgggctcgtgaagcctcagatgtccccaatccaagggtctggaggggctgccgtgactccagaggcctgaggctccagggctggctctggtgtttacaagctggactcagggatcctcctggccgccccgcagggggcttggagggctggacggcaagtccgtctagctcacgggcccctccagtggaatgggtcttttcggtggagataaaagttgatttgctctaaaaaaa

SEQ ID NO: 28207 - DNA, 492 bp, Homo sapiens
cctcaggggtttgctgacagcagcaagagtggcggcgggctcgtgctggaggaaatggaagcaactgtcgagattgcagcggaatatgattctcttcctccttgcctttctgcttttctgtggactcctcttctacatcaacttggctgaccattggaaagctctggctttcaggctagaggaagagcagaagatgaggccagaaattgctgggttaaaaccagcaaatccacccgtcttaccagctcctcagaaggcggacaccgaccctgagaacttacctgagatttcgtcacagaagacacaaagacacatccagcggggaccacctcacctgcagattagactggctgctctcagcactgcctgttatcctgacactttccctggacatggtcctgtaaaacggtcatgatcaggccccagtctcctggattcggtcttcctccttcatgattttactctcattttggtgagcaaagaccccaaaag

SEQ ID NO: 28208 - DNA, 687 bp, Homo sapiens
ggcgcgggcgcactggccgcatagagacgcagcgcacgcgcagtcgcgtatccgtgtgatgggcgggctgttgacggcgctgcgatggctgcctgcgagggcaggagaagcggagctctcggttcctctcagtcggacttcctgacgccgccagtgggcggggccccttgggccgtcgccaccactgtagtcatgtacccaccgccgccgccgccgcctcatcgggacttcatctcggtgacgctgagctttggcgagagctatgacaacagcaagagttggcggcggcgctcgtgctggaggaaatggaagcaactgtcgagattgcagcggaatatgattctcttcctccttgcctttctgcttttctgtggactcctcttctacatcaacttggctgaccattggaaagctctggctttcaggctagaggaagagacccggtgtccaaaaaaagtaaaaataaaaataaagttagggagagagattgtaacacttaagttaacagatagtacagattgcacttcattttcatctcccggtctttagggaggaagggccgctgggaaggattgaggaagggagaagcgaaggtgagtggccggagatgagtggagattaccgtaggcccggaggggttgtggggaagggaggatggagaaagaagggccagtttcaaggaggtca

SEQ ID NO: 28209 - DNA, 588 bp, Homo sapiens
ggcgcgggcgcactggccgcatagagacgcagcgcacgcgcagtcgcgtatccgtgtgatgggcgggctgttgacggcgctgcgatggctgcctgcgagggcaggagaagcggagctctcggttcctctcagtcggacttcctgacgccgccagtgggcggggccccttgggccgtcgccaccactgtagtcatgtacccaccgccgccgccgccgcctcatcgggacttcatctcggtgacgctgagctttggcgagagctatgacaacagcaagagttggcggcggcgctcgtgctggaggaaatggaagcaactgtcgagattgcagcggaatatgattctcttcctccttgcctttctgcttttctgtggactcctcttctacatcaacttggctgaccattggaaagctctggctttcaggctagaggaagagcagaagatgaggccagaaattgctgggttaaaaccagcaaatccacccgtcttaccagctcctcagaaggcggacaccgaccctgagaacttacctgagatttcgtcacagaattttgagacccattaaaaaagttaaatgagaaaaaaa

SEQ ID NO: 28210 - DNA, 317 bp, Homo sapiens
gccctttaaaaaaaaaagcctgtgcttaataatgctacaataatgacgttgtgtcacatttcagccacggggctcttaatccaccactgcattcaaatattgtgaaatgtgttacttacgatattgggttagcgggaaaaataatgtcctagcaagaaggaaggagaaatacattttccgttttatcttgtagcctgggacaggccagagaaggcatgtccctggtcataagttagaatgacagttgctctttttgagtcccggctatgcatcaagggcttacacatggggcttacacttactaatgcttgaaacac

SEQ ID NO: 28211 - DNA, 280 bp, Homo sapiens
gccaagtctttgacagaggacttataactagaatataaaaagaattcaccaaatctcaacagttaaacagcaaacaatttaactaggtatgggcaaaaatcacgaacacacattttgctgtagagtgtccaacaatgggcagctacttgtgtcattcactggaccatttatgccccagtgaatagcatcttccaggcaccctcactcacaaggttgcttaacttttttcttttcattgcaagttttccccaaactcttatcagctgaatgtagacactta

SEQ ID NO: 28212 - DNA, 465 bp, Homo sapiens
cctatcttccagtctgttgcttttacctcccattgggggaaaaaaatgcatggtagtctaggaaatggagtttgtagacttccagcccttgcagcatagaggagcatgtggaagggtgggaactgaaccaagcgtctgcaggcaaacaactagcacagcgtacaggcaccagccccagtgtgagggatcccagaggcccacagctaagggatggtcactacagcacttgcctccttgttttctttctttgctggtcatcttggcagagcaatctgaattgtcaggtcccatatggttcatctcagtccagagagtgacagccccaggggaacaggaggaaaagaggagaaggaagaaaaaaaggggtgcttggaaccagggcatctctgaaattggtagccttttttataatggaatcctctggtttacttggtgttataagtaaaatgtttattcagaaacaga

SEQ ID NO: 28213 - DNA, 951 bp, Homo sapiens
atgatgggactcaccgagggggtgttcctgattctgtctggcactcagttcacactgggaattctggtcaattgtttcattgagttggtcaatggtagcagctggttcaagaccaagagaatgtctttgtctgacttcatcatcaccaccctggcactcttgaggatcattctgctgtgtattatcttgactgatagttttttaatagaattctctcccaacacacatgattcagggataataatgcaaattattgatgtttcctggacatttacaaaccatctgagcatttggcttgccacctgtcttggtgtcctctactgcctgaaaatcgccagtttctctcaccccacattcctctggctcaagtggagagtttctagggtgatggtatggatgctgttgggtgcactgctcttatcctgtggtagtaccgcatctctgatcaatgagtttaagctctattctgtctttaggggaattgaggccaccaggaatgtgactgaacacttcagaaagaagaggagtgagtattatctgatccatgttcttgggactctgtggtacctgcctcccttaattgtgtccctggcctcctactctttgctcatcttctccctggggaggcacacacggcagatgctgcaaaatgggacaagctccagagatccaaccactgaggcccacaagagggccatcagaatcatcctttccttcttctttctcttcttactttactttcttgctttcttaattgcatcatttggtaatttcctaccaaaaaccaagatggctaagatgattggcgaagtaatgacaatgttttatcctgctggccactcatttattctcattctggggaacagtaagctgaagcagacatttgtagtgatgctccggtgtgagtctggtcatctgaagcctggatccaagggacccattttctcttag

SEQ ID NO: 28214 - DNA, 619 bp, Homo sapiens
ctggccctgtgtataaggttttaaaatttttacaatcccccaaatgacttcttttcattgaacctgactctttggtaatgaagagtctagctgcagttttaaagccccaaattagtacctatgatttgtgtaaccttgtaggcaagtcaaaatgatggcttaatcaacagccgtgaagctcagatagctttgaataaaatgtgtttatgctaaaggcattcttactgagaagtgagacgcaggctgcttgttgagatgacaggcaaggcagatctgttttggagatgtgtagttacctctattgcaatgttatctcagtgtcccatttttttagcctgcggatccccttaagattattaatgtattctcagttgggcgcagtggctcatgcctataatcccagcactttgggaggtcaaggcagatggatcacttgaggccaggagttcaagaccagcctggccaacatggcaaaaccccgtctctactaaaatacgaaaaaaacatctgggcatagtggtgcatgcctataatgccagctgcttgggcagctgagacacaagaatcaccggaaccctgcaggtggtggagaccaaaattgtgccactgcagtccagcc

SEQ ID NO: 28215 - DNA, 272 bp, Homo sapiens
tgcctacaaggccttacatagattggctttccagtaccactctgccctcattttttgctacagcctcccctgaccattccacacattggctctacccgactctgctttcttaaacctgcgaagcacatcatgcctcagtgcatttgtacttgctgctccttttacctagaaagctttttcctcagatatcctcatgtgtcatagcctcagctcctttaggtctttactcaaatgacacttttcaatgaggctttccttggttattttttcta

SEQ ID NO: 28216 - DNA, 604 bp, Homo sapiens
ctgctctagtgtctgtgacaaaagatattatctggaaacattttaagtatgtgtctcgcgaattggacctctaagaaatattcttactttttggtaaatttttttcagtaaaactattatttatgaagataaataataacatgaatgctcatttccaccactcatttggctttcattatatgttgagacaaaaattttgattaaaggaagcaaagaaacccttggactgttatcattcccctacctacatcccctatagtctacagaatctacatctctggaagagtttccagtcttaacaaagggtttgtgctggggagagggatttatggcgagatgtggttctgctatttattttaagttagaactcttattctgagagttttccatagaaacacagtaagatatgtggttaagttccagagtactgttaatattacaggtatgttcaggcatttgttaattagcctagaaacctaaccactgggtataacgtttccagaggaacatatatcctgaaattcaagtaaccgcttcactagagactgtctttcctaacttgtttactcagcattaaaaaggtaatgattttggcaaaaaaaaa

SEQ ID NO: 28217 - DNA, 263 bp, Homo sapiens
gaaaaactaacatttcgtttgtcaactagcaggcttcatagtggggtgaatgggctttgattgtacttggaaaacaccaccatgaggaatctacagtgcattaagcaattgattcctcttttgagaagcaatagttgtttgtttgtttgttttgagacggagtcttgctctgttgcccaggctggagtgcagtggcgcgatttcgactcactgaaagctccgcctcccggtttcccaccattctcctgcctcagccactcgag

SEQ ID NO: 28218 - DNA, 1749 bp, Homo sapiens
gcggtcttatataagccagatccgcaggggagtccgcagaagggttaaacaggtctttgggcttcggcgacctcgcccgcggcagaaaccggtaagaagacagtgggctgcgcgtctcattttcagccttgcccggactctcccaaagccggcgcccagtagtggctccagagcccacaggtggcccccggcagtctctggggcgcatggagcggcgttaatagggctggcggcgcaggccagtagccgctccaacatgaacctcgtgggcagctacgcacaccatcaccaccatcaccacccgcaccctgcgcaccccatgctccacgaacccttcctcttcggtccggcctcgcgctgtcatcaggaaaggccctacttccagagctggctgctgagcccggctgacgctgccccggacttccctgcgggcgggccgccgcccgcggccgctgcagccgccaccgcctatggtcctgacgccaggcctgggcagagccccgggcggctggaggcgcttggcggccgtcttggccggcggaaaggctcaggacccaagaaggagcggagacgcactgagagcattaacagcgcattcgcggagttgcgcgagtgcatccccaacgtgccggccgacaccaagctctccaagatcaagactctgcgcctagccaccagctacatcgcctacctgatggacgtgctggccaaggatgcacagtctggcgatcccgaggccttcaaggctgaactcaagaaggcggatggcggccgtgagagcaagcggaaaagggagctgcagcagcacgaaggttttcctcctgccctgggcccagtcgagaagaggattaaaggacgcaccggctggccgcagcaagtctgggcgctggagttaaaccagtgagccgaggcccgcgccgaggacctggccaggccagccactcctgaagccccgggaggagaggaaggcagcggcgaacgccaggctctgggctccggcgactggtgctacgcatcccgcggagcttctgctgagcgccggcaggtcgtcggctgcaaccacacacttggatcgcacgtgcaatgtcctttgattttttttaatacattaagagaaagagaaatatatatatatccacccccagcccaaccgagggcggcccttggcggcaacatgcaagaaggagggactgtcgaacccaagggctcaaagacgcactcttccacccttttggagcgaatttagaacctcagccctatctccatttccctatctggctctttctctcttgtccctccatatgatccgccccgacgccgtcttctctaattaaaatgcaataaggaatcaattcttttctgcctgagaaagagaaccagacgcaggaagatgaaaggctgccctttgttcttcgaatcgtggtggttttattttatttttctttttgtcgctgcacttcctgtttagttccaagggaaacactttctctctttctctgtctctctcttttcttccttcttttccttcctttttgtttctatctaaataaaagctttccctgtgttggaaagtttttatgtatttaaactacctaccatgcctgttgtgctcaggtgtttgttcatcctgccatccccaacccttttctacctcaagtctgtgtgaccactcacagcccccctcccttcgccaaagcagtgtctatgctcttgattaataaaacattttctgaaatcaaaaaaaaaaaa

SEQ ID NO: 28219 - DNA, 146 bp, Homo sapiens
ttaaaatcttagaagaaaacctagaaagtactcttcttgacatgaaccttggcaaagaacgtttgactaagtccccaaaagcaattgcaacaaaaacaataattggcaagtgggacctaactaaactaaacagcttctgcacagca

SEQ ID NO: 28220 - DNA, 476 bp, Homo sapiens
gttcaaaatactgtatagtagctaagattgccacattttcattgtgtgtctaaatcttgagtaaacttcaaaatatgtggtaaagttaaaaatacttctattgttccatttactgcaggcagtgggatcaactattctggtgagtataactgtacaggtagattagaatttgtagatttgtctgaagtttttcttctaaaaccgtttcttcatccatgctagtctttatttgggaggtttcttggcaagctctactgaatctaatgaattaaaatattaattgattttttcccttcccctcctaaaacatctctaaagcagaaaaactcaatattgatcaggtgatttacagaatgaagcttgaaaaaaacgaattatgtggttggaagtaattgtttacataacataattaatgtcagcactaagctttaagttggcaggggatttttttcttcttcttgttagtaacactccat

SEQ ID NO: 28221 - DNA, 5163 bp, Homo sapiens
  misc_feature (2761)..(2761): n is a, c, g, or t
agctggtctcctgcttgacaccataaagaggccagcattgcagggtctatgtctttgtcttgacttccagtttgatactgtggttaaagacagacccacaattttgagcaagcttttactcttgcactttcttaagcaggatattcctgctctgagctgggagttctttgtcaatagatttgagacgctttctttggaagcccagctacatttggattgtaacaaggaatttccttttcctacaaccatcactgctgtgaggaccaatgttgctaacctcagcgatgcagccttatggaagatcaagagagctcgctttgcaagaaaccgccagaagagtgtacgttccctgagggacagcgtgaaagggcctgtggaatccaagagggcgctctccctccctgagaccctgacctccaaaattcctatgaggttgaccaggcatgagcagtctgctccagctctcggtgggacacccgaacagacgccaggacaacaatctcctgagaatgacaacaccatcaaggacctgctcccagaagacgctgggatcgaccaccagacagttcaccagctgattacagtgctcatgaagttcatggccaaggatgaaagcagcgctgagtcagacatcagcagtgcaaaggccttcaacacggtcaagcgacacctgtacgtcttactcggctatgaccagcaggaaggttgcttcatgattgcacctcaaaaaatgcgcctgtcaacttgctttaatgcattcattgcaggaattgcccaagttatggactataacattaacttgggaaaacaccttctccccttagtggttcaggtgctcaaatactgctcttgtcctcaactccggcattatttccaacagccgcctcgttgctccctctggtccctaaagcctcacatccggcagatgtggttgaaggccttgcttgtcatcctttacaagtatccataccgagactgtgatatcagcaagatcctgctgcatctgattcacataacagtcaatacactcaatgcgcagtatcatagctgcaagccccatgccacggcaggacctttgtacagtgacaacagtaacataagcagatacagcgaaaaagaaaaagaagaagatagtgtttttgatgaatctgatattcatgatacacctactggaccctgcaataaagagtctcaaactttttttgcaagattgaaaagaataggcggcagcaaaatggtgaaatatcagccggttgagatgaatgttcagagaagtgaaatagaactggctgaatatagagagacgggtgcattacaagacagccttctccactgtgtgagagaagaaagcattccgaaaaaaaagctacgctctttcaaacaaaaatctcttgatatagggaatgcagactcgcttttgtttacattagacgaacatcgtaggaagtcgtgcatagatcggtgtgacatagagaagcctccgacccaagctgcgtatatcgcacaaagaccaaacgaccctggacgttctagacagaactctgctacgaggcctgacaatagtgaaatccccgagaacccagctatggaagggtttccagatgctcgaaggcctgtcataccagaggttaggttaaactgtatggagactttcgaggtgaaagttgactcgccggtaaagcctgctcctaaagaggatttagatctgatagatctatcctcagattcaacctcggggcctgaaaaacactctatactctcaacctccgacagcgactctcttgtatttgagcctcttccccctctcagaatagtcgagagtgacgaagaagaggagacgatgaaccaaggcgatgacggcccctccggtaaaaatgctgcctcttctccctccatccccagccatccctccgtcctcagcctgagcacagctccgcttgtacaagtaagtgtggaggattgttccaaagacttttcttctaaggactcaggaaataatcagtcagcagggaacactgactctgccctcatcactctggaagaccctatggacgccgaaggatcctcaaagccagaggagctgccagagttctcctgcggtagcccactgacgctgaagcaaaaacgagacctccttcagaagtcgtttgctctccccgagatgtcgctggatgatcaccctgacccgggcactgagggggagaagcctggggagctgatgccaagttcaggggcaaaaaccgtcctcctcaaagttcccgaagatgcagagaaccccacagaaagtgagaagcctgataccagtgcagaatctgatacagaacagaatcctgaaaggaaggtggaagaggatggagctgaggaatccgaatttaagattcagattgttcccaggcagaggaagcagaggaagattgctgtcagtgctatccagagagagtacctcgacatctccttcaacattctggacaaactgggagaacagaaagatccagatccttctactaaaggactttcaactttggaaatgccacgagaatcttcatctgcccctacgttagatgcaggtgtgccggaaacaagtagccattcctcaatatcaactcagtataggcagatgaaaaggggatccctgggagttctgacaatgagccagttaatgaagcggcagctggagcatcagtctagcgccccccataacatcagcaactgggacactgaacagatacagcctgggaaacgccagtgtaacgtgccaacntgcctaaaccctgacctggagggacagccattgaggatgagaggtgccaccaaatccagcctgctatcagcaccaagcatagtcagtatgtttgtgcctgcacctgaagagttcactgacgagcagccgacggtgatgacggacaaatgccatgactgtggggccattcttgaagaatacgatgaagagacacttgggctagccatcgtggtcctctccacattcattcacttaagcccagacctggcagccccgctgctgctggatatcatgcagtctgtgggaagattggcatccagtactaccttttctaatcaagcagaaagcatgatggttcccggcaatgcggcgggggtggccaagcagttcctgcgctgcatcttccatcagttggcccccaacggcatcttcccgcagctgttccaaagcacgatcaaagatgggacttttttacggaccttagcctcgtctctgatggacttcaatgagctgagctccatcgcagctctcagtcagctcctagagggtctaaataacaaaaagaatttaccagcagggggtgctatgattcgctgtttggaaaacattgcaaccttcatggaagctttgcctatggattctcctagtagcctctggaccacaattagcaaccagtttcagacattttttgccaagctgccttgtgttttacctctgaagtgttctttagattccagtttaagaattatgatttgcctcttgaagatcccttctaccaatgctacaaggagtttgttggaaccattttcaaaactgctcagctttgtaattcagaatgccgtcttcactctggcctacctggtggagctgtgtggcttatgttaccgagctttcactaaggaacgagataaattctacttgtctcgtagtgttgttctagaacttctgcaggccctaaagctcaaatctcctttaccagatacaaaccttcttctgcttgttcagtttatttgtgcagatgctggaaccaaactagctgagtcaacaatcctgagcaagcagatgatagcctctgtacctggatgtgggactgcagcgatggagtgtgtgaggcagtacatcaacgaagtgcttggatttcatggcagacatgcacacgctgaccaaactgaagagccacatgaagacatgttcccagcctctgcatgaagatacctttgggggacatctcaaagtggggctggcccagattgcagccatggacatctcacggggcaaccacagagataacaaagctgtgatccgctatctgccttggctttatcatcccccctctgcaatgcagcaaggacctaaagaattcattgagtgtgtctcccatatccgactgttgtcctggctgctgctgggttccctcactcacaatgcagtgtgcccaaatgcctcctctccctgcctgcccattcctctggatgcaggctcccacgttgcagaccatcttattgttatcctgattggatttccagagcaatcaaagacctccgtgctgcacatgtgctccctcttccacgcgttcatctttgctcagctgtggacagtttattgcgagcaaagtgccgtcgctacaaatctccaaaatcagaatgaattcagcttcacggcgatactgacagcactagaattttggagtagggtgacacccagcatccttcagctaatggcccataacaaagtgatggtagaaatggtgtgtctccatgtgattagtttaatggaggcattgcaggaatgcaattcgaccatttttgtcaagctgatacctatgtggttgccaatgattcagtcaaatatcaagcacttatctgcgggactccagcttcgcctccaggctattcagaaccacgtgaaccaccacagcctaaggacgctgccgggctcgggccagagcagtgctggcctggcagccctccgaaagtggttgcagtgcactcagttcaaaatggcccaggtggagatcccagtcctcggaagcagcctctcaattttatcctctatgagtggactcctcggcgctcagtgtcaacactctggtttagcaataatgggtttaaaaacaaacaatttgatccaagcaggttggggaacatattggtactgtacattctctttctagtttagtaaaagatgtgcaaaggccagagagggccgaaaatgaagctttcttgctacacatatttctgatgactccttgggctatctgattaagtgtttccttacattattttttaaaaaccaaatcatttttctttaactaacttctattttttttaagaaaaaaaaatagactggtgggtactcacagaaaagttgtataagtccccctgttgctatttttgatgatagagaataaatagggtttttga

SEQ ID NO: 28222 - DNA, 482 bp, Homo sapiens
  misc_feature (107)..(107): n is a, c, g, or t
agagagagagagagagagagagagagagagagagagagagagagagagagagagagagagagagagagagagagagagagagagagagagagagagagagagctganatggaatctcaaagtgtccacaccactcctaatcctcacactccctgttttcacagatctcagttgtaaggttatataaatggatcggggatatgttaccttataagctggatgttctgcttgcataagcattttgattaaaaataagcattttgattaaaaacaaaataatagttcaagagatctattgtacgccgtggtgactacagttaataacaatatattctatacttgaaaattgctacgaggagatttcaaatgttctcaccataaaaaataagtacgtaaggcaatgtacatgttaaatagcttgatttagccattccacaatgtatatctatctcaaaacttttatattgatatatgaatattaaa

SEQ ID NO: 28223 - DNA, 5230 bp, Homo sapiens
  misc_feature (2761)..(2761): n is a, c, g, or t
agctggtctcctgcttgacaccataaagaggccagcattgcagggtctatgtctttgtcttgacttccagtttgatactgtggttaaagacagacccacaattttgagcaagcttttactcttgcactttcttaagcaggatattcctgctctgagctgggagttctttgtcaatagatttgagacgctttctttggaagcccagctacatttggattgtaacaaggaatttccttttcctacaaccatcactgctgtgaggaccaatgttgctaacctcagcgatgcagccttatggaagatcaagagagctcgctttgcaagaaaccgccagaagagtgtacgttccctgagggacagcgtgaaagggcctgtggaatccaagagggcgctctccctccctgagaccctgacctccaaaattcctatgaggttgaccaggcatgagcagtctgctccagctctcggtgggacacccgaacagacgccaggacaacaatctcctgagaatgacaacaccatcaaggacctgctcccagaagacgctgggatcgaccaccagacagttcaccagctgattacagtgctcatgaagttcatggccaaggatgaaagcagcgctgagtcagacatcagcagtgcaaaggccttcaacacggtcaagcgacacctgtacgtcttactcggctatgaccagcaggaaggttgcttcatgattgcacctcaaaaaatgcgcctgtcaacttgctttaatgcattcattgcaggaattgcccaagttatggactataacattaacttgggaaaacaccttctccccttagtggttcaggtgctcaaatactgctcttgtcctcaactccggcattatttccaacagccgcctcgttgctccctctggtccctaaagcctcacatccggcagatgtggttgaaggccttgcttgtcatcctttacaagtatccataccgagactgtgatatcagcaagatcctgctgcatctgattcacataacagtcaatacactcaatgcgcagtatcatagctgcaagccccatgccacggcaggacctttgtacagtgacaacagtaacataagcagatacagcgaaaaagaaaaagaagaagatagtgtttttgatgaatctgatattcatgatacacctactggaccctgcaataaagagtctcaaactttttttgcaagattgaaaagaataggcggcagcaaaatggtgaaatatcagccggttgagatgaatgttcagagaagtgaaatagaactggctgaatatagagagacgggtgcattacaagacagccttctccactgtgtgagagaagaaagcattccgaaaaaaaagctacgctctttcaaacaaaaatctcttgatatagggaatgcagactcgcttttgtttacattagacgaacatcgtaggaagtcgtgcatagatcggtgtgacatagagaagcctccgacccaagctgcgtatatcgcacaaagaccaaacgaccctggacgttctagacagaactctgctacgaggcctgacaatagtgaaatccccgagaacccagctatggaagggtttccagatgctcgaaggcctgtcataccagaggttaggttaaactgtatggagactttcgaggtgaaagttgactcgccggtaaagcctgctcctaaagaggatttagatctgatagatctatcctcagattcaacctcggggcctgaaaaacactctatactctcaacctccgacagcgactctcttgtatttgagcctcttccccctctcagaatagtcgagagtgacgaagaagaggagacgatgaaccaaggcgatgacggcccctccggtaaaaatgctgcctcttctccctccatccccagccatccctccgtcctcagcctgagcacagctccgcttgtacaagtaagtgtggaggattgttccaaagacttttcttctaaggactcaggaaataatcagtcagcagggaacactgactctgccctcatcactctggaagaccctatggacgccgaaggatcctcaaagccagaggagctgccagagttctcctgcggtagcccactgacgctgaagcaaaaacgagacctccttcagaagtcgtttgctctccccgagatgtcgctggatgatcaccctgacccgggcactgagggggagaagcctggggagctgatgccaagttcaggggcaaaaaccgtcctcctcaaagttcccgaagatgcagagaaccccacagaaagtgagaagcctgataccagtgcagaatctgatacagaacagaatcctgaaaggaaggtggaagaggatggagctgaggaatccgaatttaagattcagattgttcccaggcagaggaagcagaggaagattgctgtcagtgctatccagagagagtacctcgacatctccttcaacattctggacaaactgggagaacagaaagatccagatccttctactaaaggactttcaactttggaaatgccacgagaatcttcatctgcccctacgttagatgcaggtgtgccggaaacaagtagccattcctcaatatcaactcagtataggcagatgaaaaggggatccctgggagttctgacaatgagccagttaatgaagcggcagctggagcatcagtctagcgccccccataacatcagcaactgggacactgaacagatacagcctgggaaacgccagtgtaacgtgccaacntgcctaaaccctgacctggagggacagccattgaggatgagaggtgccaccaaatccagcctgctatcagcaccaagcatagtcagtatgtttgtgcctgcacctgaagagttcactgacgagcagccgacggtgatgacggacaaatgccatgactgtggggccattcttgaagaatacgatgaagagacacttgggctagccatcgtggtcctctccacattcattcacttaagcccagacctggcagccccgctgctgctggatatcatgcagtctgtgggaagattggcatccagtactaccttttctaatcaagcagaaagcatgatggttcccggcaatgcggcgggggtggccaagcagttcctgcgctgcatcttccatcagttggcccccaacggcatcttcccgcagctgttccaaagcacgatcaaagatgggacttttttacggaccttagcctcgtctctgatggacttcaatgagctgagctccatcgcagctctcagtcagctcctagagggtctaaataacaaaaagaatttaccagcagggggtgctatgattcgctgtttggaaaacattgcaaccttcatggaagctttgcctatggattctcctagtagcctctggaccacaattagcaaccagtttcagacattttttgccaagctgccttgtgttttacctctgaagtgttctttagattccagtttaagaattatgatttgcctcttgaagatcccttctaccaatgctacaaggagtttgttggaaccattttcaaaactgctcagctttgtaattcagaatgccgtcttcactctggcctacctggtggagctgtgtggcttatgttaccgagctttcactaaggaacgagataaattctacttgtctcgtagtgttgttctagaacttctgcaggccctaaagctcaaatctcctttaccagatacaaaccttcttctgcttgttcagtttatttgtgcagatgctggaaccaaactagctgagtcaacaatcctgagcaagcagatgatagcctctgtacctggatgtgggactgcagcgatggagtgtgtgaggcagtacatcaacgaagtgcttggatttcatggcagacatgcacacgctgaccaaactgaagagccacatgaagacatgttcccagcctctgcatgaagatacctttgggggacatctcaaagtggggctggcccagattgcagccatggacatctcacggggcaaccacagagataacaaagctgtgatccgctatctgccttggctttatcatcccccctctgcaatgcagcaaggacctaaagaattcattgagtgtgtctcccatatccgactgttgtcctggctgctgctgggttccctcactcacaatgcagtgtgcccaaatgcctcctctccctgcctgcccattcctctggatgcaggctcccacgttgcagaccatcttattgttatcctgattggatttccagagcaatcaaagacctccgtgctgcacatgtgctccctcttccacgcgttcatctttgctcagctgtggacagtttattgcgagcaaagtgccgtcgctacaaatctccaaaatcagaatgaattcagcttcacggcgatactgacagcactagaattttggagtagggtgacacccagcatccttcagctaatggcccataacaaagtgatggtagaaatggtgtgtctccatgtgattagtttaatggaggcattgcaggaatgcaattcgaccatttttgtcaagctgatacctatgtggttgccaatgattcagtcaaatatcaagcacttatctgcgggactccagcttcgcctccaggctattcagaaccacgtgaaccaccacagcctaaggacgctgccgggctcgggccagagcagtgctggcctggcagccctccgaaagtggttgcagtgcactcagttcaaaatggcccaggtggagatcccagtcctcggaagcagcctctcaattttatcctctatgagtggactcctcggcgctcagtgtcaacactctggtttagcaataatgggtttaaaaacaaacaatttgatccaagcaggttggggaacatattggtactgtacattctctttctagtttagtaaaagatgtgcaaaggccagagagggccgaaaatgaagctttcttgctacacatatttctgatgactccttgggctatctgattaagtgtttccttacattattttttaaaaaccaaatcatttttctttaactaacttctattttttttaagaaaaaaaaatagactggtgggtactcacagaaaagttgtataagtccccctgttgctatttttgatgatagagaataaatagggtttttgaaacctttgtagtgttttttcttaaaatccactcttggcaatgcaataaaaaaaaccgtcaccataag

SEQ ID NO: 28224 - DNA, 4880 bp, Homo sapiens
  misc_feature (2761)..(2761): n is a, c, g, or t
agctggtctcctgcttgacaccataaagaggccagcattgcagggtctatgtctttgtcttgacttccagtttgatactgtggttaaagacagacccacaattttgagcaagcttttactcttgcactttcttaagcaggatattcctgctctgagctgggagttctttgtcaatagatttgagacgctttctttggaagcccagctacatttggattgtaacaaggaatttccttttcctacaaccatcactgctgtgaggaccaatgttgctaacctcagcgatgcagccttatggaagatcaagagagctcgctttgcaagaaaccgccagaagagtgtacgttccctgagggacagcgtgaaagggcctgtggaatccaagagggcgctctccctccctgagaccctgacctccaaaattcctatgaggttgaccaggcatgagcagtctgctccagctctcggtgggacacccgaacagacgccaggacaacaatctcctgagaatgacaacaccatcaaggacctgctcccagaagacgctgggatcgaccaccagacagttcaccagctgattacagtgctcatgaagttcatggccaaggatgaaagcagcgctgagtcagacatcagcagtgcaaaggccttcaacacggtcaagcgacacctgtacgtcttactcggctatgaccagcaggaaggttgcttcatgattgcacctcaaaaaatgcgcctgtcaacttgctttaatgcattcattgcaggaattgcccaagttatggactataacattaacttgggaaaacaccttctccccttagtggttcaggtgctcaaatactgctcttgtcctcaactccggcattatttccaacagccgcctcgttgctccctctggtccctaaagcctcacatccggcagatgtggttgaaggccttgcttgtcatcctttacaagtatccataccgagactgtgatatcagcaagatcctgctgcatctgattcacataacagtcaatacactcaatgcgcagtatcatagctgcaagccccatgccacggcaggacctttgtacagtgacaacagtaacataagcagatacagcgaaaaagaaaaagaagaagatagtgtttttgatgaatctgatattcatgatacacctactggaccctgcaataaagagtctcaaactttttttgcaagattgaaaagaataggcggcagcaaaatggtgaaatatcagccggttgagatgaatgttcagagaagtgaaatagaactggctgaatatagagagacgggtgcattacaagacagccttctccactgtgtgagagaagaaagcattccgaaaaaaaagctacgctctttcaaacaaaaatctcttgatatagggaatgcagactcgcttttgtttacattagacgaacatcgtaggaagtcgtgcatagatcggtgtgacatagagaagcctccgacccaagctgcgtatatcgcacaaagaccaaacgaccctggacgttctagacagaactctgctacgaggcctgacaatagtgaaatccccgagaacccagctatggaagggtttccagatgctcgaaggcctgtcataccagaggttaggttaaactgtatggagactttcgaggtgaaagttgactcgccggtaaagcctgctcctaaagaggatttagatctgatagatctatcctcagattcaacctcggggcctgaaaaacactctatactctcaacctccgacagcgactctcttgtatttgagcctcttccccctctcagaatagtcgagagtgacgaagaagaggagacgatgaaccaaggcgatgacggcccctccggtaaaaatgctgcctcttctccctccatccccagccatccctccgtcctcagcctgagcacagctccgcttgtacaagtaagtgtggaggattgttccaaagacttttcttctaaggactcaggaaataatcagtcagcagggaacactgactctgccctcatcactctggaagaccctatggacgccgaaggatcctcaaagccagaggagctgccagagttctcctgcggtagcccactgacgctgaagcaaaaacgagacctccttcagaagtcgtttgctctccccgagatgtcgctggatgatcaccctgacccgggcactgagggggagaagcctggggagctgatgccaagttcaggggcaaaaaccgtcctcctcaaagttcccgaagatgcagagaaccccacagaaagtgagaagcctgataccagtgcagaatctgatacagaacagaatcctgaaaggaaggtggaagaggatggagctgaggaatccgaatttaagattcagattgttcccaggcagaggaagcagaggaagattgctgtcagtgctatccagagagagtacctcgacatctccttcaacattctggacaaactgggagaacagaaagatccagatccttctactaaaggactttcaactttggaaatgccacgagaatcttcatctgcccctacgttagatgcaggtgtgccggaaacaagtagccattcctcaatatcaactcagtataggcagatgaaaaggggatccctgggagttctgacaatgagccagttaatgaagcggcagctggagcatcagtctagcgccccccataacatcagcaactgggacactgaacagatacagcctgggaaacgccagtgtaacgtgccaacntgcctaaaccctgacctggagggacagccattgaggatgagaggtgccaccaaatccagcctgctatcagcaccaagcatagtcagtatgtttgtgcctgcacctgaagagttcactgacgagcagccgacggtgatgacggacaaatgccatgactgtggggccattcttgaagaatacgatgaagagacacttgggctagccatcgtggtcctctccacattcattcacttaagcccagacctggcagccccgctgctgctggatatcatgcagtctgtgggaagattggcatccagtactaccttttctaatcaagcagaaagcatgatggttcccggcaatgcggcgggggtggccaagcagttcctgcgctgcatcttccatcagttggcccccaacggcatcttcccgcagctgttccaaagcacgatcaaagatgggacttttttacggaccttagcctcgtctctgatggacttcaatgagctgagctccatcgcagctctcagtcagctcctagagggtctaaataacaaaaagaatttaccagcagggggtgctatgattcgctgtttggaaaacattgcaaccttcatggaagctttgcctatggattctcctagtagcctctggaccacaattagcaaccagtttcagacattttttgccaagctgccttgtgttttacctctgaagtgttctttagattccagtttaagaattatgatttgcctcttgaagatcccttctaccaatgctacaaggagtttgttggaaccattttcaaaactgctcagctttgtaattcagaatgccgtcttcactctggcctacctggtggagctgtgtggcttatgttaccgagctttcactaaggaacgagataaattctacttgtctcgtagtgttgttctagaacttctgcaggccctaaagctcaaatctcctttaccagatacaaaccttcttctgcttgttcagtttatttgtgcagatgctggaaccaaactagctgagtcaacaatcctgagcaagcagatgatagcctctgtacctggatgtgggactgcagcgatggagtgtgtgaggcagtacatcaacgaagtgcttggatttcatggcagacatgcacacgctgaccaaactgaagagccacatgaagacatgttcccagcctctgcatgaagatacctttgggggacatctcaaagtggggctggcccagattgcagccatggacatctcacggggcaaccacagagataacaaagctgtgatccgctatctgccttggctttatcatcccccctctgcaatgcagcaaggacctaaagaattcattgagtgtgtctcccatatccgactgttgtcctggctgctgctgggttccctcactcacaatgcagtgtgcccaaatgcctcctctccctgcctgcccattcctctggatgcaggctcccacgttgcagaccatcttattgttatcctgattggatttccagagcaatcaaagacctccgtgctgcacatgtgctccctcttccacgcgttcatctttgctcagctgtggacagtttattgcgagcaaagtgccgtcgctacaaatctccaaaatcagaatgaattcagcttcacggcgatactgacagcactagaattttggagtagggtgacacccagcatccttcagctaatggcccataacaaagtggtgagttcacagacgagtttcccttctgagatggaatctcaaagtgtccacaccactcctaatcctcacactccctgttttcacagatctcagttgtaaggttatataaatggatcggggatatgttaccttataagctggatgttctgcttgcataagcattttgattaaaaataagcattttgattaaaaacaaaataatagttcaagagatctattgtacgccgtggtgactacagttaataacaatatattctatacttgaaaattgctacgaggagatttcaaatgttctcaccataaaaaataagtacgtaaggcaatgtacatgttaaatagcttgatttagccattccacaatgtatatctatctcaaaacttttatattgatatatgaatattaaa

SEQ ID NO: 28225 - DNA, 320 bp, Homo sapiens
agattgcagccatggacatctcacggggcaaccacagagataacaaagctgtgatccgctatctgccttggctttatcatcccccctctgcaatgcagcaagggtaagacccttactattccgggaatgagggtaaagaaggcaggagacacccctgagtttcctcgggctcagctagagttaaggagtacaccgaagatttatgacagtggaatatacttggttaggaagatggaaatcagatcccatctccttacgtacttgctgacccagaatgctctttgacatgctgccaaaaaataaacctgtcctcccacaaa

SEQ ID NO: 28226 - DNA, 172 bp, Homo sapiens
aatgtgggcacaagtgtccccccgaaacagaccagtggcagctgtaagataaaaccctcatgaggctaggcatggtggctcatgcctacaatttcaatattttgggaggccagcgcaggaggatcacttgagcccaggagtttgaggccagcctgcacaacatagcaagacc

SEQ ID NO: 28227 - DNA, 273 bp, Homo sapiens
tagaagccaaaccaaactgacaataatgcttgaaaaattaggaatggattatgatgggcggcctcactgtggtcttgatgactctaagaatatcgcccgaatagcagttcgaatgcttcaggatgggtgtgaactccgaatcaacgagaaaatgcatgcaggacagctaatgagtgtgtcctcttccttaccaatagagggcactccaccaccacaaatgccacattttagaaagtaacagttttgtgtgtggatcattccaattgaagttgc

SEQ ID NO: 28228 - DNA, 619 bp, Homo sapiens
ttcaactctttttaatccaacagttttaaaagcagcctaggcaagattaccagaacctctgccttttattttctgttcttctctctcgctcttgcccttgtctgactcagagtcagtgggcgaggagagtactattaaaggtaaagggcttatatggtacttgaaacactcactttcctgactaccaaatgtatagaattgagaagacttgggcattatttattctaaagatacagagaaactaaggtcatagtttcaatttgatttaaaaaggggtttaagcaattgtgtattagtaatttattactgagtaacaaattacctcaaaacttagtggcttaaaacaataaacatttgtcatctcacagtgtttgtgattaggactagagagcatcttatctgggtggttctggctcagggcctctcctgaggctcctgctatctgaaggcctgactgcggtggaggagctgcctcccaggaggctcacctacgtgcttggcaagttagtgctgtttgttgcccagaagcctcagctctttgctacatggacctttctccatgtgactgctttagtgtcttcaccttagagcacgtgatccaagagagaacaaggaggag

SEQ ID NO: 28229 - DNA, 1117 bp, Homo sapiens
aaagaatatacacagcaacattttttgtaaaagcaaaaagtctaggctgggcgtagactcatgcctgtaatcccagcactttgggaggctgaggcaggcggatcacgaagtcaggagttcgagaccagcctggccaacatagtgaaaccccatctctactaaaaatacaaaaattagtcgggcatggtggtgggcgcctttagtcccagctactcgggaggcggaggttgtggtgagccaagatcatgccactgcactccagcctgggcaacgagcgaaactccatccccccaaaaaaaaaaaaagaaaaaaagaaaacaaaaaaaggaaaaagtctagaaccaacccaaagacccagccagtgagaatgggtgaagtatgatataaccacactgtgtaatgttattcagcagtgaaaatctatgaaccacagtgacctacagtgtggagttctcttcttcatataatgctgagagaagacaatatatatcatgatgtactatgaataaagttcataaacaacaaaaacattcactattgtttaggcaatttataaaatttttaagctaattttaattacatattttactgccagaaaacctagtttttaaagacaaggaaattataaacccagagattcttatcgcaagggaagagaagggtacacggtcggatgagcccattcagcattctggctgccggggtggctgctagtcccagatgtcactaagtcattaccatttatttactttttaagcatgaaattaaactttaaaaaaataaatatttaaattcaggagcacaactcccgcttgaaaagaaagctgtggtgaatcatttaaaaccaagatttgtcccagatggactggtttcacaggtgactattatacattgaaatggcaagatgggacatgagacattttctgtcaaacccctgaggcctttgtcctgtcggcctgaaccactggaattaagtcccacagcgtcttctgggagccctggggtggtttcaagcccgccctgctgcttcacagacacagccaggcactgagccccaggcccactgccctgccccgactccaaggatatccagccctggtctctggcctttccaacc

SEQ ID NO: 28230 - DNA, 857 bp, Homo sapiens
agaggagatcccccagcttggttgccccccccaaaaaaaaaaaaagaaaaaaagaaaacaaaaaaaggaaaaagtctagaaccaacccaaagacccagccagtgagaatgggtgaagtatgatataaccacactgtgtaatgttattcagcagtgaaaatctatgaaccacagtgacctacagtgtggagttctcttcttcatataatgctgagagaagacaatatatatcatgatgtactatgaataaagttcataaacaacaaaaacattcactattgtttaggcaatttataaaatttttaagctaattttaattacatattttactgccagaaaacctagtttttaaagacaaggaaattataaacccagagattcttatcgcaagggaagagaagggtacacggtcggatgagcccattcagcattctggctgccggggtggctgctagtcccagatgtcactaagtcattaccatttatttactttttaagcatgaaattaaactttaaaaaaataaatatttaaattcaggagcacaactcccgcttgaaaagaaagctgtggtgaatcatttaaaaccaagatttgtcccagatggactggtttcacaggtgactattatacattgaaatggcaagatgggacatgagacattttctgtcaaacccctgaggcctttgtcctgtcggcctgaaccactggaattaagtcccacagcgtcttctgggagccctggggtggtttcaagcccgccctgctgcttcacagacacagccaggcactgagccccaggcccactgccctgccccgactccaaggatatccagccctggtctctggcctttccaacc

SEQ ID NO: 28231 - DNA, 1060 bp, Homo sapiens
aacaagtgaattcaactagatcccaggatacagggtcagtatatagaacctgttgtagcagtgaacactttgaaatgaaagtgttacattaatagcatcaaaaacatgataaatttttaaatgcgtaaaaggaactataaacataaatgtaaaagctaaaactataaactttttttttttttttgagacagagtctcacttccagcctgggcaacgagcgaaactccatccccccaaaaaaaaaaaaagaaaaaaagaaaacaaaaaaaggaaaaagtctagaaccaacccaaagacccagccagtgagaatgggtgaagtatgatataaccacactgtgtaatgttattcagcagtgaaaatctatgaaccacagtgacctacagtgtggagttctcttcttcatataatgctgagagaagacaatatatatcatgatgtactatgaataaagttcataaacaacaaaaacattcactattgtttaggcaatttataaaatttttaagctaattttaattacatattttactgccagaaaacctagtttttaaagacaaggaaattataaacccagagattcttatcgcaagggaagagaagggtacacggtcggatgagcccattcagcattctggctgccggggtggctgctagtcccagatgtcactaagtcattaccatttatttactttttaagcatgaaattaaactttaaaaaaataaatatttaaattcaggagcacaactcccgcttgaaaagaaagctgtggtgaatcatttaaaaccaagatttgtcccagatggactggtttcacaggtgactattatacattgaaatggcaagatgggacatgagacattttctgtcaaacccctgaggcctttgtcctgtcggcctgaaccactggaattaagtcccacagcgtcttctgggagccctggggtggtttcaagcccgccctgctgcttcacagacacagccaggcactgagccccaggcccactgccctgccccgactccaaggatatccagccctggtctctggcctttccaacc

SEQ ID NO: 28232 - DNA, 2215 bp, Homo sapiens
aacaagtgaattcaactagatcccaggatacagggtcagtatatagaacctgttgtagcagtgaacactttgaaatgaaagtgttacattaatagcatcaaaaacatgataaatttttaaatgcgtaaaaggaactataaacataaatgtaaaagctaaaactataaactttttttttttttttgagacagagtctcactcttgcccaggctggagtgcagtggcacaatctcggctcactgcaacctccgcctccctggttcaagcgattctcctgcctcagtctcccaagtagctgggattacaggcactcaccaccatacccagctaatttttgtattcctaatagagacggggtttcaccatgttggccaggctggtcttgaactcctgacctctggtgatccacccgccttgggctcccaaagtgctggattacaggcgcgagccaccatgcccgtccctaactataaacttctaaaagaaagaaatacaaaagcatatgagaaaatattcatgagagctggaatacaatggttttgtacttggaaaaatattatattggttctctatttttcatacactggaattaaatccaggtggattaaagacctaaatgtttctttaaaaaaaaactatacagggccgggcacatggctcatgcctataatcccagcactttgggaggccaagacaggagttttgtttgagcccagcctgtgcagcatagagagacccccaactctacaaaaattaactaaaattaaccaggcgtagtggcatgcacctgtagtcccagctactcaggaggctagggtgggaagatcacttgaaaccggagttcaaagctgcagtgaactgtgattgcgccgctgcattccagcttgggggacagggtgagaccctgtctcaaaaaaaaacaaccaaaaaaaactatataattttgtgtggaaaatataggtaaatatatttttgactttggggtagtgaaagactccttaagccacaaaaagaatttaaaaagaaatgatgaacatacttgaccatatgaaaattagaacctaaatccataaaccttaagaaagtgaaatctaaactacaaactgggagaagagataaatagtctcaagactacatgaagaactctgataaatcaatgagaaaacaacctaataggaaaatagaaaaaaaaacatgcataggcatttcatggaagaagagatacaaaaggccaacatagtgaaaccccatctctactaaaaatacaaaaattagtcgggcatggtggtgggcgcctttagtcccagctactcgggaggcggaggttgtggtgagccaagatcatgccactgcactccagcctgggcaacgagcgaaactccatccccccaaaaaaaaaaaaagaaaaaaagaaaacaaaaaaaggaaaaagtctagaaccaacccaaagacccagccagtgagaatgggtgaagtatgatataaccacactgtgtaatgttattcagcagtgaaaatctatgaaccacagtgacctacagtgtggagttctcttcttcatataatgctgagagaagacaatatatatcatgatgtactatgaataaagttcataaacaacaaaaacattcactattgtttaggcaatttataaaatttttaagctaattttaattacatattttactgccagaaaacctagtttttaaagacaaggaaattataaacccagagattcttatcgcaagggaagagaagggtacacggtcggatgagcccattcagcattctggctgccggggtggctgctagtcccagatgtcactaagtcattaccatttatttactttttaagcatgaaattaaactttaaaaaaataaatatttaaattcaggagcacaactcccgcttgaaaagaaagctgtggtgaatcatttaaaaccaagatttgtcccagatggactggtttcacaggtgactattatacattgaaatggcaagatgggacatgagacattttctgtcaaacccctgaggcctttgtcctgtcggcctgaaccactggaattaagtcccacagcgtcttctgggagccctggggtggtttcaagcccgccctgctgcttcacagacacagccaggcactgagccccaggcccactgccctgccccgactccaaggatatccagccctggtctctggcctttccaacc

SEQ ID NO: 28233 - DNA, 257 bp, Homo sapiens
ttaattattttgtgcccattaaccattgccacttcccaatcatttttattgattgattagttgattgattgagatgggagtcttgccgtgtggcacaggctggtcttgagctcctggcctcaagtgaccctcccacttcagcctcctgagtaactgggactgattacaggtgcaaaatactacgcccatctaattaaatttttttttttggagagacaaggtctcactaggttgcccagctggtcttgcactcctag

SEQ ID NO: 28234 - DNA, 942 bp, Homo sapiens
atggaggggaaaaatctgaccagcatctcagaatgtttcctcctggggttctctgagcagctggaggagcagaagcccctctttgggtccttcctgttcatgtacttggtcacggtggcaggcaacctcctcatcattctagtcatcattactgacactcaactccatacccccatgtacttctttctagccaacctctcccttgcagatgcctgctttgtgtccaccacagtccctaagatgctggcaaacatacagatccagagtcaggccatctcctactcagggtgtctactacagttgtattttttcatgttatttgtgatgctggaggcattcctcttggcggtcatggcctatgactgctacgtggccatatgccacccacttcattacattctgatcatgagccctgggctctgcatcttcctcgtgtctgcatcctggatcatgaatgccctccactcccttctacacacacttctgatgaacagcctgtccttctgcgcaaaccatgagatcccacacttcttctgtgacatcaatcccctcctgagtctgtcctgcacagaccccttcaccaatgagctggtgatcttcatcactgggggtctcacaggactcatttgtgtgctttgcctgattatctcttacacgaacgttttctcgaccatcctgaagatcccatcagctcaggggaagcggaaagccttttccacctgcagctctcatctctccgtggtctctctcttctttgggacttctttttgtgttgatttcagttctccctcaacccactcggcccagaaggacacagttgcatcagtgatgtacacagtggtaactccaatgttgaatccctttatctacagtttgaggaaccaagaaataaagtcttccctgagaaagttaatctgggttcggaaaattcattccccttag

SEQ ID NO: 28235 - DNA, 340 bp, Homo sapiens
tgtctgagtccagagcctttctgcagctcatgcagcatgagcacagctggaggaagtgctctttttctccctgcctttctcactccctctctccagttctaatcctgctgcctggaatgagatcatcatccctgctagcagtagcgctgtcctgggctgccttacagagggatgttggaatttaggctgcagttttgggaaatggatttttttttttttttgagatggagtcttgctgtgttgcccaggctggactggagttgcagtgagccgagattgcactactgcactccagcctgggtgacaaagtgagactccacctcaaaaaaaagccaaaaca

SEQ ID NO: 28236 - DNA, 838 bp, Homo sapiens
gttgattactgttgcatgatgtgattgttgttcctactactgctttttccaagaaatagtgtttgatactgtggatgatacagagataaataagatacagccttcattatagatttgaaaaacaagtctcttcattatgtatacatttgattcttttgctggttccataatgtgttcatttctagagaggcgcctttaatccttcatagctttatagtttccatgaattgttcatctttgtcttgtacagagtagaattaataaaatgtttattttttctttttcttccttcttccccttatttctcttttttccctgccatctctccattttttattgttgcaaggaaatatttacatgttaaacagttccttaaaaagccctctggggttaaatatttttttcctcaaaaactataatcatctaattctcaaatgaaaatgcttaagtgaacaaaatttaactggaatttgatcacattttaacataaaagtcaaagattaaaattggaatgagaagggacacataaatgaatgctagcaaacaaaacaaacatttggtcattttaaaagttgtgtattttggataggtgccatggcttatgccataattccagcacttttgaaggctgaggtgggcggatcacctgaggtcaggagtttgagaccaacctggccaacatggtgaaaccccatttctactaaaaatacaaaaattagccaggcgtggtggccggcgcctgtaatcccagttacttgtcaggctgaggcaggagaattgcttgaacctggaaggcagaggttgcagtgagccgagattgtgccattgcactgcaaac

SEQ ID NO: 28237 - DNA, 401 bp, Homo sapiens
gcctactactactaaattaaaaaccggtcgaaccatccatatatattaaatgagagtaagtgaatacccatataacaatagaaagtattaattaaattatttttacatataaaagctcagtgtcaaattgcattaattctgaatttcactgacatttaataaaaatgtaatataattttttcacataaactttcatcaatggcagaggtaacatttttctattaatttactagctaggggtactgtgataccaaagccagacaaaagaatcacaagtaaagaagactatggactaaaattccatataaatatagaattcctgatgaagttattagaaatgttagcacacggctgggcatggtggctcatgactgtaatccagcactttgggaggctgaggc

SEQ ID NO: 28238 - DNA, 202 bp, Homo sapiens
gttaatattataataatctcttatattagtagagtatagttggcaaaacactttctctcacatacattatatcatttgatgcttacaataaccattcaaggtagatggaaggtattattcagtttatttcagtggaaagtcctaccactatccaaagtctgaatttcttttttaacaaatacagaagtatacaaaaagaaaa

SEQ ID NO: 28239 - DNA, 119 bp, Homo sapiens
aatgctttatatgagttagcccatttaatctccttccttagcatatcaattatactatttttcatcagaactactactattccgattttatagaaaaggaaactgaggcttattaaaac

SEQ ID NO: 28240 - DNA, 1700 bp, Homo sapiens
  misc_feature (1055)..(1055): n is a, c, g, or t
  misc_feature (1084)..(1084): n is a, c, g, or t
  misc_feature (1115)..(1115): n is a, c, g, or t
  misc_feature (1165)..(1165): n is a, c, g, or t
  misc_feature (1187)..(1187): n is a, c, g, or t
  misc_feature (1235)..(1235): n is a, c, g, or t
  misc_feature (1477)..(1477): n is a, c, g, or t
tatacttcaattctttaagcatagttctccttagttttttaacctatttgcaatagttgctttgaagtctttatcttctagctccaacatctggggtcacttggggatattttctatttattgttttgtggggttttttttgtgttttttttttttaatccccctgagctgtggtgttctatcttgtttctttgtatgtgtacacatttcttttgtaaataacatatatatattttagacagagtctcactctgttgcccatgctagtatgtagtggtgcgatcttgattcactatagcctcgacatcctgaactcaagcaatcccctcacctcagaccccagactagctgggactacagctccgcactaccatgctcacctaatttttgtattttttgtagagatgggatttcaccatgttgcccaggctggtctcaatccacttgcctcagcctcccaaagtcctgggattacaggaatgagccactgcagctggccaaaacatacatttttgttactttgttgtttctgagaattcccatcctctagtctctacccagcaagaagtgtttctgtaccttcatttatttacttccctgtggttgctaatgtctctgctgtgtttaaagaaagctaaaatataatttttaagtgtagcatcctagctttgccctagctttgtccatgtatctttggtttgcctctaatctcaaatataagttatgttcaatcccctcaaggcagtaaggcttctgtcgtctcctgatgaatctatgcttgggtaagtgagattgcccaaattaattcaaagttaaggctgtttaaaaatctgctacaattttctcactgatgtgttgtttcacttatcctttccatatgtgtgtgtctttagcatggccagggttgcatataacttactcctagttaagttaatatatgtaattcctgttgtttccagccacagtgcagtagtgcttttaagatgggcatctgggctgggcgcagtggctcatgcctgtaatcctagcactttgggaggccgaggcgggcggancgagaccatcctggctaacacggtgaaancccatctctactaaaaatacaaaagaaaaanaaattagctgggtgtggtggcgggagcctgtagtcccagctactcgggangctgaaacaggagaatggcatnaacccaggaggcagagcttgcagtgagctgagatcgcaccactgcacnccagcctgggtgacagagtgagactccatctcaaaaaaaaaaaaaaaaaaaaaaagatgggcatctgatccaacacagacaaatgccatgcaagcctaaaagttttttatgttaaaacttagaagttctcctttctgctggggtttatatcaggagagttacatttccttcatgtacagagaataaactcaatgtagaggaatagggagaatttggagaaggacattgatcatatttttgtnttttgttttcagatgaagtctcactctgttgcccaggctggagtgcagtggtgtgatcttggataactgcaacctccgcctcctgggttcaaacaattcttgtgcctcaactactcgggaagctgaaacaggagaatggcataaacccaggaggcagagcttgcagtgagctgagatcgcaccactgcaccccagcctgggtgacagagtgagactccatctc

SEQ ID NO: 28241 - DNA, 1419 bp, Homo sapiens
  misc_feature (1196)..(1196): n is a, c, g, or t
tatacttcaattctttaagcatagttctccttagttttttaacctatttgcaatagttgctttgaagtctttatcttctagctccaacatctggggtcacttggggatattttctatttattgttttgtggggttttttttgtgttttttttttttaatccccctgagctgtggtgttctatcttgtttctttgtatgtgtacacatttcttttgtaaataacatatatatattttagacagagtctcactctgttgcccatgctagtatgtagtggtgcgatcttgattcactatagcctcgacatcctgaactcaagcaatcccctcacctcagaccccagactagctgggactacagctccgcactaccatgctcacctaatttttgtattttttgtagagatgggatttcaccatgttgcccaggctggtctcaatccacttgcctcagcctcccaaagtcctgggattacaggaatgagccactgcagctggccaaaacatacatttttgttactttgttgtttctgagaattcccatcctctagtctctacccagcaagaagtgtttctgtaccttcatttatttacttccctgtggttgctaatgtctctgctgtgtttaaagaaagctaaaatataatttttaagtgtagcatcctagctttgccctagctttgtccatgtatctttggtttgcctctaatctcaaatataagttatgttcaatcccctcaaggcagtaaggcttctgtcgtctcctgatgaatctatgcttgggtaagtgagattgcccaaattaattcaaagttaaggctgtttaaaaatctgctacaattttctcactgatgtgttgtttcacttatcctttccatatgtgtgtgtctttagcatggccagggttgcatataacttactcctagttaagttaatatatgtaattcctgttgtttccacctgggtgacagagtgagactccatctcaaaaaaaaaaaaaaaaaaaaaaagatgggcatctgatccaacacagacaaatgccatgcaagcctaaaagttttttatgttaaaacttagaagttctcctttctgctggggtttatatcaggagagttacatttccttcatgtacagagaataaactcaatgtagaggaatagggagaatttggagaaggacattgatcatatttttgtnttttgttttcagatgaagtctcactctgttgcccaggctggagtgcagtggtgtgatcttggataactgcaacctccgcctcctgggttcaaacaattcttgtgcctcaactactcgggaagctgaaacaggagaatggcataaacccaggaggcagagcttgcagtgagctgagatcgcaccactgcaccccagcctgggtgacagagtgagactccatctc

SEQ ID NO: 28242 - DNA, 933 bp, Homo sapiens
tcctcacaccaattcagtgatgtggatagtgttcttcattttgcagatgagaaaactgagacacagagaggtcaaagtattttgcacaacatcacatagctaggaagtgtctgaaataggatttgaatgcagataggcagatccagagttcatgcttttaattaccactcccaaccccgcctcccaaaaaaactgaatgaataagagtctcttggctaaatgccttttcaagtagtgctttgttgtgtctctgctgaaagatcttgtcttccatattgccagtagcaagatgctgttttgataaggtgggtaggtccaatctgtcttgtcttccttacaaaattattgtttgtatatctatgttcagtctgagtgttaataatttctttctgcaaatgataaccctcttgaacagccagaacttgagctagacctcagggtagattcctagcccatcgattagggcctgtgtctatggaggaggcacagtacacagtgggagaccactgtggagttgatgcagagatcctagtgctcccttcagcctgaagagaaagtgtgaacgctttcccacggggaaacagggacctcaccaagaagtactccccaagagaaaaaagaaaaatgtcagtgacaaaagaagaaagtcgtgggagcctgtggggcccctgagggtagatcaggaggaagtgtgagtgcaggtgcccctttgggctcaagtgagagtgacccatagagacaatactcagttttgctctcccattcgccatccagtgcagattatgcaatttgtcttcccacaccctcttcctcaacactgcttaccgcaaatctctaactctgctgttaaatcctttcctctctcctcaaaaaccccatgtcttttatgccacgcctcagcttgcggtggtgtaatgaatacttttagtccag

SEQ ID NO: 28243 - DNA, 486 bp, Homo sapiens
ggttattttctgtaactggctcctaggagtcacatattcagttattttaggttttcttcattaaaaatatggtagtacactaagatacctgtaaattagttttataacgctaatattcagagtgatttgtgaataattttaaaaattgctagtttttctataaacattatagaagtgacatgctctccataaagaaataaaaattcacaattccaccacaccaattgatttttcattatacatactcttttgcagtctttattcacttatatataatattctatttttataatcacgacaattttgtttgcttcctttgtcagttaacattatatgttgacataatctttaaatcttgctaacaaacttcaatcaaaataatttcagtaatattctgaacttttgaaaatagatctcactttaaaaatcaggagtgaacaaatagcattttgggtctctctaagatacttaatattacctattaga

SEQ ID NO: 28244 - DNA, 612 bp, Homo sapiens
aatgcggtatgtcatgtttattgatttgtttatgatgaaccattcttatattcctgggataaatcccacttgttcatggtgaattatcttttaaatgtgctgttaaattcagttttatagtattttgttcagggtttttctgtctgttcttcagggatattggcctatagttttccttttttgtctatttttggtatcagtgtaatgctggccttgtagaataagttaggaaaaattccttcctcttcaattttttggaatactttgagaagaattgctattagttcttctgtaactgttggtagaattcagcagtgatgccatcaggtcctgggcctttctttgataggagactttttattactgattcaagtctcctttctcattactggcctgttcaggttttctatttattcataattcagtcctggtaggtagtgtggtagaggaattcatttcttctaggtttttcaatttattggcatataattgttctttgtatttctgtggtatcaattgtaatgtctccttttttatttctgattttatttatttgagtcgactgtcttttttacctagtctagctaaaggtttgttgattttgtttctttc

SEQ ID NO: 28245 - DNA, 3247 bp, Homo sapiens
ccattttttaaagcccttttggtaaaaaccaacaggttgtggccgcagacctcagatggacccggcccatccctggggacgtgctggcgtggcaggtccagagagctgcaccctgcacggggcaccgcaccgcttccctccgcgcactcttctgcctggttttcggaggccaggctgctgggaggcttccgtgttcctgtcagtccttccttcaagaagccggggaactcaggcagactcatctccgcagagcataccagccgtgggggaccgttcgacttgatgatgtgtgcacacttcaggtggtggggacttgagctttaaaaaaacctccacagccgaatcttctcctccgagccactccacgtcacgtccagctgggcctggccagtctgtggttatccatgtggggatgagataacaccacatcctgcagctgtgaagggggatggacaagggacgacggccgacggagagcatcagcagccgacacatagttcgggtcggggccttgggtggtcctgcatggcccgggactcatctcacggaccctccgttctgcattaagccccaggttctcttctggctttgaaagggcccgagtgctcccagtgtagcttcgtcacatcgtcacgagcccctgtggtcatgggcgacctcacacctccctccctgagttctgctctgacataaggaagtcctcggtggctggtgcagcgcggctgtgctgtgctggggaggcagccgttccttcgggggtccttgggcctgcagtcccctcatactcacccttcacccaacatattttccggtgctgatatgtttccagactccagcgcaacctggggtgctctccagacccgtgcaggggccgcctggggtacacggaaggaagttgagtcctagtgcaaaatgcaggcggacgttgccagagagtgcgcagcaaatgaccttcattgccagttccaccctactcctctcattttttatactaagcaataactttccaaagcaagaagttcaggatggagagagtcccctcctgtgtaggcatggggtggatgcggtgcccacctgggctatgtggggagcaccactgtctcgggatgcgcgaattttttttttttttttaattaacagggcattagaagatgattttgccaaaattgtcatgactctgaattcttgctgtggggacttcctgagttttctcagtttttacatctaagattagtcttggctgaagagaaatgagacgtgattatactactttttcaattgcaggtttaaggagttcagatttaatgaccaaagtcatacagatcatggaatctgtcgtcgtcttatacagtgtcagcctcgagtacatttattaaccttttggggctgtcagttttccactaggattaagattttggccgggcgcggtggctcacgcctgcaatcccaacacattggggggtcgaggcggacggatcactttgagcccaggagttcaagaccagcctgggcaacatggcgaaacctcgtctctactaaaaatacaaaatatatatatatatatatactagctggggcacatagtggtgtgcacctgtagtcccagctgcttgggaggctgaggtgggaggatggctagagcccaggagatgggtgttgcagtgagctgagaccatgccactgtactctagcctgggtaacagccagaccctgtctcaaaaaaaaaaacaatttttttcataacataattcccatttttatttattttgagtcactcataattaattgccaaaaaagcattttatacattgagttggggggtagtggatcttagtgtggtgttgcatggaggggcgagattttatatttataatcaacacgtgggttaacatgtttttttgaaatccaagcaatacacaggaaatttaagtagaataaaaattgcagcccatttttgaaatgtcagcatgtgctgtgttcagttcaggtttttgttgtttgttttgttattttttaactaataagttggttatcagtggtgggttttcaaaatgtacttgttctaataagttgtacaatgaactaaatcagtggcattctctagataatgtgggggaaggttagaatattttctggccttctatggggtagcaacccagaatcaatctgaattagtcctgttttggtggagtttgtacattttaaatcctataacaaaaataatctagttttcatttccttactagctagatgcgaatttgtctttttgaatgaccctgtcaataagccagaaagggcaacccagaaaaagtgctccccacatccttctgagacttggcctgtgtgtgtggacgagaagccattcaccgtaagggtgcagaaagctcgaccaagccgaattgcaaacaacgttcgttctatttttaaatgtacaggttcgatcgtttctatagaaatgggtttatctaagaaaagtcttggtttgtcttgctgctgtaaaaggcctttccaaacccctccttttattcctgtttcccgaaataaggtatttgtagagttaaggacctactgcatgcctgtccccagggccccggtggaaggaaggcagcgcctgctcttccttgactcagcccatcatctgaaaattcagaagtgaaccaagggttagacgccagaggttgggcttctgttagagtggcttcaaaacatgagccttatgggaagtagccttaaaaaaagaatgggtatacgcagtgacttccgatggaaatctccaaaacaatattcctaagtagcaatggggttggctcaagtctttattaacaaagaacattctctttcatctataaagaaattcttaaagatgcattgacagtgttgaattaccaacagcctgtgaagatcagtttgaccggtgtggacacgtgctggttaagcactcaggcctacgtgggccgagcgggatcttgatcatggggctggtgtatggatccaccgtcggattccgtctgcagaggaggacgtagggggccgtcacacccaccaggcctccctgctgtgctttaacacaggcagaagaggttcatggcaatataatagtcaatgaactttcagtttaaattgtgtacatttttaaattgtaagatttttactgtatattgatgcatagtgtgattcaataaattgcttgtaatttaaaaactatttaatattcaaaataaatatagttatatatttataaactctg

SEQ ID NO: 28246 - DNA, 2135 bp, Homo sapiens
aattgtgggagctacaattcaagatgagatttggatgggacacagccaaaccatatcaataggtattattttatcccccattttataaatgaggaaacggaggcttagttgagtgagctgaccaatatcacccagccagtatgtgataaaactgattctgacccacacagtttgattctagagcctgttctgactactgtgctaaggtgtgtataatgaacatggtaattctaaccagctttttaaaaatatgtagcgcttgtcatgagaggtactggggaaaagaatgtgcagtagagtgcaaatacattacaattactggaaaattggtggaaaatgctttttggggttacaattatatcatttttaagtgttgatgctttgtagtactacaaagctaaattgtgcaaacaaaacatatttaacagagtaattgggaggataaagcaataataaattcaaatatatttttctccaaactgccaaagggaaagtagaattgtggagggaaatgaaatatccatgtaccaggccaggcagatggtcagttaggatgacaatagtaagttcatctacagcataaaatgtgaaatgctttcatcctcattgcccatttccaactaccattctgtttctcctctattgttcatggtttttcaaacatatctttgatttttcaacccccctttttcattaatctgttcttaaaacttctttttactggctttcatacttagcattccagtgaaatgttcttagactcaccagtggacaaataataaggcctttttttattattatttcttgtcttttttgatctaatttatattttatattgttgaattctccctcctttggcttgtgggatcctttttctctaatatctgtctttctttttttagttgatctttccacccactcccctttctcctcttctccactgagaataatctccctgtcttttattcacttcattttctatactcctatttatccattttgattgtttatacctactatttgtattcgaatgacttcatttttcccaccctgtgggtcagtttgtgacttttggaattttccacaggtacctgtacaacttgatatttgaaaacaggattcatcaccatatatccccagcccccgttttctttttaaacaggcctcattgcgtaattcctttgccctgaaaagtgtcaccacctttatatttttaccccagccttggagttatctttttctgctctccattctccatgtccaaaaacttgctgtcagtccagtttttaatcagttttctccttgaggcttgatctcccatttctctcatcccattatagcttttcatgtagatctgaggcccaggttactgtaattcttttttttccaatttccttgctcccaggatccccatcttgtataaagtttctaaggtgctcctcctcaaactccatttttacaatatccgtattgtaaaattttcattttcagtaacacccagtagataatttttcaaagacgatcctcctcaaacacccatttttacaatatctctattgtaaaatttcattttcactaagtaacacccagtagataattcctatggagcagtggtgttccaaattctccattacctctatgcctaatattcatcagccttcattactctctagcatattcaccttgattcaacagattcaaacttcctacagccttctactgatgtcttacaagctcttgcctctgtgcctttctcatgctattctttttgcttagattgctctttggtcccagctcatgttcatcactcccttcaaagcctttcttcctttatatcttctgactgagctctccctgattgacatcacctcatgcgatgacctccctcattctgtgctgcctcagcacttatcttttgagtttgtactgtggtccatgtacttactaatatgttgctttgtaattattttctagcactctgtgttacagtttcatatttgtatttatttccaaaattaaattgtaagctccttgagggcaggaataataacttttacatttgtatctctgcacccccgagtgcctagtatagtgctgagcacatagtaggcgtttaataaatgcttgttgaagta

SEQ ID NO: 28247 - DNA, 2080 bp, Homo sapiens
aattgtgggagctacaattcaagatgagatttggatgggacacagccaaaccatatcaataggtattattttatcccccattttataaatgaggaaacggaggcttagttgagtgagctgaccaatatcacccagccagtatgtgataaaactgattctgacccacacagtttgattctagagcctgttctgactactgtgctaaggtgtgtataatgaacatggtaattctaaccagctttttaaaaatatgtagcgcttgtcatgagaggtactggggaaaagaatgtgcagtagagtgcaaatacattacaattactggaaaattggtggaaaatgctttttggggttacaattatatcatttttaagtgttgatgctttgtagtactacaaagctaaattgtgcaaacaaaacatatttaacagagtaattgggaggataaagcaataataaattcaaatatatttttctccaaactgccaaagggaaagtagaattgtggagggaaatgaaatatccatgtaccaggccaggcagatggtcagttaggatgacaatagtaagttcatctacagcataaaatgtgaaatgctttcatcctcattgcccatttccaactaccattctgtttctcctctattgttcatggtttttcaaacatatctttgatttttcaacccccctttttcattaatctgttcttaaaacttctttttactggctttcatacttagcattccagtgaaatgttcttagactcaccagtggacaaataataaggcctttttttattattatttcttgtcttttttgatctaatttatattttatattgttgaattctccctcctttggcttgtgggatcctttttctctaatatctgtctttctttttttagttgatctttccacccactcccctttctcctcttctccactgagaataatctccctgtcttttattcacttcattttctatactcctatttatccattttgattgtttatacctactatttgtattcgaatgacttcatttttcccaccctgtgggtcagtttgtgacttttggaattttccacaggtacctgtacaacttgatatttgaaaacaggattcatcaccatatatccccagcccccgttttctttttaaacaggcctcattgcgtaattcctttgccctgaaaagtgtcaccacctttatatttttaccccagccttggagttatctttttctgctctccattctccatgtccaaaaacttgctgtcagtccagtttttaatcagttttctccttgaggcttgatctcccatttctctcatcccattatagcttttcatgtagatctgaggcccaggttactgtaattcttttttttccaatttccttgctcccaggatccccatcttgtataaagtttctaaggtgctcctcctcaaactccatttttacaatatccgtattgtaaaatacccatttttacaatatctctattgtaaaatttcattttcactaagtaacacccagtagataattcctatggagcagtggtgttccaaattctccattacctctatgcctaatattcatcagccttcattactctctagcatattcaccttgattcaacagattcaaacttcctacagccttctactgatgtcttacaagctcttgcctctgtgcctttctcatgctattctttttgcttagattgctctttggtcccagctcatgttcatcactcccttcaaagcctttcttcctttatatcttctgactgagctctccctgattgacatcacctcatgcgatgacctccctcattctgtgctgcctcagcacttatcttttgagtttgtactgtggtccatgtacttactaatatgttgctttgtaattattttctagcactctgtgttacagtttcatatttgtatttatttccaaaattaaattgtaagctccttgagggcaggaataataacttttacatttgtatctctgcacccccgagtgcctagtatagtgctgagcacatagtaggcgtttaataaatgcttgttgaagta

SEQ ID NO: 28248 - DNA, 1035 bp, Homo sapiens
agtatttccaggaggctgtgagggggaggtccaacgcagtccagctgacaaggatggaatacgccatgaagtcccttagccttctctaccccaagtccctctccaggtccgggacactctgatgctggcagacaagcccttcttcctggtgctggaggaagatggcacaactgtagagacagaagagtacttccaagccctggcaggggatacagtgttcatggtcctccagaaggggcagaaatggcagcccccatcagaacaggggacaaggcacccactgtccctctcccataagcctgccaagaagattgatgtggcccgtgtaacgtttgatctgtacaagctgaacccacaggacttcattggctgcctgaacgtgaaggcgactttttatgatacatactccctttcctatgatctgcactgctgtggggccaagcgcatcatgaaggaagctttccgctgggccctcttcagcatgcaggccacaggccacgtactgcttggcacctcctgttacctgcagcagctcctcgatgctacggaggaagggcagccccccaagggcaaggcctcatcccttatcccgacctgtctgaagatactgcagtgaaagcccaagtccttggaagctttccccagtgaaggactgactgggggcctcacgcttaactggtagtggccacaagcctggcagctgtagagccgcgaacctccccacacctccctcaccgcgcaggaccctgagtgaggaggaggagctggaaacctggggtgggttggccaaaggagaacctcaagctcctggcctgatccagctccttcctgcccaaggcagcttagcccatccagactggtcctgaagtctgtccctccattggcatgaagtctgccccttagcaatccggcctcgcaggctgtactttcatggtgctctctaccttctggcccccatcccggaacattcctgagtgaattcgcaagcgcactagcatgtgatattagggagtttgcaataaattattgaggctg

SEQ ID NO: 28249 - DNA, 222 bp, Homo sapiens
atggaacagtgccctcaagagttgggaaatgattttgaacttagaattctatacccagccaaactatctcaagtatgagagcaaaatagaatgatgtgcaaggactcaagattttactcccagccaccatgctagtgggagttactagaagataaactctagcaaaggaagggaggaaacatctggcatgatatatttgatatgtgaatacctgaatatggc

SEQ ID NO: 28250 - DNA, 1047 bp, Homo sapiens
  misc_feature (125)..(125): n is a, c, g, or t
tgaattcaccattttgtccagggtgtctcaactcttcatctaatgaactgccaccttgcctcccagagtgctgggattgcagccatgagccactgcacccagcccaaagtaaatgcttttaaaanaaatatgtaatataatataaaatttttgaaaagcaaattatgatataattcaagtatcaaattacttcatgctgtttcattgttcctattcacatgtgaaagcatgtgatcaattattgctgcatcacatatagactcattaggtggaaattatggcctcttctgtaaaaaagtaaggacattaaaatgtaagatgcttgatgaaaatctaagtggagaggctctttgtggttaacttattgagtgatgtatgaggtcgatgttcagagtaatatgcctctgtattacagtgatagaaaatattttttagttaaaagtgaatttataataaaattgtaaatcattttagtgattgagcttttatgttataaaatgcagtatatttcaaaatttttaaattatatgtaaatttgattttatttgttaccatgttaagactattgtgcatttaatgaagcattattatgctatcaactttaacctatcccacgttactcaagggtgtagctaaatgaaggtagcagtatgctatttagtaacatagtggaatagcatctctagtaatctcttttgccagtagctttaactggcagataagttaatattgttcccataggttaaatatttatcctttttttgatatttaaatttttttcttatttttttgtgggtacataatatgtgtatatatttatgcaaatctggcatattttgatacaggcatacaatatgtaataattacatcaattacatcagggtaaattatgtagccattacttgtaacatttatcttttacaaacaactcaattatgcacttttagttattttaaagtgtacaattaaattgctattgactgcatggttatctttgtggtataaaaatttatatataagtataaataaactcatttctgagtctta

SEQ ID NO: 28251 - DNA, 1678 bp, Homo sapiens
ttttactttgtgtaactgattaattgttcatttgggtagtgatattatgactatggctaaatttgcattgtcttgcctaatagacctgagcactgatgagcactgtcttccctttagatatcatagaatacagtcatggttacttggtttccaatgtgtagccttgtttggggcttgctttccaaccaggggagtaagaaggcacaggcaagagtgccagggcttgctgtcatagactgagggctctgccaagacagggattgactctggctttggattatctcctaagctttggaggggaaaggggagagaagaggactacagaaggtctagtagttgggaaatgagggggcagcccccttgtgccactgccttgagagtttcaaacctgtggcccccgcaaaaggccaataagcactcttgtgtaagggaaagggccattcaggtgggtgctgggaaagatagctaaatttacccgcctctctattcttgggttttttcctctgtgcctgcagtactttgttttcttctcattgtgaatgacctggacttatttccttgaggtccagcctgacttgggctcagggctttcatcttcccttcacgggatctgggaaagggcatgagatctggagccagacaaacctagatccagtcccagctccaccaaatattagttgaatggcttcagacaagtcttttaacctctctattcctgaatttccccatctccaaaatgggatggtgatgattaaggtgaaagaaagatgcctggtttagcagcaagaacatagactttgggttcatagacctggatttaaagtctggccttgaggcaccgtggctcacgcctgtaatcccagcactttgggaagctgaggcacgcggatcacctgaggtcaggagtttgagaccagcctgaccagcatagcgaaaccccgtctctactaaaaatgaaaaaaaaaaaaaagccaggcgcggtggctcctgcctgtaatcccagccctttgggaggctgaggtgggtggatcatgaggtcaggagttcgagaccagcctggccaacatagtgaaaccctgtctctactaaaaaatacaaaaaaaaaaaaaatagctgggcgtggtggcaggcgccgtaatcccagctccttgggaggctgaggcaggagaattgcttgaacccaggaggcggaggttgtagtgaacccagatcgccccattgcactccagtctgggcaacagtgtgagattccgtctcaaaaagaaaaaaaaaaaagcaaaaaaaattagctgggcatggtggcacatgcctgtagtcccagctacttgggaggctgaggcaggagaatagcttgaacccaggaggtggaggttgcagtgagccaagatcatgccactgcactccagcctgggcgacagagcgagactccatcttaaaaaaaaaaaagtctggggctgggcgcggtggctcatgcctgtagtcccagcattttgggaggccgaggcgggtggatcacaaggtcaagagatcgagaccatcttggccagtggcgcgtgcctgtagtcccagctactcgggaggctgaggcaggagaatcgcttgaacccgcgaggtagaggttgcggtgagctgagatgctacagcactccagcccggcagcagagcgagactccatctc

SEQ ID NO: 28252 - DNA, 375 bp, Homo sapiens
gtcatacacagagaaaagtaatttataaattatgtgccccccatttgctgcaactctcagtggtgagaagaatgattcagtgcagctataggagactacttccattggcatgccacctgcctaacatacacaattttgttaagatatacaataaaattattatgctaatagcaaatattttatgtagctcactatgttccacatactcttgtaagtgcttcatgttagtccccagtaaacacctggttgggggaggtggctcatgcaagtaatcctagcattttggaaggctgaggcaggaggatctcttgagcccaggagttttagatcagccacagcaatataatgagaacctgtctttaaaaaataaataaa

SEQ ID NO: 28253 - DNA, 409 bp, Homo sapiens
caacagcatctcccctccccaatctcttccctctgtgacctagtagtccctcactgggaggtggcatctatctcttcccacatttgatctggggcggttctgtaactacttcaaccaaaactatgtggcacagagtggaaaacaggcggttcctcaaaaagttagacacagaatcaccatatgacccagcaattccacccctaggtacataccccaaagactgagagcaaggactgaaacagatacttatctgctgctgttcgttgcagcactacttattttttgtttgtttgttttttctttttgagacagagtttctccctattgcccaggctggagtgcagtggcgcaatcttggctcacttcaacctccacctccttggttcaagtgattcttgtgcctcagcct

SEQ ID NO: 28254 - DNA, 535 bp, Homo sapiens
ggcggaaggatcatttgaggtcgggagtttgagaccagcctgaccaacatggagagaaaccgtatctctactaaaaataaaagattaactgggcattgtggtgcatgcctgtaatcccagctaactcggaaggctgaggcagaagaattgcttgaacctgggaggcggaggttgtggtgagccgagatcaggccattgcactccagcctgggcagcaagagcgaaaatccatcacacacacacacaaaatattatccccctggttcctggtcctttgttttgtgtgctaggtgaagattaagtaaatacataagtagctaggaggtgtgcttatttttggatgccacttccttagggaatacgattgggaacagttttattttggctgtgacttagattgttacattcctaaagaaacagtacattttctttactggttggagtgccagggctcacacctgtagtccagcacttgaggctgaggggagaggttctcttgagatcttgaggctaggagtttgagatcaggctgggc

SEQ ID NO: 28255 - DNA, 329 bp, Homo sapiens
cagatatgtttgcctccttgccttcagttcatttcaagaatgagaaaagcagccaggcatggtggctcacgcctgtaatcccagtgctttggaagactgagacaggtgatcacttgaggccagcagttgaagaccagtctgggcaacaaagcaaggcccccatctctacaacaaatttaaaaactagccaggtgtggtggcatgcacctgtataccctgctacttgggaggctgagagaggaggaccacttaagcccaggtgtttgaggctacagtgagctatgatccactgtgctgcagcctgggtgacagagcaagacccagactct

SEQ ID NO: 28256 - DNA, 455 bp, Homo sapiens
taaaatgcccataaggggtttatttatttatttattttgagatggagtcttgctctgtcccccaggctgcgtgcagtggtgggattttggctcactgcaacacctgcctcctgggtttaagcaattctcctgcctcagtctgccaagtagctgggattacaggcacacgccactaggcctgggtaatttttgtatttttagtagagatggggtttcaccatgttggccaggctggtctggaactcttgacctcaggtgatctgcccgcctcagcccccaaagtgctgggattacaggcgtgagccactgcacccagtccacaaggggtttagaatagattgagtgctcaatagtggtgtttcaaatcaaactcatcatctccatttcacaagggaggaaagtgaggcccagaggggcttcgggactcaaagcctgggtgagctgactctggagcc

SEQ ID NO: 28257 - DNA, 263 bp, Homo sapiens
ggtgtctatcctggaaacataaaggagtcatcacacactttttttttggaacactgctatagggtaacctgggataccatattgcaataccaacctacctaggattgcaattctgattgccccagggagccgtataatttcttatgccctatgcatgtgcaggcatgcacacacacacaaatcaaaggtagaaacagccacaaaaggaatgatttaaggtagcctactctgctaaagacagcaaggtaactttctggttatag

SEQ ID NO: 28258 - DNA, 101 bp, Homo sapiens
agctgaggtggctatactaatgtcagataaaatgagtcttaagtaaaaaattgttacaagagacaaacaaggacattacatgttgataaatgtgttaattt

SEQ ID NO: 28259 - DNA, 448 bp, Homo sapiens
tttcttattttcaaaagggtgcttaaaatggtaggattgaattgccagaactcaactttaaaattgaatttaaagggaccacaataagggttataaacagtgataaacctccacagtacataaaaataagaaagcatcactcttaatggatgatctaaaagtggcatgaagcagtaggcattggtaagtacattagcatagagagagtcaatgaatcatgaatgaagagtaatagaagtctgtagttcaagaaaacagtcctataatctgtgcattaagccttagggagtaattttcacaggaacggttaattgtaagaggagatttgagagcatgcactgatatcaattctcttcctttcctctcttaagtgttgtaccattctctcccatgtcattcagatgaatatagttattatgcacccactgtgtgaaaaacatttcactag

SEQ ID NO: 28260 - DNA, 418 bp, Homo sapiens
ggtgtacctactgtactgcacatgtcaactgccttcagccaaatagacagaatctggttcaagcatttattttgctcctcatgtctcttgtctctttgccgtcactgctacttctttctctggaaaaagacggaaagagcagcagagaggctgaacatggccatgcaaacattttggtcttgtgagatattattatacttgaaaaaatcaatctggtttaaactaattttaaaaaaatctttagttaggttttagggaaaatacagattgtctcagggtgtttattatttcaaaggcaagggcagtttatatcctctgttttgctcataagaacccaaaataaactggacccaaaaagaatcaggccagagggtcataaatgcacattttatgttcatgggaattatggctcaattct

SEQ ID NO: 28261 - DNA, 585 bp, Homo sapiens
tagcattttcctgttctgaagacagcagcacctgtatctgttctggaacatctggtggccatttgcacagctactgctggacttccatctttatctctccaggcagacgagtcgaaccttccaataggaaattttgggtaaatgacaaaaacttatgagggttgtcctttgtgagcagactttgaagcagtaggaatgtagcctattgaaaagatggccagaggttcagaaataagcgtgacggataaaaatcagcaagacatttaatacatctgcaaacttgccttctttcaaagaacattgattgaaacagattcgtttgttcataatgtgggtgtgaaaatagttctgaaaagccattctaaacaaacttatgtttttaaaaagagtagatgaaatctgtttgcggaggaaggaaaagatgacattcaggaagcaatgttctggttaattctgtgttcttcaaaagccagctcattttcttgaaaagaatgctggccacaatccacaggtatagagaatatggagagaaagcatctcacgcctgaagagtccaataaaacatttatagataagaatttaaga

SEQ ID NO: 28262 - DNA, 483 bp, Homo sapiens
agaataaacttgataagttcgtcaaatttttattttattaaaaaaattctgtttgcaaatggcatatttacacaacttggtaataagtcattttctcttttttccattttactaacttaacaatctaaaagcaacaaccacaacatagaggattaaaattaatgtcattaattttaggtcagtttgccataaaattttagatgttttaccttgcacactaaggtaatcccatgaatttattttagattaggtctggcaagaagatttcaaggacattgtgctttgctttcagttctgaaaggtatgagtggatttataacagaagtgtttgactaattcctgttgtcttgtgggtacataagcttagtaagcagaacaaatgactgaaggaaagagggacaaaatttaagtctgcattgtgtaaatcattactgtctaagtggttaggggacttctgtttttttctttgtttttgagactgcg

SEQ ID NO: 28263 - DNA, 411 bp, Homo sapiens
ttgactttattcctagcagctgccagtgtcgttttgaatgcttgaaattacttagtgtctactgtgccactgggtggggattttaagctaaatgtaatgttctgtcttctgagtggagctacagaagactttttaaaagctgtagaataaagtctcatcataccagaattacagggcctgtcggaaaattctgaattggataacatttattttttaaaatgcagttgaaaaactcatgaatatatttagtgtagctagttctgggataatgccagcccaaatacattgattagataagaatattctgtaattaacgtattactcatgggctagcgagtgctactgggaaacagtttgaagttaaaacataaacatgtcctgtgtgatgtggcttgcgtgattcttttgctg

SEQ ID NO: 28264 - DNA, 530 bp, Homo sapiens
gacaagagaacagacgatgaggcccagcatttttagtgatactgcttctagctttcttttgccaaagcccccttaccacccctcttattctcccccaccaaccctgacctcttgtttcagaagccctggaatacccccccagcttgcagccccctgccaactactgctgcccagaagggtggcacagtgcctggacttcaggcagaatctatcaaatcacagaaccagagggtgtctggaagtcacctcatctagtcctctgttcacatccagccctgctcacgaggacaggggcagacaggttcagggtagtgggcagcagaaggatgaagtgcccatctcccttcagctgccctttctcctttcttacttcttacacaatttatattggaagtcctcactcagatctgactttgcagacatcatgcataatgagaattggccagaatcaggagtcctatggtcaatagactgacccagtcctagattctccaaaaaataaaacgagatttttggctaggtcctttcac

SEQ ID NO: 28265 - DNA, 201 bp, Homo sapiens
ggacagatcacttgtctagtcaacatttcttaatctataaagtaaaggggttgatagctgggcccggtggcctgtgcctgtatcccagctactctggaggctgaggtgggaggactgcttgagcccaggagttccaggctgcagtgggccatgactgcaccactgcgctccagcctgggcaacagagtaagactctgactc

SEQ ID NO: 28266 - DNA, 426 bp, Homo sapiens
tatttttatcaatatgtaaacctgtcttatctatttatttatgggtctattgtcttcctaccaccccgagtacaaagaatcttctttaggtcatagactatctagaacagtataagttgcatagaaaatgctcattaaatatctgtggactgacttattgattgaccagccaagctgccatccatcctcatctataaggctagtaatatgttgggtatcatcaggtaagacattatacataaatataaaacatcatacagaaccagcccggagctttgcatcctctatggtcatcaacattgtacttcacaaaaaattattggagatggttgggtccaggggagacgatcgaaataatcaagagaaggatgattggcagaggaggaagatagttgaggaactgctgtacaaaagcaaaaaaaaata

SEQ ID NO: 28267 - DNA, 865 bp, Homo sapiens
atcatagtcttgccgtggccaggtggggtggctcatgcctgtaatcccagcactttgggaggctgaggcgggtggatcacctgaggtcaggagtttgagaccagcctggccaacatggataaacccccatctctactaaaaatacaaaattagctgggcatggtggcacgtgcctgtaatcccagctacccgggaggctgaggcagaagaatcacttgaacccgggaggcggaggttgcagttagccaagatcgcgccatcgtactccagcctgggcaacaagaacgaaattctgtctcaaaacaaaaacaaaaacaaaaacaaaaacgcttgccataaatacctttcctccctccccacgcctaatggattaatttttagtcttataaattaggaaatttctcatatagggctgacataaagagtaagcgttattgttcatgtaaagccctgaaatagtttgcctttatcgaaagctctagggtattttcgcaattattttgttgtgttaaaaatatggagaactaccttctaccccaggtggtcctcagcagagcttctgtgtggagcagaaagttttctcctgggatatttttgcctattttaagccctgtcttatgcttatttctgttggtcatttctcccagcatttctcaaaggaaagatagtaacgtattgcttctattttagggattaaagaatgataaatgtatggggtttttaattcattttatattttaaattgaagctaccaagattcataagccatttgttcatctaattggatcacattgtgttcaagtttcttttcactgtttttgttttttaaaatacaatcttaaatagttaccctttctctcctcac

SEQ ID NO: 28268 - DNA, 250 bp, Homo sapiens
gaagaagaaacctcactgaatatcttggatataaaggttcaaaatagtgccccatatggcatcaattactgttttaaattttaacagtttggattgaggaagcatcggacccaaacttggtgtttcttaaaacataggctgcatcaaggccgggcgctgtggctcacgcctgtaatcccagcactttgggaggccgaggtgggcggatcgagaggtcaggagatagagaccatcctggctaacacggtga

SEQ ID NO: 28269 - DNA, 308 bp, Homo sapiens
tcttccttccttccagcctttccctgggcccctcaagtcacatcccttgtacagtcacccacaggcaccccttctctgtgggccttcattttgaccaagccctgaggtcacaacaccctgggaaggagacatgaaggattttccaaggacccagctgtggccacgcactttctgtcctctctgtcctgctggaagccaaagttcttaagcttctgtacagcaagtttttcataaaatgaacgatgacaacctagtcttttcaggctttctgtttgcagttgcaggaggcttcttagctggtgatgacc

SEQ ID NO: 28270 - DNA, 389 bp, Homo sapiens
gacattcatttatcacattaacttatattgattgacaaccgttatatggcatatgtcgtatcttttgtatttcattgtaatttgtcattaaaactttattttaacctttacctctaattaaatatatttagggcagactaaaatacttgctaattatactcaaatgaaaatacatttacaagaggagtgaaaaaattaacataaatgtggaaaatagcagggaataaaataaataatagtagtaataataataatggacagactgggcatgaagtacaggtggctcacacctgtaatcccagcaccatgggagacccaggtgggataatcacttgagcccaggagttcgagcccagcctgggcaacacaaggagacgtagtctcaacaa

SEQ ID NO: 28271 - DNA, 560 bp, Homo sapiens
cagcctgggcaatatggtgaaactgtctctacaaaaaatacaaaaattggcagagtgtggtggctcgtgactgtagtcctagctactcaggaggctgaggtgagaggatggcttgagcccaggaggtggagattgcagtgagccaacattgccccattgcacttcagcctgggcaacagagggagatcctgtctaaaaaaaaagttagtccattaaggatggttaaggttatatgagagagctattactatttttttgagaggttggggttctttatttttatcaatctaacaaacgttctaattgttaaaggagtatttagtgttctaggttatagaaatagaaagaggaataaccagtattgtgtgactatagtgaacaaagttcctgttgtttttctcttaactctgcatcagggaattatgtggtcactggccttgggttgtttgcagttgtccttgttgggtcaaggtgggcctttttacatcaaatctgggcaaggtgccctttattgtcattctgtttggcctttcagccagctttttgtgtataagtaatac

SEQ ID NO: 28272 - DNA, 489 bp, Homo sapiens
caggacaagacagggcaggcgcccacagcagccacgtgctgtccctcagtgtcccttggaccaggaccgtgaactgtggcaccgctcacccgaggccagatgagaacactggggcttccttgtctttctccttcgtgtcgggcatctcttgtgccctcttttattttgtgggctgtggctaaatgaggttgctgcattcgtcagctgagttgttggggttttgatattttgtggctgtaaaagatagtaacctgacatagttaccatttcctcgtacctcgctttgccagcaggcaggtgactcaagattcattaaaaaattttacaagttggccgggcacagcgggcacagcggctcacgcctgtaatcccagctactcaggaggctgaggcatgagagtcacttgaacccaggagccagaggttgcagtgaggcgagattgcaccgctgcactccagcatggacgacaggggtgagactgtctcaaa

SEQ ID NO: 28273 - DNA, 307 bp, Homo sapiens
caggacaagacagggcaggcgcccacagcagccacgtgctgtccctcagtgtcccttggaccaggaccgtgaactgtggcaccgctcacccgaggccagatgagaacactggggcttccttgtctttctccttcgtgtcgggcatctcttgtgccctcttttattttgtgggctgtcgggctagtcggggctgtcgggctagtcggggctgtcgggctagtcggggctgtcgggctagtcggggctgtcgggctagtcggggctgtcgggctagtcggggctgtcgggctagtcggggaggtaccga

SEQ ID NO: 28274 - DNA, 645 bp, Homo sapiens
cagtatgtcaaagagttatggtccctgaccgcaaagggcgaaagccacaatgtcataacagatgtgaaatgaaaagacagcggtgtcgacattaaatagtaatatacatagtgtaaagttaacatcgtgcaccaggaaaggcttaggtgagaggtagtaagggaaatgggtggttctcaaggctgccagtttcaagagctgtaggaagaatggaaaaggtttggctattgactttcttgtatgtggttcatgctaatacttcaaaataggtgtgagatgatcaagaatcagagcactatactataaatatacctgaacccacagtgcgaataaaagaggtaagaccctaagaaagtccagtgaagttggtcaaaagccttgaagcccatatactctacctgctttttctcggtttcttctaagtctggcaagcagtcagagggcagagccagttaagtcccccagctataagaatgccacaaaggtatgttgtgcgtgtatgtgtgtgtgtgtagctcagctagtgctttcttgagaatatttaacttttacttttgttccgattagtaaagttgtgcatgttatcactaacagaaatcagaaattcttcaaactgcatataacttagaacaaagttgtttttgc

SEQ ID NO: 28275 - DNA, 326 bp, Homo sapiens
aaaaaactctatatctccttaccgtctctacctcctcttcatgcccaccaaccaatttaacattctgctgtgtatatttctataccttttatcattctaatacaaacctctacaatcatttatgaaatataaaggattctttgctttgtttttatgtttttatgcagcatgcttctctcacttttgtggacattattccaggtcaaaagataatagatttaactcattaattttaataatcacccaaaaaaatgaatttaatggctgttactacaggtggggaattcttatagcctgggagctacaccatcaacacaggaaagtca

SEQ ID NO: 28276 - DNA, 870 bp, Homo sapiens
gtctaccaaaaaactacaaatcttagccaggcacagaggtacatgcctgtagtctgagccattcttgaggctgaggtgtgagaatcgcttgagcccaggaggtagagcctgcagtgagtagacattgtgacactgcgctccagcctggccaacagagcagaccctgtcttgaaacaaaagaaaacaaaacaaagaatcagttgcagacatgatagcctttatgcttaaatacctcagtatacatttcttatttatcttatgtaactaccatacaattctcaaaattaagaaattaacatgggtacattctattctcaaatccaaatacctgttcacattttgacagttgtctcagtaatgttctttatgacatgccactgtgcccggcccaggggattaattctatcttacctgttttcatatctgtaattttcttcttcaacagtgagaaaagtggcttcatttatctgcaacgtatttatttgagcctttttagaatacacagaaagttgtttcagaattaatagccagtgcttttgtagaaaagaaacctgtgtataaaattttttttgattatcaaattattaacatacagcaatagtcctcaacacaggacattttacctcccaggggacatttggcaatatctgaccaggaaaactaccaaacatcctacaattcatagggtagccccacagcaaagaatttattcagcccaaaatgtcagtagtgctgaggttgaaaaactcgatcacagagcaaggaaaatacctactcaaggaattaatgtcgatgtttttgtcaaaccacttgaatgtaagatgcaagcatcatgatgcttctcttctaaatactccttaaaaaaaaaaa

SEQ ID NO: 28277 - DNA, 489 bp, Homo sapiens
actcctaaataacatttatttccatgtgacttgcatgtctaaataaaatgaatttggcttagtaaggctttcatttatcttcatctaaacgcttttccaccagtactcatcacaagactccccaaggttatgaagcagattgatatagaaactccatttctaggacaaaaacgaggcaccttgagaatggacccaagccataataaactagtaatgcttttcccacacaaccatataaaatacagtgagcccttgatcaacctttgcacaaaaagaattgctcattaagtctttgattttttaaaaaatggcacttggttttctagaaagaggatctgcacactaactattcgatttgtttgaatatagtcagattattatgtctgtgtttattaggcttaatttgaaaagatttttggttagtatctccacttctatgatcaaacactatagagttcaagaccagcctgggcaacatagtgagaccct

SEQ ID NO: 28278 - DNA, 983 bp, Homo sapiens
actcctaaataacatttatttccatgtgacttgcatgtctaaataaaatgaatttggcttagtaaggctttcatttatcttcatctaaacgcttttccaccagtactcatcacaagactccccaaggttatgaagcagattgatatagaaactccatttctgtagtctgagccattcttgaggctgaggtgtgagaatcgcttgagcccaggaggtagagcctgcagtgagtagacattgtgacactgcgctccagcctggccaacagagcagaccctgtcttgaaacaaaagaaaacaaaacaaagaatcagttgcagacatgatagcctttatgcttaaatacctcagtatacatttcttatttatcttatgtaactaccatacaattctcaaaattaagaaattaacatgggtacattctattctcaaatccaaatacctgttcacattttgacagttgtctcagtaatgttctttatgacatgccactgtgcccggcccaggggattaattctatcttacctgttttcatatctgtaattttcttcttcaacagtgagaaaagtggcttcatttatctgcaacgtatttatttgagcctttttagaatacacagaaagttgtttcagaattaatagccagtgcttttgtagaaaagaaacctgtgtataaaattttttttgattatcaaattattaacatacagcaatagtcctcaacacaggacattttacctcccaggggacatttggcaatatctgaccaggaaaactaccaaacatcctacaattcatagggtagccccacagcaaagaatttattcagcccaaaatgtcagtagtgctgaggttgaaaaactcgatcacagagcaaggaaaatacctactcaaggaattaatgtcgatgtttttgtcaaaccacttgaatgtaagatgcaagcatcatgatgcttctcttctaaatactccttaaaaaaaaaaa

SEQ ID NO: 28279 - DNA, 408 bp, Homo sapiens
gaaatttcttatcaaatccaatgtgattacacacttactgctgtaaaggatgcgcattatgtagtttttaagtaaaaactatagtgagaattctataatcacattcacactcccctctctattgtatgaaaaatcttgttgttgttgattagataaggtggatattcactcatagttaatgtcaaatctctgcagttaaggattgaattaagccctctggtgcagtacctaatgatcaaaacattttttccaataagtttatataaccaaggataataatgatataaaaggtttttaatgttgtttttaagagcaggtactataacaaagaaggttaacactggtacagaaatatttcataaaagttatgaaaaccagataaatacagtattaaattttggagctttt

SEQ ID NO: 28280 - DNA, 472 bp, Homo sapiens
ttcagaagtttacacattacttagtcatgagctccagagtcaggattttgtgttttcaaacaccaagtagttttctccatcaaatcacttgccttgtgttcattctgtatacatattatttgtacacagatcttaaatttaaacacagatgttgaaagggatcccaaccactacggggtgtcttttccgaagctggatcttgggttcagggagatgccttaaggtcaccccttgaggaatgggagggcctccttgcacctctcctctgtggccagagcatctcagcttttgcctgtgctctgtattgggattccatttgcagaaagggttttgttgctgaaaactaaagattgaaaaccacttttctagtaaaaaccccttcattttacagacaaggaaatgcagaggcccaaggaagtgaaattttttttcatcagtaaggtgtttagaggcataaacaccttactgatga

SEQ ID NO: 28281 - DNA, 247 bp, Homo sapiens
accaggaaattgacatactacagtctttaggtttttaatttatttttatgtttcatatcaaaaagtttccattttgcagtaattcatttttattatatttgacttggcccttcctctcctaaattagcaaatgttaataagcttgtcctagtgctcatcttgaattacaagtttatttttaaaattatctgggtcaacacaattgaaagtgatttatttgtaaggtggttgctttctctggtcatac

SEQ ID NO: 28282 - DNA, 434 bp, Homo sapiens
aagatttaggggggccatgataaagaaccttataaacttctttctctttaataaagacttgtcttacatcttgctgtcattaaaggcagctgttcctagaatttaaatcacttaagtacacccacaaaacaagaatatggagatcttcatttctcctcgactttaatttgcccagttatacctcagtgttgtagcagtactttgatattacgatactttctgtactgacctgaaggagacctaacagtcctttctctttttgagtttgaatcacagccttgatgtggtatctggttttatgtccttgttcctgatgtaaaagtgattaactgcttcttggttgtgttgggtagcattgggataagattttaactgggtattcttgaattgtttttataataaaccaattttataatctttaaatttatcagctt

SEQ ID NO: 28283 - DNA, 416 bp, Homo sapiens
gcctggggccaagggctttgaatgttgactttgccacttgctagcactgtgaactttagaagcttaacttttttcttcctcggtttcttcatatttagactatggtcataatagtacttacctcttaaggtcattgtgtctcagggacactagattaattcatatatgtaaacagttagatcatgcctggacacagtggacactgggtgttggtgatcaccactattcacaatctgcagtggaatagaaaactacatgcacaaaaaccgggggctaaacatcatgtgttacagcagggaccacctctattttgttcaatcctctctcccctgtgcttatctgatgttagaacacaggagatcagcaaaaatcctgaataaatgcacatcaaatgtaaccattgactaagtgaacat

SEQ ID NO: 28284 - DNA, 850 bp, Homo sapiens
aatccccaagtttttgggaggtacatgattgtccatctagagatgacatatcccagcctcacttgcaactagttgtggccatatgactaagttcccaccaatggcatgtgagcctaagtgatgtatgtcacttctaggtcacatccttaaaagaaagttgcatgctctccctttcttctttcctctttcttgaggctggaatgcggacataatgttgggcatttaactcaatcatgtggataggacaacacccgagaggatggcaaagcaacaaaacagaaggcataagggtcctcagaccatcacaagaagcagagcagcccacctttcctgggctgcctaccagctggacttttatttgaaagacagaccatcttgtttaagccatggttacttggtacctgttacagcaactaaacaaatatcctaaatgatagatcacaaaatgcttctaaggcagttattaacggtgttcctggtgagtcttcttgggacagctgtgaattacatccttttaaaagagtacctgagaaagcaagcccaggtgatatcaccatttaagcccctcttaggctgtgtttgctgatgtcctcaaaatgcgttctcactagcttaagggtgtcttcttaggatgctgctatggaaaactccatcactgttttccagctttgcccatactcaggtaccaagaggatttcactcatgtgattcttcatttatttcactattttaggggctcttctcatgtggcagtcactgtgtcaggcgccagggaaacagcagacagcagaacagacacgagctttacactctcaggaagctgatattccagtaaggcaggaaagaccca

SEQ ID NO: 28285 - DNA, 374 bp, Homo sapiens
gagaatcacttgaacctgggaggcagaggttgcagtaagccgagatcacaccactggcactccagcctgggtgacagagtgagactccatctcaaaaaaaaaaaaacaactatcaggcataaaaagaaaccaaaaaataaaacacataagccagatatagtggtgtgtacctgtagtcccagctacttgaaagcctaagtgggaggattgcttgagcccaagagtgtaagaccagcctgggcaatatagtgagaccctatctcaaataaatagatgggtggaaagaaggaaggaaggatggatggatggatggatggatggatggatggatggatggatagatttaaaaaaataataatttaataattaattac

SEQ ID NO: 28286 - DNA, 629 bp, Homo sapiens
ggtcgactctacttcttcatgaagcagaaagcactacgagctgaaatggctgtagatttgggagagcaggaaggatctgaacgaaactacagccatttcagctcacagtgctttctacttcttcatgaagcattttctctctcaattcgactcttactctgctttgtatcatccaccctctttttatgtgtatttttaatctcatcaactggattatcaggagtaacgtatgttctcttttgcaactctcatgctctattcgtgataccttgtacatagtagcgatcaggaaaatgcaaagttgttgttgttattgttgttagagacagagtctcactgtcactcaggctggagtttagtggcatgatcatcgttcactgcagccttgaactcctgggctcaagccatccagagtagctggtagtaaggatgcgtacaaccatacctggcttatttaaaaaaaaaaatgtttgtagagatgaggtctcaccataatgaccaggttggtctcaaactcttggcctcaagtagtcctcctactttggcctcccgaagtgctagggttataggtatgagccaacacacctggctacaaagcttatatatatgtgcatacacacacacacaca

SEQ ID NO: 28287 - DNA, 716 bp, Homo sapiens
ggttcctgctcactatgcacaacatctcagaagatggcgtacaaaactatttttctaactatagcacaggtaatgtgggggtggggaggcttgggatatacctaaatgtggcaaatgatttatcttccaccttgagggatgaaaaggaaactatgcacttgaattttaattaaaattttaatttaattcattggatagcttgtgccagaaagaacagtcaatattcaagaagcaaaactgacgattagctcagtttcgggcctccctgtcgggggagttttcttgtctggaacacaaacacctacaagtagagtgtgagctggttcttgacaatcagatctcatcaaccctttgaaatgttctgggcagcacagctccttggtctgcatggttggtgtaagtataatcaagtagtgaaattgtatggtatatacctatatgccaacagtgtacacccgtatgtgcagaatttgctaatataaccatttcaataaaaacctattgaaaaagctgatttgaccacatggagtattgttggtggtgacgtgtatcactgaggactctcttggttacaaatgacagaaaacccagccaaaactggctaacacaaaagggaatgtcatggctcccaaaagccaaaatgcccaggggtgcctatgtcaggcttggtgtgatttcaccctcaaatgctgacaccaagacacatgccaactttg

SEQ ID NO: 28288 - DNA, 348 bp, Homo sapiens
caaaaaatttaaaagtgagctgggcatggtggcatgtgcccgtaatctcagctcttctgggggctgaggcgataggatggcttgagcccaggaattcagggctggagcaaactatgattgcaccactgcactccatccagcctgggcgacagagcaagcaagaccctatctctaaaaaggaaataaataaatacacataaaaaccattgcttttttttggccgggagtggtggctcatgcctgtaatcccaacactttgggaggccgaggcaggcagaacatctgaggtcaggagttcaagaccagcctggccaacatggtgaaatgtcgtctctaccaaaaatacaa

SEQ ID NO: 28289 - DNA, 344 bp, Homo sapiens
gtccatgtgctctagtactgttttcctattagggccaatttaaaaaatgaaagttatattccaaagggctgggattatgtaggagtcattgagaaaatggcatctgaggaaattgacaggtttataatggatccacatagcagagataatgttggcaggaggactgattcctgtattcccttctgcctctgctggggcttctgccagttgataagatgaggcaagattacttaataaggttcattaggtaactctacgtcacctgcctgccttgttgattgttgggatcctttgtaaccaagccaatcatttatcctgatttacttgggaccatctgaagctct

SEQ ID NO: 28290 - DNA, 463 bp, Homo sapiens
agtgataaaacatgttgaacgtaaagattcttacatattgtataggataactatgatattttcatttatgagaacgtatcctaattaggaaagtcataatgtaggtgaatgtattttaagctgccccataaaacacatcaaattggtgtataagcattgtgatttggggctaatcccattttagataatactttgtttacctaatcaagtactacacagttacacacatagttacatgtgtgtgttcatgtgtttgtgaattttcattttaatatacttgcctgtatttctggtcattcatttgcaaagcattgattgcataattatttattgtatgccacatagtcaagtcctagggacacaaatatgaagacagaagtcttcacttgtgaataactcacagtctggttggtgaaacatgtaactacttaataaaatattatgtaataaaaatggaattgtg

SEQ ID NO: 28291 - DNA, 815 bp, Homo sapiens
actcctctcatgccccacccaccacagagaagcctgcagttttgaaatgaggactccttgtcactttagaaattaagaagaattttctgggtatccatcattttacacattttgaggattcatgtttcatgcaatcccagctccctattaaaataagactcatttatagcacatagggcaacctatacttcatcacttcagcaaaaacctagtagtcaaacccaattaccatgcgtttttctggtaggacacaatttaccttttgattagagtttgaataaatccaacctttattgatgagaggcagtataatttaccttaaagcagacctatcttagctcaaattcccaccctaccatttactagcagtatggccttcggcaattttaataacttttcaaagccttagtttcctcattagtaaaaaatagtgacattaaaaaaaaatagtgacattaagagcatatatcttattaaggactaaatgaagttaatgcatataaatgacctgagacatagtaagtactgaatgaatgtcagataataacattcaaaatgaaaaaaggagctttttcctccttcgcctctttgggcatataaaaactgtttgataaatgaatgaatggaataaatgcatgtatgaatgaataaacatatgaatggtgctttcactcagagaagggcaaactatgtctgctggtgttatttatgtaacagactgtaacagcaaggtgtgctactctgtcccatcgatgtatatcctctgacagtagaaaccctgccctgtttatctttctgtatcctcacagtgctta

SEQ ID NO: 28292 - DNA, 1438 bp, Homo sapiens
tacactgatctactactgatgtcttctttcagctttgatctaaagatgtattttattaaaactataatttaaatgtaccatgaaaaatatgcagtaaaaattagttgttttctaagctagagtaggatttgtcttacaattattgtgctatgtagtttttgttttaaaaattccaatggtgtgctgctttctttggacattttattttcaattctataagagggatagatgacattgttctagaaacacatatacatcattaagagtgaatctctaaaaccaggatataaattatgctttatttctctgagaaaatcaaacaaatggaagctgttcacacctccccttctttaagcattatctaaattaatttttacttgcataatgttcttagaaaaaaaaacagaacatttaagcaggaaaaaaggaagaaacaagttgatttttaagtgcattttactataatgaatcaatgaagggaaaaggaactgcatatttcatgaaaataataagcattgtcttaatatactgttaatagaaaatgtgtcttaattctgtgcttgaatccctgcatgatatttgagactaagatctctcttatgattctaccaagaattatatctgtgtcacttaatttttttaaaagagagagatcaataactattcagagcaacatgttaaaggcaaagtttccaatcatttacatctgtatcaggtgcctcttacctttccttatttaagacaattatttgtacaagaaacacatgactcttttcatatcaatgggagggacttttctacaaagtattttccaggatgcaacccacatttaaacaatgtaaaattctttgtttcctgcaacaacttacaaaataaggtaaaagactaaaattcaaaaaaaaaaaaaaaaaaaaaaaaacaaaaaaaaaaaaaaaaaaaacaaaaaaaggaggggcacaccacataacagtgttccccacgcagggggcccccaccacatcacgacgccccccacatctactctgccaacagggggcacccactagtggaggccgcctccactccaacgacccacccccccggcgcccccgatcccacacaccccacgcccacgcgcaccccacccccaccacgccaccctcccgacgcaggaccccccacaccacgcgccgccacacaacaggcccaccacctccctcaccaacctcgaccccccccaaccggaccaccgaccaccccacaccgccacacgcgcccaccaccccacaactcgccccacgcaaaccccccgcaccgccaccccacacacctctacacaaggcccacacgcccaccccaccccacacgacccctgccccctcatcacccaaagcactcgccaccacacacccacccacccccgccacgaccaccacccgcccccgcccccccccgaacc

SEQ ID NO: 28293 - DNA, 3072 bp, Homo sapiens
  misc_feature (1541)..(1541): n is a, c, g, or t
tacactgatctactactgatgtcttctttcagctttgatctaaagatgtattttattaaaactataatttaaatgtaccatgaaaaatatgcagtaaaaattagttgttttctaagctagagtaggatttgtcttacaattattgtgctatgtagtttttgttttaaaaattccaatggtgtgctgctttctttggacattttattttcaattctataagagggatagatgacattgttctagaaacacatatacatcattaagagtgaatctctaaaaccaggatataaattatgctttatttctctgagaaaatcaaacaaatggaagctgttcacacctccccttctttaagcattatctaaattaatttttacttgcataatgttcttagaaaaaaaaacagaacatttaagcaggaaaaaaggaagaaacaagttgatttttaagtgcattttactataatgaatcaatgaagggaaaaggaactgcatatttcatgaaaataataagcattgtcttaatatactgttaatagaaaatgtgtcttaattctgtgcttgaatccctgcatgatatttgagactaagatctctcttatgattctaccaagaattatatctgtgtcacttaatttttttaaaagagagagatcaataactattcagagcaacatgttaaaggcaaagtttccaatcatttacatctgtatcaggtgcctcttacctttccttatttaagacaattatttgtacaagaaacacatgactcttttcatatcaatgggagggacttttctacaaagtattttccaggatgcaacccacatttaaacaatgtaaaattctttgtttcctgcaacaacttacaaaataaggtaaaagactaaaattcaagatttgcttccttcattgtcctaagacgattcgttgagaatcactgactttgagatatttaaaactttcagcattatactgtggtttcttttgcactgcactcacctattcaggactcctcccccaggttcctcatcatgcacaaaaatgcaaagaaaacatcttattagtaattaatgaagcaacattgaaattctaactctagctgtctttggattctaattaactcagcatcaatttctcacctcagactacagtgaatttttatttcctatcagctgaaatatttcacagatggaagctcatgtttcagttttaatgactgccttgaataaacaagttgttgccacttgtttcaaacaaaagcctaaaaataatctacattcaattttaggctccattgactaatatggtgttgcttttggaagtactgtatatcctcacatggaagccaaattgttaaattatttgaaggacacaccactgtacagaaagtagtgtttcaaatataaatcgaagaacaaagagtgctccaaaaaataggtcattcttttattttcataaagtatctaaactgtactaacattcagtgttgtgtttcattctaaatttgcagctgaaataaatttatttgcgatagcaganaatatcttattattcatcctcagaaataaaggatttgaagggatagagattatatgataaatttatagaagactttcagaatttgaatgcattttgtttagtgttatgaaatgacaataggaaaaaagtctcgacttcaattaaaagttacacaaacaaacaaatctacaggcatgtctttatataccatcaggtctaagttttcaaagaaaatggtagatataacttgcagataactcattacagtcataatctctgcccatgtgtattgagagggggcagtttgcacgaaaaagaattatgtggcccatttaataattcagctttaaatagacttgtgtcatatgcatgaatcatcagagatgaaactgtttgagagactcatgtgaccttacgaaaattacaacagcagtcttaaagtatgaaaaagatgcatcacagcagagacattatggcccagttgatatcaaatgtaaaatgtaaatgcatgtaaatgcacacttcattttatgtattatttagtaatttgcagtggtatgtgtttaatatttttgctacctacacattaggcaaaaaaaagatgtaaataatttgggagaaaaagaggaagaacagtgtaaaataaaactttctataagtactccatttcaatgtgttcaacatcatcctaaaaggcaagattttcccacgcaggtgacaaggtggtttatgtactatttaagggcggaaggtgcgtgcccgttcaataagcatgttttttgccaggtaggaaatatgttccatatctttacttatcattgcatttcagatgggaactagaaaaactggagagaaaaatgtaatgaaactgctgctgtaaattattccttttagcatgtattcacttgctaaatacacatttcttcaaaatatttgaattcagatgtctttactgttccctataacatatggtgttaaggaacataagctcataaaatgttgagaaccagagtcaggttgctacataattagctaacagatttcttcattgtagtcatctgtaaactgggttctatatttatggtgatgatgtgaatttttatgccctttaaattaagtattgttctttttaatgtcatacctaaaaaggaaatgtagggataaatttttataatgtgtcattttcataatcagtttggttttattcaggatccacaaagatgtcagatgactgttattgaaattgcttatcttaaaggtcacagacaagcattttattaatatggagccactagtataatatgttaaaatctttgttttattagctcattttaaaacacaatttccattcaatttaatgaaactgtatcaggtttcatggtttcaaagacagacttaaataggattcaacacccccgtatcgtgtaataacatgttaaactggtctaacaccaaggacatctatacttttaacttgatttgtaataattatttgaagtcaatgttaatgtttgcaaatacatgtttccataaagaagaaaacattattttt

SEQ ID NO: 28294 - DNA, 1475 bp, Homo sapiens
tacactgatctactactgatgtcttctttcagctttgatctaaagatgtattttattaaaactataatttaaatgtaccatgaaaaatatgcagtaaaaattagttgttttctaagctagagtaggatttgtcttacaattattgtgctatgtagtttttgttttaaaaattccaatggtgtgctgctttctttggacattttattttcaattctataagagggatagatgacattgttctagaaacacatatacatcattaagagtgaatctctaaaaccaggatataaattatgctttatttctctgagaaaatcaaacaaatggaagctgttcacacctccccttctttaagcattatctaaattaatttttacttgcataatgttcttagaaaaaaaaacagaacatttaagcaggaaaaaaggaagaaacaagttgatttttaagtgcattttactataatgaatcaatgaagggaaaaggaactgcatatttcatgaaaataataagcattgtcttaatatactgttaatagaaaatgtgtcttaattctgtgcttgaatccctgcatgatatttgagactaagatctctcttatgattctaccaagaattatatctgtgtcacttaatttttttaaaagagagagatcaataactattcagagcaacatgttaaaggcaaagtttccaatcatttacatctgtatcaggtgcctcttacctttccttatttaagacaattatttgtacaagaaacacatgactcttttcatatcaatgggagggacttttctacaaagtattttccaggatgcaacccacatttaaacaatgtaaaattctttgtttcctgcaacaacttacaaaataaggtaaaagactaaaattcaagatttgcttccttcattgtcctaagacgattcgttgagaatcactgactttgagatatttaaaactttcagcattatactgtggtttcttttgcactgcactcacctattcaggactcctcccccaggttcctcatcatgcacaaaaatgcaaagaaaacatcttattagtaattaatgaagcaacattgaaattctaactctagctgtctttggattctaattaactcagcatcaatttctcacctcagactacagtgaatttttatttcctatcagctgaaatatttcacagatggaagctcatgtttcagttttaatgactgccttgaataaacaagttgttgccacttgtttcaaacaaaagcctaaaaataatctacattcaattttaggctccattgactaatatggtgttgcttttggaagtactgtatatcctcacatggaagccaaattgttaaattatttgaaggacacaccactgtacagaaagtagtgtttcaaatataaatcgaagaacaaagagtgctccaaaaaataggtcattcttttattttcataaagtatctaaactgta

SEQ ID NO: 28295 - DNA, 1046 bp, Homo sapiens
ctcaccctcgacacccacctgcacagccactgtctgcccaaaggtacccactgagtctggggatcccgtgcgggacccgggtgcatgagatcagccagaatcagcaggtgtgcgctgtgcagaccaaaacacaatcagttacccctggagcaggaaggcagctctgccttcccttaggctttttgttgttgttgtttgagacggagtctggctctgtcattcaggctagaatgcagtggcatgatcttggctcactgcaacctccacttcctgggttcaagcgattgtcctgcctcagcctcctgagtacctggtattacaggcacccaccaccacgcctggctaatttttgtatttttagtagagacaggtttcgccatgttggccaggctggtctcgaacttctgacctcaagtgatctgtcctcagcctcccagagtgctgggattacaggcgtgagctacttgcccggcctattcccttgggcttttaaaaagcgtcttggatggaggtggtgcaggtgctcaccaagcccgcaggtaacccaagttgcatgtatccccagggcacttttgtgattcccctgcttgtgactgcacaccgggaccccactcaattcaaagacccagactgcttcaaccctaccaacttcctggacaagggcaagttccaggacaatgatgctttcatgccctttgcctcaggtgcaggcagaggaggaaggggaccagcctggactggctctggggtacctggtgctcactgtgcacctgtgtacccggcaaagcagatgtgcctgggcacaggcctggcccactcgggtatcttcctattccttacggccaccttacagaggttctgcctgctccctgtggtacgccctggcaccatcaacctcacctgcagtgcactggcctgggcagtgtccccccagacttccagctccagccagtggcctgctgaggtcaggctccactatggtgggctcactggccctcaaacctccataccctcctcggtcaataaaggccctaaattgcagatgg

SEQ ID NO: 28296 - DNA, 118 bp, Homo sapiens
ataattccctcacaaccagtgttaatacctcactgcgtatcttttacatgttcttttctctgtgtgtgcacacatggcatctatcatctgtttgaacaaaaatgagatcataataggt

SEQ ID NO: 28297 - DNA, 375 bp, Homo sapiens
tagaacccacagatacagagggccggctatcttatttgagatttgggattagttatatgcctgcaagctcatggcagcaaactggctgaagagtggcatggcttaggccccattctgtgcccatgagatccttccctcatctccctgtgctcagcactggcttctcaccatgggtagcaaaaggacctccaggatggcgctagaggaagcgcccctcagacaaccttccctcacatcccccatacagggagcaacaggcagatggggccattggcacacctcaggctgagctctggcagggccctgccaacctggggaaaccaacaaacaaaccaggcatgtgtgtgcctgcctggcagctccctctcacctgga

SEQ ID NO: 28298 - DNA, 431 bp, Homo sapiens
ctcccaacggacagggattacaggcgtgagtcactgtgcctgactacactttctttagtacaggatataaccaacatcttgcctcctaagagtcaggggcaggagtataggtgattgtacttcaggtagaggaaagatctcattcacagaggaggggagagtagattttgttggcatatagtggcaaattttattaaggctctgggaaaagtgctgatgacattgggaaaagattcagtttttacccagtaaaatattaaaaacttattttgcttaaggccatgtcctctaattactgaaggggctgatttttttttttttttaaatcatcagtcataatagcacctattgaagggcttactgtatgccaattactgattaggacactttacaagcacttatagtattaatttttatagcaaccatatgag

SEQ ID NO: 28299 - DNA, 262 bp, Homo sapiens
aggcttttactcctgagagacagaagactagaaatttagtcctgacttagagttctaaaacaatactttattgaacatcattttattgaccttggtcaggtcctttcgcctctcagaacatttgtctccccccgtctgttccagttcttagaacagtaaacacagaccacgagaaactactccagtatttaatagtaaagcaagcaatctgtcacgcagggctttgccttgccctgtctccctcttatctgacctcgttttc

SEQ ID NO: 28300 - DNA, 422 bp, Homo sapiens
aaactcctttcttgaggggaggaggggttggggaggctttgttggtagttacagtctttcataccttattaagcttaaaatcctgactctggatgacataggctggaaatacttctcttagggtccataataacaaagatgtgagtaacattgaaatctaaattaatttattttaaaacatagtactggccaggcgcagtgactcatgcctgtaatcccagcactttgggaggccgaggcaggcggatcacgaggtcgggagatcgagaccatggtgaaagcccgtctctactaaaaatacaaaaattagccgggtgtggtggtgggtgcctgtagtcccagctgcttgggaggctgaggcaggagaatggcgtgaacccaggaggcagagcttgcagtgagctgagatcgcgccactgcac

SEQ ID NO: 28301 - DNA, 439 bp, Homo sapiens
ccagcactttgggatgccaaggtgggtgaatcacgaggtcaggagatcgagaccatcctggctaacacagtgaaaccctgtctctactaaaaatacaaaaaattaagccacccgagtagctgggactactcggctggctgatttttaaatggtttgtacagatgggggtctcactatgttgcctaggctgatcccgaactcctgggctcaagtgatcctcctgcctcagcctcccaaagtgctggaatgaaccaccatgcccagcccatccataaatttctttttttcaaatatcaccctaggaggcctggcatggtggctcatgcctgtaatcccagcaccttgggaggccaaggcgggtggatcaccaggtcaggagatggagaccatcctggctaacacagtgaaaccccttctctactaaaaatacaaaaaaaaa

SEQ ID NO: 28302 - DNA, 329 bp, Homo sapiens
ttaaaaaatatatgctcattataagaattttaggtaatagagaaatgcataaacatagaaaaccattgtaaacagattttcatttagatgaacatgcatacattttaaatggaccaatcctctattggttgcgtttttgctatataatttataattaatgtctttcatcataaaactaggtcatcattattaagggttgcataatattgatctgtgtggatagaatgtaagttttttaaacaatcccataatgaacatttatgtccaattttttagacttaaaaaaattattgtggaaagaatatgtaacatgagatctatcctctgaa

SEQ ID NO: 28303 - DNA, 373 bp, Homo sapiens
cttcagcaatgtactcaagaacatgccaaagaaattccaaggtttttgctacagttagtttctccagcagctattttggataactcacctgcatttttaaatgtggtagagacaaatccttttaagcatcttacacacctctcactaaaacttttacctggaaatgatgtggagataaagaaatttctcgcaggctgtttgaaatgtagcaaggaagaaaaattatcattgatgcaatcactagatgatgctactaagcaactggactttacacgaaagacattagcagaaaaaaaacaagaattagataagttacggaatgaatgggcgtcacatacagcagccttgacaaacaagcattctcaggaactga

SEQ ID NO: 28304 - DNA, 849 bp, Homo sapiens
gacgcactactttctagttagtttaccgcacctgcctgttacctgcaggcccgagggtgtgtgcttctgtggcctgtgtgggatggcaccccttccagccttacccactcagctcagttggcctggttggaatgggccctgggaggagtgtttgcactgtggaaattggtaaatgcttcaaatcagggtggtttttaattttgcttttgttttcttctgaagagaaggttgttaaacaccagcacagtgctgcaccaggcagccagcatataatcatgagaaataagtagttgtttaagccactgcatttggggtggtttattacatagtaatgataaccatatcatggcccttgaaggcccagcatgtatgacccctgcctccacccctcagaaaacctcttctccctacctgcttctcctggagcccctcaggtgttcctctgcttctccaccgaaccagctaattctcacaaacagcccctcaggtaccagcccctccctctgcagcctctcctcattcagctcctgcagggctgcccccaccccgccagccagtctagtttccccccagcacctgtcactatcggaaaggaaacatctgtttaccgtttgtctccccctctcaaaaaaatagagcagggatcttgcctgtctgcccactgttgtttatttgtctgaaatgtttggccccagggcagcatctactgatcactgaccagttggctactgaacggtgaaggtctgatgagctgatgagccgtcccctgggcttgaaatctttcccgcggcacaaacaggcgccccttcctctgtcgctcacttttcacggttgtctccttctgaggcg

SEQ ID NO: 28305 - DNA, 525 bp, Homo sapiens
gagagtgcaggcgctgaggacagcgacgatcccgagacgagacccaacggcgagaaaggagagagcaagagatgccatggactacaaggtgatgaataccactatgagctcactacaagatctcaaagatttcaagccactggctgttacaaagcataaagccacccttctggagcagcggcgggaggcaggctgggaggaggccccaagttttggccagacgatagaccacctccttaggtgtccggggagctgctgaaacataatgaggaagatgctgctgatccaaaggataaaaacacagaaactagaaccaagaagcacctaaagtggactcatgcccagcatccctgcagactgactttctctgagctatagttctgcattggactgtttttcctttgctatcacctgcccaacacacaatcctggatgcttttgattggttggatttctttttttttttcctgccttttctttttctttccttgaccctgggaattataaacgagaaattgctttaaa

SEQ ID NO: 28306 - DNA, 1999 bp, Homo sapiens
atctcaaactcctgggctcaagcaatctgcccattttagcctcctaaaatgctgggattataggagtgtattagtctattctcatgctgctaataaagatacctaagactgggtaattcacaaaggaaagaggcttaactgacgcacatttccacgtggccagggaggcctcacaatcatggtggaaggcaaatgagaagcaaagtcatgtcttacatggcggcaggcaagagagcttgtgcagggaaactcccatttataaaaccaccagagctcatgaaacttattcactaccatgagaatagtatgggggaaatcgttcccatgactcaagtatctccacctggccctgcccttgtcacatgggggttattacaattcaaggtgacacttgtgtggagacacagccaaaccatatcacaggcatgagctaccacgcccgccagcatgtcttttttaaacattttaaaatctattctttatcttgtttcagagaggatttggagttacagaaacacattagactgggcatggtggctcacacttgtaatcccagcacttcaggaggtttctcctagtgtactctcacacttctgataccagatatgtgggggagggggtttcccccacacattaagcaagtgtgaaacatgatatagaaaaatgacttcactctgggccgggtgtagtggctcacgcctgtaatcctagcactttgggaagccgaggtgggcagatcacccgaggtcaggagttcgagaccagcctggccaacatggcaaaaccttgtctctactaaaaatagaaaaattagttgggggtagtggcagccgcctgtggtcccagctattcgagaggctgaggcaggagaactggttgaaccggggaggcagaggttgcagtgagccaagatcatgccactgcactctagcctgggtgacagagtgaaactctgcctcaaaaaataaaataaaggccaggcatggtggctcacgcctataatcccagcactttcagaggccaaggcaggtgggtcacaaggtcaagagtttgagactagccttagcaacatggtgaaggtgaaccccgactctactaaaaatacaaaaattggctgggcctggtggtgtgcacctgtaatcccagctacttaggaggctgaggcaggagaatcgcttggacccgggagacataggttgcagtgagccgagactgcaccactgcactccagcctaggtgacagagtgagactccatcttaaaaaataaataaataaaataaaataaatgacatcactttggttcagagctctaaaatggagggaggaagccattctaaaaaggactccctacatgacctgcaacttgaaaaaaaattaaaagctccaaaaaaaaaaacaatacaggagcttaccttgaacctttgaattgggccaaattgcgatgaccactgcatcctggaaaattttatttcaccagcactacaactcctcaacagcaccaaccaataaactatggatttttgtactaagccagttgcctctttcaaaacaacttgtcaacttgtctaatcaccctcagctttttttaaaaacccctcctctaccctctctcttcagaacacaagtggcttctagctgaatctgtctcccaaattgcaattcctaagacctcaataaaaacaccttgtcttgctaaaaaaaaaaaaaaaaaaaaaaaaaaaaaaaaaaaaaaaaaagctaacaaaaaaccaaaacaaaacaacaacacaaaacaaaaaaaaaagagagggggggcgggcataaaagatctgcccgggtggggcacagatgatgaaacacacccacatttttcgcagacaagaaggcccccacaagagaagacgcattaaagaaggacacgagaggcgcagtaaaaacacgcggcggacggcaacacagcgatcgaggacgattcaggggaacacaccaccgtcgggcggggcaccagggcaaacctga

SEQ ID NO: 28307 - DNA, 1547 bp, Homo sapiens
atctcaaactcctgggctcaagcaatctgcccattttagcctcctaaaatgctgggattataggagtgtattagtctattctcatgctgctaataaagatacctaagactgggtaattcacaaaggaaagaggcttaactgacgcacatttccacgtggccagggaggcctcacaatcatggtggaaggcaaatgagaagcaaagtcatgtcttacatggcggcaggcaagagagcttgtgcagggaaactcccatttataaaaccaccagagctcatgaaacttattcactaccatgagaatagtatgggggaaatcgttcccatgactcaagtatctccacctggccctgcccttgtcacatgggggttattacaattcaaggtgacacttgtgtggagacacagccaaaccatatcacaggcatgagctaccacgcccgccagcatgtcttttttaaacattttaaaatctattctttatcttgtttcagagaggatttggagttacagaaacacattagactgggcatggtggctcacgcctataatcccagcactttcagaggccaaggcaggtgggtcacaaggtcaagagtttgagactagccttagcaacatggtgaaggtgaaccccgactctactaaaaatacaaaaattggctgggcctggtggtgtgcacctgtaatcccagctacttaggaggctgaggcaggagaatcgcttggacccgggagacataggttgcagtgagccgagactgcaccactgcactccagcctaggtgacagagtgagactccatcttaaaaaataaataaataaaataaaataaatgacatcactttggttcagagctctaaaatggagggaggaagccattctaaaaaggactccctacatgacctgcaacttgaaaaaaaattaaaagctccaaaaaaaaaaacaatacaggagcttaccttgaacctttgaattgggccaaattgcgatgaccactgcatcctggaaaattttatttcaccagcactacaactcctcaacagcaccaaccaataaactatggatttttgtactaagccagttgcctctttcaaaacaacttgtcaacttgtctaatcaccctcagctttttttaaaaacccctcctctaccctctctcttcagaacacaagtggcttctagctgaatctgtctcccaaattgcaattcctaagacctcaataaaaacaccttgtcttgctaaaaaaaaaaaaaaaaaaaaaaaaaaaaaaaaaaaaaaaaaagctaacaaaaaaccaaaacaaaacaacaacacaaaacaaaaaaaaaagagagggggggcgggcataaaagatctgcccgggtggggcacagatgatgaaacacacccacatttttcgcagacaagaaggcccccacaagagaagacgcattaaagaaggacacgagaggcgcagtaaaaacacgcggcggacggcaacacagcgatcgaggacgattcaggggaacacaccaccgtcgggcggggcaccagggcaaacctga

SEQ ID NO: 28308 - DNA, 1707 bp, Homo sapiens
atctcaaactcctgggctcaagcaatctgcccattttagcctcctaaaatgctgggattataggagtgtattagtctattctcatgctgctaataaagatacctaagactgggtaattcacaaaggaaagaggcttaactgacgcacatttccacgtggccagggaggcctcacaatcatggtggaaggcaaatgagaagcaaagtcatgtcttacatggcggcaggcaagagagcttgtgcagggaaactcccatttataaaaccaccagagctcatgaaacttattcactaccatgagaatagtatgggggaaatcgttcccatgactcaagtatctccacctggccctgcccttgtcacatgggggttattacaattcaaggtgacacttgtgtggagacacagccaaaccatatcacaggcatgagctaccacgcccgccagcatgtcttttttaaacattttaaaatctattctttatcttgtttcagagaggatttggagttacagaaacacattagactgggcatggtggctcacacttgtaatcccagcacttcaggaggtttctcctagtgtactctcacacttctgataccagatatgtgggggagggggtttcccccacacattaagcaagtgtgaaacatgatcatggctcactgcagcctggacctcccaggctcaagtgatccttccacctcagcctcccgaatagctgggattgcagatgcgctccatcctgcccagctaatttttttttggttggtttttggttttttgagacaagtctccttctgtcgcccaggctggagtgcaatggcacaatcttggctccctgcaacctctgcctcctggaggaggctgaggcaggagaatcgcttggacccgggagacataggttgcagtgagccgagactgcaccactgcactccagcctaggtgacagagtgagactccatcttaaaaaataaataaataaaataaaataaatgacatcactttggttcagagctctaaaatggagggaggaagccattctaaaaaggactccctacatgacctgcaacttgaaaaaaaattaaaagctccaaaaaaaaaaacaatacaggagcttaccttgaacctttgaattgggccaaattgcgatgaccactgcatcctggaaaattttatttcaccagcactacaactcctcaacagcaccaaccaataaactatggatttttgtactaagccagttgcctctttcaaaacaacttgtcaacttgtctaatcaccctcagctttttttaaaaacccctcctctaccctctctcttcagaacacaagtggcttctagctgaatctgtctcccaaattgcaattcctaagacctcaataaaaacaccttgtcttgctaaaaaaaaaaaaaaaaaaaaaaaaaaaaaaaaaaaaaaaaaagctaacaaaaaaccaaaacaaaacaacaacacaaaacaaaaaaaaaagagagggggggcgggcataaaagatctgcccgggtggggcacagatgatgaaacacacccacatttttcgcagacaagaaggcccccacaagagaagacgcattaaagaaggacacgagaggcgcagtaaaaacacgcggcggacggcaacacagcgatcgaggacgattcaggggaacacaccaccgtcgggcggggcaccagggcaaacctga

SEQ ID NO: 28309 - DNA, 955 bp, Homo sapiens
gttttttgagacaagtctccttctatcgcccaggctggagtgcaatggcacaatcttggctccctgcaacctctgcctcctgggttgaagagattctcctgcctcagcaggaggctgaggcaggagaatcgcttggacccgggagacataggttgcagtgagccgagactgcaccactgcactccagcctaggtgacagagtgagactccatcttaaaaaataaataaataaaataaaataaatgacatcactttggttcagagctctaaaatggagggaggaagccattctaaaaaggactccctacatgacctgcaacttgaaaaaaaattaaaagctccaaaaaaaaaaacaatacaggagcttaccttgaacctttgaattgggccaaattgcgatgaccactgcatcctggaaaattttatttcaccagcactacaactcctcaacagcaccaaccaataaactatggatttttgtactaagccagttgcctctttcaaaacaacttgtcaacttgtctaatcaccctcagctttttttaaaaacccctcctctaccctctctcttcagaacacaagtggcttctagctgaatctgtctcccaaattgcaattcctaagacctcaataaaaacaccttgtcttgctaaaaaaaaaaaaaaaaaaaaaaaaaaaaaaaaaaaaaaaaaagctaacaaaaaaccaaaacaaaacaacaacacaaaacaaaaaaaaaagagagggggggcgggcataaaagatctgcccgggtggggcacagatgatgaaacacacccacatttttcgcagacaagaaggcccccacaagagaagacgcattaaagaaggacacgagaggcgcagtaaaaacacgcggcggacggcaacacagcgatcgaggacgattcaggggaacacaccaccgtcgggcggggcaccagggcaaacctga

SEQ ID NO: 28310 - DNA, 471 bp, Homo sapiens
cccttttaaagatggatgaggcctcggttcaatgagggccccaggcaggggacggccacacccaggtaaacgctgcatttctacaacagccacctgtgcaggccctgcatgctctgtaacctggggatttggtcttctgaaaagggcaccagagaaaaactgctcttaagcctctgttaactgacacagcagtagaactccaaggtgttgatccttggattcatgtttctcaacttcagagacacacatcactccttcctgaccactgggcatccatcccaccaggagctcctaatctgagagctgttagaaatcctccaaaagtgctgactgcagaagttggtagcttctgctcaagatgacagaacaagattaacttttgtattcttcagcaccttttttattttccattatcacactttgataccctctaaaacattaaaacaccttctagaatgcttatgtgatcaa

SEQ ID NO: 28311 - DNA, 485 bp, Homo sapiens
atgacacagcaagaaggccctcaccagatgctgagcagatgccggcaccatgcctgtggacttcccagcctccagaactgtaaacgctgcatttctacaacagccacctgtgcaggccctgcatgctctgtaacctggggatttggtcttctgaaaagggcaccagagaaaaactgctcttaagcctctgttaactgacacagcagtagaactccaaggtgttgatccttggattcatgtttctcaacttcagagacacacatcactccttcctgaccactgggcatccatcccaccaggagctcctaatctgagagctgttagaaatcctccaaaagtgctgactgcagaagttggtagcttctgctcaagatgacagaacaagattaacttttgtattcttcagcaccttttttattttccattatcacactttgataccctctaaaacattaaaacaccttctagaatgcttatgtgatcaa

SEQ ID NO: 28312 - DNA, 438 bp, Homo sapiens
ttttgtaggttcatccacataaaacttatttcacagtagctgaaaaagggagttttccagatattatcatctatgaatatccttctctgagaccatacagagtccttcgaggtgagtccagaagcatatttaaatatttcatgttcaaggataacaacattctgaagaaggtgtgacattatttcataagtcaaggttctccagagaaacagaactagtggaagacagaaaagagatttattcaaattcacacacaacaatactaaccttaaatgtaaatgggctaaatgccccaattaaaagacacagactggcaaattggataaggagtcaagacccattggtgtgctgtaattctggagacccatcttacctgcaaagacacacacaggctcaaaacaaaggaatggaggaaaatttaccaagtaaatggaaagg

SEQ ID NO: 28313 - DNA, 379 bp, Homo sapiens
gggatgtcaagatcattgacagacttgtgaggtgaaagaaagttttagtgaaactgaaaggacgggacgcagattggattgggtgcaaaatacagtaatgagataaagtggaaacaatgggtttgactggctttttagagaagtattgtaaaaagagggtaaatgaatctatgtacttgtaatcccagcactttgagaggctaaggtgggtggtttgcttgagcccaggagttcaagaccagcctgggcaacatggcgaaaccccatctctaccaaaaatagatgaaaattagccaggcatggtggtgcacacctgtagttccagctgcttgggaagctgaggtaggattgcttaactctgggaggtggaggtctcagc

SEQ ID NO: 28314 - DNA, 1715 bp, Homo sapiens
atgtatttgaggacctgctttggttccggtactgtcaagactcagggataccagaatgaatgataccttgtctgaaatagctcacaatctagtggggaaaatgaacatatgaaaataacaaagaaatattacttaaagtgcatttctaggcatacaccagatgttacgagaatacagtgaagcgtcacccaacacagtaagggaggagggccataagatcattccaagctgagagcctggtgtaaacaaaggcacagagggaagaaatcttagagtggaggtgaggaactgaaagtggtttccagtctcctaaatgtttagaggatcccaagaagtagtaagagattaagctaaagaggcagtcagagggcagaacacagatataacgttgcctaggaggctgacaaatgtgactttatcctaaggatagcaaggagttattgaagagtgctcagtagaaaagtggcatatatttgcttttataagaatacacttttcaggtattatgtaaaagatgatttgggatggagaccagggacctaaaaagacagtccaggcaaaagattagacctgaactagaggagtcatagtagggatagaggggaagaaaaatgtttaagaaacatattggaagtagaactggaaaaactgtgattgatcccaagtagaagatgagggacagagaagaaataggatgattcccaggtttcttttttaggcatctaggtagctgatgatgccatcatcttaggcaaggtttactttaggaggaacagagttggagatgttgagctccgttagggatataatgagttttaggagcctgtggacatccagttaaagaataaatgagagaacattcacatagaacaaaggtgtggtggaggctctcaccagcttaacctagagtccattccaacctgcaaactgctggttgtccccagtccagatgatgctgaactctttggcctggctgaactcttttgtccagtcacatgtcacactggacaggaagtggcttggaactcgaaaccttgttgatacacttttcctcccaaagaggtgatccaaattcctgagatggcccgacctaggatgtactgaaagaggctttgggcagtaacttctaaactgagaatgacttgtggctaaacttgaacccttgccttccagtagatgaaaggtgaagcaatttatctctcgaaagaaaaaatatggtatgattccacttatttgaggtaacagcaagacactgtctcaaaaaaaaaaaaaagaagaaaagaaaggaaggagaggaggagaggggaggggattattattattaataataataccattgttatgcataaataatataatttattgagtattcactatatgcaaagtactgtgctaaatactttacaataattccatataattctctcaacagccctgtgaggttgggctacttattatccccattttacaaaaagcacctccagatagtgtaacttgccagaagtcccatagctagtagctgaaggacagagcatttgaaccaagaccatctgattccagatctcttgttcctagcagtttactaaagcttcccaatccatgtgctggggcacactgatgggttagggataggttacagataggctactgacctcttcagtccttgggggagccgcagcccacagtgagtgacctctgccagccttacccatttt

SEQ ID NO: 28315 - DNA, 477 bp, Homo sapiens
ctaccatgcagggctccttcctccccgccccaccaccgccagtggcaattctcacacacatactccatcctgcattctttcatcgcagtcctgtgggccggttctcaccttcacatctttgctttcctgctttcctcaccttggaatgccccctaggtcctgtccaccaggaagctctggcctcatttggccacagcctagagtcttgggccttcttgcagttactccctcctaaagtgctctcctgtgttctgtggtctcaggcacttccttttttgtcacaaggcctcagtttcgtcatctgagaaatgggaagggttagacacaaatctctctcgtggtggaaaaagcttgtgctttggagtcatatggagctgaattccatccaatccacttagttccttaacttttatgagcctcaccttcctcatctgttagatggggtcttataaaaacagacagcacacactgcggtga

SEQ ID NO: 28316 - DNA, 276 bp, Homo sapiens
tgaataggaagggtggagcatatcagtgttcatgtcctgtttctgattttatactatagctttgtaagatgttaccattgagagaaactgcataaagaacacacaggaatcttaaaacttaaaactgcataggaatctataattatctcaaagaggtttaattttaaaaggagggagcccttaaaattactgtatctcctctaaagtgtgatttaatggctgcgtttttcataatattatttaaagatagtaaagcatctttaaaaaattaatcca

SEQ ID NO: 28317 - DNA, 486 bp, Homo sapiens
caggacatgggttctgagtgtataaaggacacaattcctgagtgatccctgtgggcgagtccggaaaaagtcatttgtcctggggcgccccctgctggccacagacaaaaacggcgtccccagagctcaggcctgcctgggtagacagaggctcagagagcctgcgcagacctgcctctttaggcctggggacctccatgctggccagcattcctcgggggcatggtcagatggcagcccagaggagaggtcaagtcctgcagcctctgacggcacccagctgctgtacacagaaatgtgtccaagatattttctcttctccctcttggcatcaggctccaagggttggagccttggcccaccgcaaaatgactggaactgtctgggcaaatcccttcacttcctcaaggtgctgcttggccctgtaaaatagggttgaagtgcttgctgacttcgcaggtagcctgcgacagatcgtaataggtg

SEQ ID NO: 28318 - DNA, 353 bp, Homo sapiens
tcgaccatgatcataggtcattgcagcctcgacatcctggtctcgagtgatcttcccacgtcagcttcccaggtagctgggactacaggcgcacgccaccatgcttggctaatttttgtatttttagtagagacagggtttcaccatgttggccaggatggtctcgatttcttgacatcatgatccaccagtctcagcctcccaaagtgctgggattacaggcgtgagccacggcacctggcttgaatctggcctttgaatcagatccctcctgaagctggcattgccctttccagaacttcagagcaacgtgatgcctaaagtcctcgtcgacgcggccgcgaatttagtag

SEQ ID NO: 28319 - DNA, 366 bp, Homo sapiens
gtctctgtattcagagggtgaaaagctaaaaattcatttttcagattcccttgcaactagagtgctggggtatgacctgggcctgccggttcacatgccatgtatgagacagggaggcataagtgcacaacatggggcagaaactgaatttggggagatgaatgttctgccaaacagagcagctgaagtatctggtcctgacacagctgtggcagagtttttggctccaggctcaagttaaaagtgcaaggcaggaggtagcagtggtagtctttccactattaccatcctgagttatggctgggcatttctttttgctgcatcattgcttctggctatttggcatccaagcctggttgctggcac

SEQ ID NO: 28320 - DNA, 2055 bp, Homo sapiens
gcggccgcgagtaaagtttgcaaagaggcgcgggaggcggcagccgcagcgaggaggcggcggggaagaagcgcagtctccgggttgggggcgggggcggggggggcgccaaggagccgggtggggggcggcggccagcatgcggccccgcagcgccctgccccgcctgctgctgccgctgctgctgctgcccgccgccgggccggcccagttccacggggagaagggcatctccatcccggaccacggcttctgccagcccatctccatcccgctgtgcacggacatcgcctacaaccagaccatcatgcccaaccttctgggccacacgaaccaggaggacgcaggcctagaggtgcaccagttctatccgctggtgaaggtgcagtgctcgcccgaactgcgcttcttcctgtgctccatgtacgcacccgtgtgcaccgtgctggaacaggccatcccgccgtgccgctctatctgtgagcgcgcgcgccagggctgcgaagccctcatgaacaagttcggttttcagtggcccgagcgcctgcgctgcgagcacttcccgcgccacggcgccgagcagatctgcgtcggccagaaccactccgaggacggagctcccgcgctactcaccaccgcgccgccgccgggactgcagccgggtgccgggggcaccccgggtggcccgggcggcggcggcgctcccccgcgctacgccacgctggagcaccccttccactgcccgcgcgtcctcaaggtgccatcctatctcagctacaagtttctgggcgagcgtgattgtgctgcgccctgcgaacctgcgcggcccgatggttccatgttcttctcacaggaggagacgcgtttcgcgcgcctctggatcctcacctggtcggtgctgtgctgcgcttccaccttcttcactgtcaccacgtacttggtagacatgcagcgcttccgctacccagagcggcctatcatttttctgtcgggctgctacaccatggtgtcggtggcctacatcgcgggcttcgtgctccaggagcgcgtggtgtgcaacgagcgcttctccgaggacggttaccgcacggtggtgcagggcaccaagaaggagggctgcaccatcctcttcatgatgctctacttcttcagcatggccagctccatctggtgggtcatcctgtcgctcacctggttcctggcagccggcatgaagtggggccacgaggccatcgaggccaactctcagtacttccacctggccgcctgggccgtgccggccgtcaagaccatcaccatcctggccatgggccagatcgacggcgacctgctgagcggcgtgtgcttcgtaggcctcaacagcctggacccgctgcggggcttcgtgctagcgccgctcttcgtgtacctgttcatcggcacgtccttcctcctggccggcttcgtgtcgctcttccgcatccgcaccatcatgaagcacgacggcaccaagaccgaaaagctggagcggctcatggtgcgcatcggcgtcttctccgtgctctacacagtgcccgccaccatcgtcatcgcttgctacttctacgagcaggccttccgcgagcactgggagcgctcgtgggtgagccagcactgcaagagcctggccatcccgtgcccggcgcactacacgccgcgcatgtcgcccgacttcacggtctacatgatcaaatacctcatgacgctcatcgtgggcatcacgtcgggcttctggatctggtcgggcaagacgctgcactcgtggaggaagttctacactcgcctcaccaacagccgacacggtgagaccaccgtgtgagggacgcccccaggccggaaccgcgcggcgctttcctccgcccggggtggggcccctacagactccgtattttatttttttaaataaaaaacgatcgaaaccatttcacttttaggttgctttttaaaagagaactctctgcccaacacccccacaaggtttgtaattaaaactgtaaatagtcaaaaaaaaaataattatatatattttctatttaa

SEQ ID NO: 28321 - DNA, 1939 bp, Homo sapiens
gcggccgcgagtaaagtttgcaaagaggcgcgggaggcggcagccgcagcgaggaggcggcggggaagaagcgcagtctccgggttgggggcgggggcggggggggcgccaaggagccgggtggggggcggcggccagcatgcggccccgcagcgccctgccccgcctgctgctgccgctgctgctgctgcccgccgccgggccggcccagttccacggggagaagggcatctccatcccggaccacggcttctgccagcccatctccatcccgctgtgcacggacatcgcctacaaccagaccatcatgcccaaccttctgggccacacgaaccaggaggacgcaggcctagaggtgcaccagttctatccgctggtgaaggtgcagtgctcgcccgaactgcgcttcttcctgtgctccatgtacgcacccgtgtgcaccgtgctggaacaggccatcccgccgtgccgctctatctgtgagcgcgcgcgccagggctgcgaagccctcatgaacaagttcggttttcagtggcccgagcgcctgcgctgcgagcacttcccgcgccacggcgccgagcagatctgcgtcggccagaaccactccgaggacggagctcccgcgctactcaccaccgcgccgccgccgggactgcagccgggtgccgggggcaccccgggtggcccgggcggcggcggcgctcccccgcgctacgccacgctggagcaccccttccactgcccgcgcgtcctcaaggtgccatcctatctcagctacaagtttctgggcgagcgtgattgtgctgcgccctgcgaacctgcgcggcccgatggttccatgttcttctcacaggaggagacgcgtttcgcgcgcctctggatcctcacctggtcggtgctgtgctgcgcttccaccttcttcactgtcaccacgtacttggtagacatgcagcgcttccgctacccagagcggcctatcatttttctgtcgggctgctacaccatggtgtcggtggcctacatcgcgggcttcgtgctccaggagcgcgtggtgtgcaacgagcgcttctccgaggacggttaccgcacggtggtgcagggcaccaagaaggagggctgcaccatcctcttcatgatgctctacttcttcagcatggccagctccatctggtgggtcatcctgtcgctcacctggttcctggcagccggcatgaagtggggccacgaggccatcgaggccaactctcagtacttccacctggccgcctgggccgtgccggccgtcaagaccatcaccatcctggccatgggccagatcgacggcgacctgctgagcggcgtgtgcttcgtaggcctcaacagcctggacccgctgcggggcttcgtgctagcgccgctcttcgtgtacctgttcatcggcacgtccttcctcctggccggcttcgtgtcgctcttccgcatccgcaccatcatgaagcacgacggcaccaagaccgaaaagctggagcggctcatggtgcgcatcggcgtcttctccgtgctctacacagtgcccgccaccatcgtcatcgcttgctacttctacgagcaggccttccgcgagcactgggagcgctcgtgggtgagccagcactgcaagagcctggccatcccgtgcccggcgcactacacgccgcgcatgtcgcccgacttcacggtctacatgatcaaatacctcatgacgctcatcgtgggcatcacgtcgggcttctggatctggtcgggcaagacgctgcactcgtggaggaagttctacactcgcctcaccaacagccgacacggtgagaccaccgtgtgagggacgcccccaggccggaaccgcgcggcgctttcctccgcccggggtggggcccctacagactccgtattttatttttttaaataaaaaacgatcgaaacc

SEQ ID NO: 28322 - DNA, 908 bp, Homo sapiens
gcggccgcgagtaaagtttgcaaagaggcgcgggaggcggcagccgggccggcccagttccacggggagaagggcatctccatcccggaccacggcttctgccagcccatctccatcccgctgtgcacggacatcgcctacaaccagaccatcctggccatgggccagatcgacggcgacctgctgagcggcgtgtgcttcgtaggcctcaacagcctggacccgctgcggggcttcgtgctagcgccgctcttcgtgtacctgttcatcggcacgtccttcctcctggccggcttcgtgtcgctcttccgcatccgcaccatcatgaagcacgacggcaccaagaccgaaaagctggagcggctcatggtgcgcatcggcgtcttctccgtgctctacacagtgcccgccaccatcgtcatcgcttgctacttctacgagcaggccttccgcgagcactgggagcgctcgtgggtgagccagcactgcaagagcctggccatcccgtgcccggcgcactacacgccgcgcatgtcgcccgacttcacggtctacatgatcaaatacctcatgacgctcatcgtgggcatcacgtcgggcttctggatctggtcgggcaagacgctgcactcgtggaggaagttctacactcgcctcaccaacagccgacacggtgagaccaccgtgtgagggacgcccccaggccggaaccgcgcggcgctttcctccgcccggggtggggcccctacagactccgtattttatttttttaaataaaaaacgatcgaaaccatttcacttttaggttgctttttaaaagagaactctctgcccaacacccccacaaggtttgtaattaaaactgtaaatagtcaaaaaaaaaataattatatatattttctatttaa

SEQ ID NO: 28323 - DNA, 747 bp, Homo sapiens
agggtataagggggcttggcaaaagaaagctagaagcagtatcactaaaaatgctttggcctcatcgtctgttctcttgtctacctatctttctttttctgcatccattcaggcaataaacctgtgccaggcctggagtaggctcagaggctctagaggagaatctgttccttgtctctttcagcttctagtggctactagcattcctttgcttgtggccccatcactgcagtttctgcctctgtcttcacatcaccttctactctttgatatatgtataatttctctctctctctctctttcataaggacacttgtgttggcatttagggcccacctggataatccagaataatctccccatctcaagattcttaatcacatcctcaaagatgaacccattttccagttaaggtaacattcacaggttctggggattagaacatggacatatctttagaagctatcagactaccaaaataagcaaagacattttaaaatttaccatttattaagtaccatatgccagacacctacatacatttttctcacctcaattaagttttacaataaccctgaaatgtaggtattaatgcctgtattctatagacgaggaaactgaggctcagggagattgagtcacgtgcccaatgtcacgtagctgggtaaatggacaggaactagggatttgaaaccaggtggaggctggggctccaaagccaacatgctttttgcctcaccaacagcc

SEQ ID NO: 28324 - DNA, 478 bp, Homo sapiens
gtcttaaaacaactgaagtttattctcttacacttctggagatcagaggttcaacatccattttattataccaaaatcaaagtgttggcaggggtatgctctttctggaggctctagaggagaatctgttccttgtctctttcagcttctagtggctactagcattcctttgcttgtggccccatcactgcagtttctgcctctgtcttcacatcaccttctactctttgatatatgtataatttctctctctctctctctttcataaggacacttgtgttggcatttagggcccacctggataatccagaataatctccccatctcaagattcttaatcacatcctcaaagatgaacccattttccagttaaggtaacattcacaggttctggggattagaacatggacatatctttagaagctatcagactaccaaaataagcaaagacattttaaaatttaccatttattaagta

SEQ ID NO: 28325 - DNA, 387 bp, Homo sapiens
acgtccaatactttctgccactgttactaaaaggaaggccacctgtaccagagaaaaccaaactgagattaataaaccaaaagcaaaaagatgtctcaacagtgcagtgggtgaacatgaaaaagtaataaataatcaaaaggaaaaagaagattttcattcttatcttccaattatagatccaatattaagtaaatctaagagttataaaaacgaggtaacaccctcttcgacaacagcttcagttgctcggaaaagaaagagcgatggaagcatggaagatgcaaatgtgagagttgcaattacagaacatacagaagtgcgagaaatcaaaagaatccatttttctccctcagagcctaaaacatcagctgttaagaaaacaaa

SEQ ID NO: 28326 - DNA, 362 bp, Homo sapiens
gttatgagaacatcgtgtgcctgggcatggccctcagaccagtggtgctggcctcatctgtgagcctgttagaaattcagattcaggtcaggtgcagtggctcacacctgtaatcccagcactttgagaggctgaggctagtggatcacttgggcccaggagttcgagaccagcctgggaaacatggtgaaacctcatctaccaaaaatgggccaggcatggtggtgcacatctgtggtcccagctacttgagaggttgaagtggaaagatggcttgagcccaggaggtggaggctgcagtgagccatgattgtgccactgcattccagcccgggcaacaagcaagaccctgtctcaaaaaa

SEQ ID NO: 28327 - DNA, 401 bp, Homo sapiens
aaggtctcactctgttgcccaggttggagtacagtggtcctatcatagaccactgcagccttgacctccggactcaatgctcccccttcggcctcctgagtagctaggactacagaaacgtgttaccacaccagaaataattaaaccctccaccacacacaaaacaaataacaagaaacccaaacataatatatatcttgaatgcctgagctcaacagatcctcctgcctcagcctctcaaattgctgggattaggccgggcacagcagttcatgcctgtaatcccagcactttgggaggctgaggcgggcagatcacttgaggtcatgagtttgaaaccatcctggccaacatgatgaaaccccgtctctactaaaaatacacaaattagccaggcatgg

SEQ ID NO: 28328 - DNA, 1092 bp, Homo sapiens
gaatatgttagtgcctctgagctaacaataatgttgatgctgaaagaagaagaaaggccactacttttaataaaaattaaatgtttaaatgtgaagtgtacttaaatgattaggtattatagcaataccctttgtaagtggaattgcctccacagcttggccttattagccctaagtatactaagttccttctgaaactcctgtcacccaccaaattatctgagaattctttccaccaacaccttaatcaaaccatcttctaccaagtgtgttcagaactggagtaaagtctgatcagttcattaccgctgtttctctttgctgtgtgggaattaaaaaacccatgcttttaacagtccaacagtagctggctgttcctggttgttaaatataaaacttaagtagggcaagcacttggggttccttgcagcaagacagctctacttctgtgctgctaggctccaacagaggactgcttctctgcttctggtgctcagcccttccaatccatacacagagccacttcccaggggtcagtgagcccaaacctttgtcccccttacttccccaggggcttatatctaggggttgggtaacttttctttttgaatttcaaactgcaaggggtctgatttctctcctgctttgacagtagagccaaccatttaccccaccacccttctgaaagtgactgcatgtaaacaaagctttgattagatgggccactttcagtgattctaaaatgattttctggcatctctttgagtaaagaaaatgtaggccttctcagtgcacttagagttaaaaaagaaaataaaacaaaaccaacttgattgctgacattcttgcaggaaaaaaatttttaatcatgcatctggaactctctagcccctaactctgtccatggaagggagagggaagtttataaaatgtaaaatttagaatctttaaaaaccatggcattccttaagattgcagatctcaaattatagtaaaataagttgagtttaagaaaatgaagagtataagtttgattagggatggagggtgagaggagcttgccagatgggccatatcataataggctttata

SEQ ID NO: 28329 - DNA, 2132 bp, Homo sapiens
ggcggaaacgggaacgtgcagccgcgggtgcaggagtcctggggcatggcgggggcggggcagggggaggcgcgcacagaacaggctggggcatccctcgccctggctctttgagcccggaccagacagagatgtgataatggatcatcatgtttctaccatcaagcctcgaagaatccaaaaccaaaatgtcattcaccgcttggaacgccggcggatcagttcaggcaagaccagacatctcttgaaatctatgagtaccagggctgccaggcagcagaggacctactgcagggatacgaaggagaaatcctgtccaatggcaatgaccagcggtcagtgaatatccggggccggctctttgaacgcttttttgtcctgctgcacattaccaatgttgcggccaatggtgagcacctgaaccgggagtgtagtctcttcactgatgactgccgctgtgtcatcgtgggctcagctgcctacctcccagatgagcctcaccctccattttttgaggtatatcggaacagtgaatcagtgacccccaacccacggtcccctctagaagactattccctccatatcattgaccttcacaccggccgcttatgtgatacacgcacgttcaagtgtgacaaggtggtcttgtcacacaaccaagggctgtacttgtacaaaaacatcctggccatcttgtctgtgcaacaacagaccatccatgtcttccaggtgactcctgaaggcactttcattgatgtgcggaccattggccgcttttgctatgaggatgacctgctcactgtgtcagctgttttccctgaggtacagcgggacagtcagacaggcatggccaatccctttagggatcctttcatcaattccctcaaacaccggttgctggtatatttgtggcgccgggcagaacaggatggtagtgcaatggccaagaggcgcttcttccagtattttgaccaactgcggcagctgcgaatgtggaaaatgcagcttctggatgaaaaccacctgtttatcaagtacactagtgaggatgtagtaacactgcgagtcacagatccatcacaggcatctttctttgtggtgtacaatatggtgacgacagaggtgattgctgtgtttgagaatacatcagatgagcttttggagctctttgagaacttctgtgacctttttcgtaatgctaccctgcacagtgaagttcagtttccctgctcagcttctagcaacaattttgcaaggcagatccagcgccggttcaaagacactattataaatgccaagtatggagggcacacagaggcagtacgccggctgctgggtcagctccccatcagtgctcagtcttacagcggtagcccctatctggatttgtctctcttcagttatgatgacaagtgggtatctgtcatggagcggcccaagacttgtggagatcacccaatcaggttctatgcccgggactcgggcctgctcaagtttgagatccaggcggggttattgggccgccccatcaaccacacagtgcgacgccttgttgccttcacctttcacccttttgagcctttcgctatttctgtgcagaggactaatgctgagtatgttgtcaacttccatatgcgacactgctgcacgtaggtgcctcaccagagccagattatctggtcttccaagactttgccactcacttatctcagtggactccaaagcaaaagctcccgactactagctctgttagttccagcctgctatacctcagatgggagagagccagagagaggagtgagggtggctcaacctaatggaatttttaaattgtatacaatactgctactgattgttataatatcctcttgcgttttccctgtgggaatgcccagcattaattaagtccatttcatttttgctttactttgcatttgattgctgtgaagatgaaagcattagacttttatccccttcatgtcacttcttcggcattatggtttgcatctgaaagcagttaaatcttgtttactgatgagaatgacatacatcctttccatttagctcataagcacggctatctttttaagagaaaaataaagccatggtattttcatacttaaaaaaaaaag

SEQ ID NO: 28330 - DNA, 2271 bp, Homo sapiens
ggcggaaacgggaacgtgcagccgcgggtgcaggagtcctggggcatggcgggggcggggcagggggaggcgcgcacagaacaggctggggcatccctcgccctggctctttgagcccggaccagacagagatgtgataatggatcatcatgtttctaccatcaagcctcgaagaatccaaaaccaaaatgtcattcaccgcttggaacgccggcggatcagttcaggcaaggcaggtacccactggcaccaagtccgagtgttccatcagaatgtcttccccaacttcacagttgtcaacgttgaaaagcctccttgtttcttgcgtaaattctcacctgatggacgctactttattgctttttcttcagaccagacatctcttgaaatctatgagtaccagggctgccaggcagcagaggacctactgcagggatacgaaggagaaatcctgtccaatggcaatgaccagcggtcagtgaatatccggggccggctctttgaacgcttttttgtcctgctgcacattaccaatgttgcggccaatggtgagcacctgaaccgggagtgtagtctcttcactgatgactgccgctgtgtcatcgtgggctcagctgcctacctcccagatgagcctcaccctccattttttgaggtatatcggaacagtgaatcagtgacccccaacccacggtcccctctagaagactattccctccatatcattgaccttcacaccggccgcttatgtgatacacgcacgttcaagtgtgacaaggtggtcttgtcacacaaccaagggctgtacttgtacaaaaacatcctggccatcttgtctgtgcaacaacagaccatccatgtcttccaggtgactcctgaaggcactttcattgatgtgcggaccattggccgcttttgctatgaggatgacctgctcactgtgtcagctgttttccctgaggtacagcgggacagtcagacaggcatggccaatccctttagggatcctttcatcaattccctcaaacaccggttgctggtatatttgtggcgccgggcagaacaggatggtagtgcaatggccaagaggcgcttcttccagtattttgaccaactgcggcagctgcgaatgtggaaaatgcagcttctggatgaaaaccacctgtttatcaagtacactagtgaggatgtagtaacactgcgagtcacagatccatcacaggcatctttctttgtggtgtacaatatggtgacgacagaggtgattgctgtgtttgagaatacatcagatgagcttttggagctctttgagaacttctgtgacctttttcgtaatgctaccctgcacagtgaagttcagtttccctgctcagcttctagcaacaattttgcaaggcagatccagcgccggttcaaagacactattataaatgccaagtatggagggcacacagaggcagtacgccggctgctgggtcagctccccatcagtgctcagtcttacagcggtagcccctatctggatttgtctctcttcagttatgatgacaagtgggtatctgtcatggagcggcccaagacttgtggagatcacccaatcaggttctatgcccgggactcgggcctgctcaagtttgagatccaggcggggttattgggccgccccatcaaccacacagtgcgacgccttgttgccttcacctttcacccttttgagcctttcgctatttctgtgcagaggactaatgctgagtatgttgtcaacttccatatgcgacactgctgcacgtaggtgcctcaccagagccagattatctggtcttccaagactttgccactcacttatctcagtggactccaaagcaaaagctcccgactactagctctgttagttccagcctgctatacctcagatgggagagagccagagagaggagtgagggtggctcaacctaatggaatttttaaattgtatacaatactgctactgattgttataatatcctcttgcgttttccctgtgggaatgcccagcattaattaagtccatttcatttttgctttactttgcatttgattgctgtgaagatgaaagcattagacttttatccccttcatgtcacttcttcggcattatggtttgcatctgaaagcagttaaatcttgtttactgatgagaatgacatacatcctttccatttagctcataagcacggctatctttttaagagaaaaataaagccatggtattttcatacttaaaaaaaaaag

SEQ ID NO: 28331 - DNA, 1598 bp, Homo sapiens
ggcggaaacgggaacgtgcagccgcgggtgcaggagtcctggggcatggcgggggcggggcagggggaggcgcgcacagaacaggctggggcatccctcgccctggctctttgagcccggaccagacagagatgtgataatggatcatcatgtttctaccatcaagcctcgaagaatccaaaaccaaaatgtcattcaccgcttggaacgccggcggatcagttcaggcaaggcaggtacccactggcaccaagtccgagtgttccatcagaatgtcttccccaacttcacagttgtcaacgttgaaaagcctccttgtttcttgcgtaaattctcacctgatggacgctactttattgctttttcttcagaccagacatctcttgaaatctatgagtaccagggctgccaggcagcagaggacctactgcagggatacgaaggagaaatcctgtccaatggcaatgaccagcggtcagtgaatatccggggccggctctttgaacgcttttttgtcctgctgcacattaccaatgttgcggccaatggtgagcacctgaaccgggagtgtagtctcttcactgatgactgccgctgtgtcatcgtgggctcagctgcctacctcccagatgagcctcaccctccattttttgaggtatatcggaacagtgaatcagtgacccccaacccacggtcccctctagaagactattccctccatatcattgaccttcacaccggccgcttatgtgatacacgcacgttcaagtgtgacaaggtggtcttgtcacacaaccaagggctgtacttgtacaaaaacatcctggccatcttgtctgtgcaacaacagaccatccatgtcttccaggtgactcctgaaggcactttcattgatgtcggcccaagacttgtggagatcacccaatcaggttctatgcccgggactcgggcctgctcaagtttgagatccaggcggggttattgggccgccccatcaaccacacagtgcgacgccttgttgccttcacctttcacccttttgagcctttcgctatttctgtgcagaggactaatgctgagtatgttgtcaacttccatatgcgacactgctgcacgtaggtgcctcaccagagccagattatctggtcttccaagactttgccactcacttatctcagtggactccaaagcaaaagctcccgactactagctctgttagttccagcctgctatacctcagatgggagagagccagagagaggagtgagggtggctcaacctaatggaatttttaaattgtatacaatactgctactgattgttataatatcctcttgcgttttccctgtgggaatgcccagcattaattaagtccatttcatttttgctttactttgcatttgattgctgtgaagatgaaagcattagacttttatccccttcatgtcacttcttcggcattatggtttgcatctgaaagcagttaaatcttgtttactgatgagaatgacatacatcctttccatttagctcataagcacggctatctttttaagagaaaaataaagccatggtattttcatacttaaaaaaaaaag

SEQ ID NO: 28332 - DNA, 1581 bp, Homo sapiens
gacccacgcgtccgcggacgcgtgggtcgacccacgcgtccgagaacaggctggggcatccctcgccctggctctttgagcccggaccagacaggtgctgggaatacagcaaggaattagaccagttccctgctctctggtatggtgggacagatactaaaaagagatgtgataatggatcatcatgtttctaccatcaagcctcgaagaatccaaaaccaaaatgtcattcaccgcttggaacgccggcggatcagttcaggcaagaccagacatctcttgaaatctatgagtaccagggctgccaggcagcagaggacctactgcagggatacgaaggagaaatcctgtccaatggcaatgaccagcggcatctttctttgtggtgtacaatatggtgacgacagaggtgattgctgtgtttgagaatacatcagatgagcttttggagctctttgagaacttctgtgacctttttcgtaatgctaccctgcacagtgaagttcagtttccctgctcagcttctagcaacaattttgcaaggcagatccagcgccggttagagcccaattgattaatggaggatggtctatgggccatgaaagaacaaagtcaaagataattctaatgtttctggattgaacagcttgcaagagagagttgccattaaactgtaaacctgtgggtagagcaggtttaggggagaagatcaaaagttctgttcaaagacactattataaatgccaagtatggagggcacacagaggcagtacgccggctgctgggtcagctccccatcagtgctcagtcttacagcggtagcccctatctggatttgtctctcttcagttatgatgacaagtgggtatctgtcatggagcggcccaagacttgtggagatcacccaatcaggttctatgcccgggactcgggcctgctcaagtttgagatccaggcggggttattgggccgccccatcaaccacacagtgcgacgccttgttgccttcacctttcacccttttgagcctttcgctatttctgtgcagaggactaatgctgagtatgttgtcaacttccatatgcgacactgctgcacgtaggtgcctcaccagagccagattatctggtcttccaagactttgccactcacttatctcagtggactccaaagcaaaagctcccgactactagctctgttagttccagcctgctatacctcagatgggagagagccagagagaggagtgagggtggctcaacctaatggaatttttaaattgtatacaatactgctactgattgttataatatcctcttgcgttttccctgtgggaatgcccagcattaattaagtccatttcatttttgctttactttgcatttgattgctgtgaagatgaaagcattagacttttatccccttcatgtcacttcttcggcattatggtttgcatctgaaagcagttaaatcttgtttactgatgagaatgacatacatcctttccatttagctcataagcacggctatctttttaagagaaaaataaagccatggtattttcatacttaaaaaaaaaag

SEQ ID NO: 28333 - DNA, 494 bp, Homo sapiens
gacctccctgcctcagcctcccaaagtgctggtattacaggcgtgagccactgcacccggccagtttgttcctcttttactttgtttagtgtattcttattcttcaaggctcataccaattgttgctccattaattattttaacatatttatgagcgcttaactgtcccttctcctaggtgctgggaatacagcaaggaattagaccagttccctgctctctggtatggtgggacagatactaaaaaggtaaacaacttaatttcaggaagagataaagaccattaataatatagggtgtatcagtaaattcatgtgggcagacgtaaggtgcctggggaagatttctgaggaggtactattttagctgagacttgaatgatgaaacagaggcagatctttcagcacttaaataatgttgttccacttctttctaacttccatggtttctgatgagaaatctacagacatttgaattgttgcacctctataggt

SEQ ID NO: 28334 - DNA, 2306 bp, Homo sapiens
gacccacgcgtccgcggacgcgtgggtcgacccacgcgtccgagaacaggctggggcatccctcgccctggctctttgagcccggaccagacaggtgctgggaatacagcaaggaattagaccagttccctgctctctggtatggtgggacagatactaaaaagagatgtgataatggatcatcatgtttctaccatcaagcctcgaagaatccaaaaccaaaatgtcattcaccgcttggaacgccggcggatcagttcaggcaaggcaggtacccactggcaccaagtccgagtgttccatcagaatgtcttccccaacttcacagttgtcaacgttgaaaagcctccttgtttcttgcgtaaattctcacctgatggacgctactttattgctttttcttcagaccagacatctcttgaaatctatgagtaccagggctgccaggcagcagaggacctactgcagggatacgaaggagaaatcctgtccaatggcaatgaccagcggtcagtgaatatccggggccggctctttgaacgcttttttgtcctgctgcacattaccaatgttgcggccaatggtgagcacctgaaccgggagtgtagtctcttcactgatgactgccgctgtgtcatcgtgggctcagctgcctacctcccagatgagcctcaccctccattttttgaggtatatcggaacagtgaatcagtgacccccaacccacggtcccctctagaagactattccctccatatcattgaccttcacaccggccgcttatgtgatacacgcacgttcaagtgtgacaaggtggtcttgtcacacaaccaagggctgtacttgtacaaaaacatcctggccatcttgtctgtgcaacaacagaccatccatgtcttccaggtgactcctgaaggcactttcattgatgtgcggaccattggccgcttttgctatgaggatgacctgctcactgtgtcagctgttttccctgaggtacagcgggacagtcagacaggcatggccaatccctttagggatcctttcatcaattccctcaaacaccggttgctggtatatttgtggcgccgggcagaacaggatggtagtgcaatggccaagaggcgcttcttccagtattttgaccaactgcggcagctgcgaatgtggaaaatgcagcttctggatgaaaaccacctgtttatcaagtacactagtgaggatgtagtaacactgcgagtcacagatccatcacaggcatctttctttgtggtgtacaatatggtgacgacagaggtgattgctgtgtttgagaatacatcagatgagcttttggagctctttgagaacttctgtgacctttttcgtaatgctaccctgcacagtgaagttcagtttccctgctcagcttctagcaacaattttgcaaggcagatccagcgccggttcaaagacactattataaatgccaagtatggagggcacacagaggcagtacgccggctgctgggtcagctccccatcagtgctcagtcttacagcggtagcccctatctggatttgtctctcttcagttatgatgacaagtgggtatctgtcatggagcggcccaagacttgtggagatcacccaatcaggttctatgcccgggactcgggcctgctcaagtttgagatccaggcggggttattgggccgccccatcaaccacacagtgcgacgccttgttgccttcacctttcacccttttgagcctttcgctatttctgtgcagaggactaatgctgagtatgttgtcaacttccatatgcgacactgctgcacgtaggtgcctcaccagagccagattatctggtcttccaagactttgccactcacttatctcagtggactccaaagcaaaagctcccgactactagctctgttagttccagcctgctatacctcagatgggagagagccagagagaggagtgagggtggctcaacctaatggaatttttaaattgtatacaatactgctactgattgttataatatcctcttgcgttttccctgtgggaatgcccagcattaattaagtccatttcatttttgctttactttgcatttgattgctgtgaagatgaaagcattagacttttatccccttcatgtcacttcttcggcattatggtttgcatctgaaagcagttaaatcttgtttactgatgagaatgacatacatcctttccatttagctcataagcacggctatctttttaagagaaaaataaagccatggtattttcatacttaaaaaaaaaag

SEQ ID NO: 28335 - DNA, 1316 bp, Homo sapiens
gacccacgcgtccgcggacgcgtgggtcgacccacgcgtccgagaacaggctggggcatccctcgccctggctctttgagcccggaccagacaggtgctgggaatacagcaaggaattagaccagttccctgctctctggtatggtgggacagatactaaaaagagatgtgataatggatcatcatgtttctaccatcaagcctcgaagaatccaaaaccaaaatgtcattcaccgcttggaacgccggcggatcagttcaggcaaggcatctttctttgtggtgtacaatatggtgacgacagaggtgattgctgtgtttgagaatacatcagatgagcttttggagctctttgagaacttctgtgacctttttcgtaatgctaccctgcacagtgaagttcagtttccctgctcagcttctagcaacaattttgcaaggcagatccagcgccggttcaaagacactattataaatgccaagtatggagggcacacagaggcagtacgccggctgctgggtcagctccccatcagtgctcagtcttacagcggtagcccctatctggatttgtctctcttcagttatgatgacaagtgggtatctgtcatggagcggcccaagacttgtggagatcacccaatcaggttctatgcccgggactcgggcctgctcaagtttgagatccaggcggggttattgggccgccccatcaaccacacagtgcgacgccttgttgccttcacctttcacccttttgagcctttcgctatttctgtgcagaggactaatgctgagtatgttgtcaacttccatatgcgacactgctgcacgtaggtgcctcaccagagccagattatctggtcttccaagactttgccactcacttatctcagtggactccaaagcaaaagctcccgactactagctctgttagttccagcctgctatacctcagatgggagagagccagagagaggagtgagggtggctcaacctaatggaatttttaaattgtatacaatactgctactgattgttataatatcctcttgcgttttccctgtgggaatgcccagcattaattaagtccatttcatttttgctttactttgcatttgattgctgtgaagatgaaagcattagacttttatccccttcatgtcacttcttcggcattatggtttgcatctgaaagcagttaaatcttgtttactgatgagaatgacatacatcctttccatttagctcataagcacggctatctttttaagagaaaaataaagccatggtattttcatacttaaaaaaaaaag

SEQ ID NO: 28336 - DNA, 999 bp, Homo sapiens
ttttagatggaattgcactgtcatccagtctagagtgcagtggcgtgatctaagcttacagcagcctccacctcctgggttcaagtgattcttgtgcctcagcctcctgagctgggactacaggcacacgccaccacgcctggctagtttttgaatttttagcagagatggggtttcaccatgttggccaggctggtctcgaattcctgacctcaagtgatcctgcctcggcctcccaaagtactgggatcaggggtgagccactatgcctggccaagggcttagtcttaaatataacctctagtcaaaatgtttaaacaaatttgtacataaatgtgatttaaaaaaatttttttaatagtaccaaaggatattcagtgaaagtgagtttcctgcccactccctgatccacccagttctttaggcaaccactgatagcattttcttaagtattcttccagatatcgtctatgcatatgtaaaagtatctgtctttctccttttaaaaacacaattggtaatatatcatacttgctggtttgcaccttgctttttttgcttaatatatctagtttataatgacctaatgtgcaaatttttgcatctgccctaaatatctactggtttatttttataatttttgtgtctatactatttgcaagcagtatgtgtcagtagactttattattaataaataaaaagccaatttggatagaatcactttataaattggtagtgctggttttttactaaaaatatttttaagttcttcaaaagaagttttatgagtgcatcttacagatctggtgaagatcttggcacattattgtatgctgtttgttgacttgtgtccgcatcggtgtccctgaggctctagcaattatgtcttgactgataaggctctaatttcttctactgtgttaacttgcttctggcaagattgaacagatctactgaaaccttgaaaggttttctgggtactcttaataaaattgcaaa

SEQ ID NO: 28337 - DNA, 716 bp, Homo sapiens
ttttagatggaattgcactgtcatccagtctagagtgcagtggcgtgatctaagcttacagcagcctccacctcctgggttcaagtgattcttgtgcctcagcctcctgagctgggactacaggcacacgccaccacgcctggctagtttttgaatttttagcagagatggggtttcaccatgttggccaggctggtctcgaattcctgacctcaagtgatcctgcctcggcctcccaaagtactgggatcaggggtgagccactatgcctggccaagggcttagtcttaaatataacctctagtcaaaatgtttaaacaaatttgtacataaatgtgatttaaaaaaatttttttaatagtaccaaaggatattcagtgaaagtgagtttcctgcccactccctgatccacccagttctttaggcaaccactgatagcattttcttaagtattcttccagatatcgtctatgcatatgtaaaagtatctgtctttctccttttaaaaacacaattggtaatatatcatacttgctggtttgcaccttgctttttttgcttaatatatctagtttataatgacctaatgtgcaaatttttgcatctgccctaaatatctactggtttatttttataatttttgtgtctatactatttgcaagcagtatgtgtcagtagactttattattaataaataaaaagccaatttggataga

SEQ ID NO: 28338 - DNA, 462 bp, Homo sapiens
ttttttttccctccagagccaaggccaaatgtcagggatgccccagcatggccccgagcagggactatgaggagggggccgtgcattcttcgctctttgggggcctgggcggaggaccctgctgagacgcccctctgggaggcccgaaggctccctgagtctcttgtcctgtggtgactgtgggtctctgccgtgcatctgcttcagtccgccagttccatggcccgcccaccagtgccgtcgcaaccccgtcctttggactgggcttttcaggacatccggagagccttggtgtgagaagcaggccccgaggctaccttctggtcccccgtcctggggttggtcccctaagcgaacgaaagcgtgctttcagccctgtgtggacggagcgtggcgcctccagcctcactcagttctgtgtgtcctaagccgtgtcctggcactttctcttggaaactgagg

SEQ ID NO: 28339 - DNA, 423 bp, Homo sapiens
ttaaaggcagtcttgctatgttgcccaggctagtctcaaactcttggcctcaagtgaccctaccacgttaggctcctaacatgctgggattatagacatgagccaccccatctgccgtagttttggcaaagttctttattaaagtaatagttgctcctacaaaaacagtattcatttttagggtaatactatactgatttttttatggaaatctttttgatatcctgtaatttataattgtcatagtatctatccatttgcatagtttttcttgtatctgtcacatctttctaagtatttatttcattttttctcaagtgctctagcagatctgtcaaatgcttagcagtatcttttccatatgttcaaacccatcactttaagttattaattttttttgacttagaaaacttcctctcacag

SEQ ID NO: 28340 - DNA, 357 bp, Homo sapiens
ggatttatgttggggaataattgatgtgtagattacaatcaaagccatgaatgataacacctgtggagggtgttgaagaacagaggacaaaatcagagatccttgtctgggtgcagtggctcacacctgtagtcccagcactttgagaggctgatgcagggggattgcatgagcccaggagttcgagaccagcctcagtaacatagtgagaaccctgtctctacaaaaaataaaaaatcagccaagtgtgatggtgcacgtgtagtctcagctactcgagaagctaagatgggaggaacgcttgagcccaggagatcaaggctgcagtaagctatgatctgcttactacaccccaac

SEQ ID NO: 28341 - DNA, 757 bp, Homo sapiens
taccacgtatctctaacattactgtgaagagactaaataggaagaaagataataggtgaggtgatgaggcacaaataccaggatggggtagatcaaatagaaaagaaacctggaaagatacagcagaggctgggcaccgtggctcatgcctgtaatcccagcactttgggaggccaaggtgggcagatcacctgagatcaagtatttgagaacagcctggctaacatggcgaatcctcgttttgaccaaaatatagaaattagcctggtgtggtggcgagtgcctgtaatcccagctattcaggagggtgaggcagaagaatggcttgaattcgggaggcggaggttgcagtgagctgagatcctgcaactgcactctggctgggcaagagcgagactccatctctaaaataaaattaaagtaatataaaaaactgcttctcatgaaagctttggtataatcttacgaggtaacatcattgttttgcaactacggtatgtgttcaaaatgttcttctttgaccccacatttcattagatatatttttaagccattttaaaattgtttttctctgaaatttattgtgtttagtttacattgaggactgcatgctttctagtctgtatcatacattggaaacattttctagtacctgataaatgattttaggttgtttcgatgtgtacttgataaagatatcaaggaactttttctttatgctaacattaaaatttagttgaagtagcctattattcca

SEQ ID NO: 28342 - DNA, 491 bp, Homo sapiens
agagaccacaccactaaccatccccaactccatggggttcgagactccatcttggtagttctgtgcctccccccagaccccgcccctggggaaatagcctcacggggttggctgttccagactcaggttccagaacagccctcggcctccgaggctccccgcctccactctagttctagatgagtgggaggcgtgcccccctcctccagtacgtcccgctgctgtgctctggggatttctgggatatatggaggattctttccccagaggctcccaatcagcttttgttctagacttccccatcccgaagccatcacttctccccgcagcccgcctgccgtgcatggctcctgtctggctcggacccaccccaactctccccagtgcctgccactctctgggactctcctcctcccctcctcttcccttagcctctcccacccggccacagctgctggagaataaatttgggatgctgatgctgaagtgtt

SEQ ID NO: 28343 - DNA, 360 bp, Homo sapiens
gagctacagtcatctgaaggatgtatgggtggtagagatttgcttccaagatggcttactcatggctcactcacacgactcttggaaggaaaccctagttcatagccatgtggatctctccatgaagctatttgagtgtccttaaaatgcagcctatacttaaggggagggaaattaaactccatctcctgaagggagtactgtcgaagagtttgaggacatacagtcacaccttacttaacagcaggagaatcacttgaacctgggaggcagaggtagcagtgagccaagatttgccactgcactccaccctgggtgacagagtgagactccatctcaaaacagacaaacgaaaagaac

SEQ ID NO: 28344 - DNA, 619 bp, Homo sapiens
ccaccttggcctcccaaagtgctgggattacaggcgtgcacatgcacctggcctctgcttttttattttaaaagcacaactaactggtagataaagtgatttgtctttagtatttgataactaatgggttttagagtgttatttataagatgtagtaaattatcctcatcattatttttaagacaaatttataagacaagtgtaatagaaatagatcaacagcacaatagaaaaagatggcagaaaacatgaatacgtaattcacagatgaaagcaaaacaaatggtccttttattaagggaatgcaaagttaaaaatcaactagacccttttttgtttgtttcttcttggattggcaaagaggagcacttaaaagctgtattttgttttggaggattagtttggttatgtctactaatgactaaatgtgtacatacattttgacccattagttacacttcaaagaattttatccaacaaaaatgtactgagacacattgcttagtataataagccattgaagcttacccaaatattcatcaatgagaaataggttaagaaaattatagtacaaccatacatgaaactgatgtagctgtaaaagaaatgagatcgattt

SEQ ID NO: 28345 - DNA, 705 bp, Homo sapiens
  misc_feature (253)..(254): n is a, c, g, or t
  misc_feature (256)..(256): n is a, c, g, or t
  misc_feature (261)..(261): n is a, c, g, or t
atgagatgggctgccccaggaaagaagacatctggtctgcaacagaaaaatattgaagtgaaaacaaaaaagaacaaacagaaaacacctggaaatggagatggtggcagtaccagtgagactccccagcctcctcgaaagaaaagggcccaggtagatcctactgttgaaaatgaggaaacattcatgaacagagttgaagttaaagtaaagattcctgaagagctaaaaccatggcttgttgatgactggnncntaaancaggcaaaacagctcttctatcttcctgccgagaagaatgtggattccattcttgaggactatgcaaattacaagaaatctcatggaaacacagataataaggagtatgcagttaatgaagttgtggcagggataaaagaatacttcaacctaatgttgggcacccagctactcaacaaatttgagagaccacagtatgccgaaattcttgcagattgtcccgatgcacccatgtcccaggtgtatggagtgccacatctcctgagattatctgtacaaattggagcaatgttggcctatacacctctgaatgagaagagccttgctttattactcaattatcttcacgatttcctaaagtacctggcaaagaattctgcaactttgtttagtgccagcgattatgaagtggctcttcctgagtaccatcggaaagctgtgtga

SEQ ID NO: 28346 - DNA, 466 bp, Homo sapiens
cctgggttcaagtgattttcctgcctcagcctcctgagtagctgggattaccggcacgcaccactgtgcctggctagttttgtatttttagtagagacggggtttctccatgttggtcaggctggtctcgaactcccgacctcaggtgatccgcctgccttggcctcccaaagtgttgggattacaggtgtgagccaccacgcctggccatatttctagttttgagcatgcctgtttacttaaaggttatgtgtctagttttgatgggtgggaaattagaatttcatcggggtgatgaaatgagcaatttgatcttgtgtttttcagaatatagtaatcccctccccgccaaattatttgtttgtagtgtgaaaatcaggtatactggattataaaccagtatcttccgtcccaaaaggcttaatttggttcagacactgctttattgttagaggcagagatttag

SEQ ID NO: 28347 - DNA, 253 bp, Homo sapiens
tggagaaatccattttattcttgtaagaaataggaataactataacaggaagtatgcaagactttaatgaaggaaactataaaacagtaccatagaggggccgggcgtggtggtttctgcctgtaatcccagcactttgggaggccaaggcaggtggatctcctgaggtcaagagttcaagaccagcctggccaacatggtgaaaccccgtttctactgaaagtacaaaaattagcagggcgtggtggtgtgc

SEQ ID NO: 28348 - DNA, 474 bp, Homo sapiens
ccattaactgatggatgggtaaataaattgtggtatgtacatataatggaatactcagccatatagtatattagaagtatcagtacttctaatatactagtaaatggtggatgagcctccaaaatattatgttagtgaaaggagccaagcacaagtgattagatactatatgattcaatttatgtgaaatactaaaatagataaatccatagtgacagaatgcagatgcaaggggctaggggcagggaggagagaatggggagcaactgcttaatgggtatgggttttattttggagttgattaaaatgtttcacaacaagatagaagggggtggttgcgcaacattctgaatgcactgaatgccactgaattgtttacttgataggtgcagcaaaccaccatggcacatgtatacttatgtaacaaacctgcacattctgcacatgtatcctggaacttaaagtaaaataaaa

SEQ ID NO: 28349 - DNA, 369 bp, Homo sapiens
aaatctctgtgacttttggtttaaagatttcttagacagtacatataaaattaactatataaggaaaaaatggacaaatttgactttatcaacattaaaaatttctgctcattgaaagactcaaaatgaaaaggcaagcagttttggagaaaatatttgcaatacatatatctgaaaaaggacttgaatgtataatatatacataaagatgctcttacaacttcataatgagaaaataaccccataaagagaagggcaggccgggtgcagtggctcatgcctataatgccagcacttttggaggctgaggtgggtgaattgcttgagcccaggagtttgagaccagcctgggcaacatggtgaaaccca

SEQ ID NO: 28350 - DNA, 414 bp, Homo sapiens
gaggaggggtgaattacctgaagctcgctgttattgtctgtgagtcacatggtgaatatgtgagggggctcaagttaaagggtaactggttagggaagattttccctctggccccacacaattactcaggcttcccctggaagctatcacttctctttggtaggaggttctcttccagctctgtgccttaaattaaccgaacatggccatggttccagaaatttgcctgccctgatctgttcactatgatgattatgtacatgattccctggttccagatctgcactcactccatagtccatctggcttctgactctggctccattcccattttatagttctgctcctgtccttcgtactagactttagtatttggtttcctatttctgactctctgcctgctgccacaaaaaa

SEQ ID NO: 28351 - DNA, 456 bp, Homo sapiens
gctgagattacaggtgtgagccaccacacctgggctaaaactactgatataatttgaggaagctatttttttcccaataaaatttccactactcaaatttggctacattattgagcacttaatgcatctttatgaccttattggatacttttctctatgttttcttatttaattcctgtaagagctccaaaaagtattacatttttcttttcttttttaaaaaaaaataaagatgggataattgtctttcctgtcagggatcatgtaccttctcggcccaaaagctttccaataagattctcaattctcctggtttagagtgtccaaggtgcctgtcacaattctgtgcactatgcttgaagtgctaggttcgtgctctatgctctttgccaaaaacaaactgagtagccagctattggagcccccttcattcatgggtggcaaccagtggcttat

SEQ ID NO: 28352 - DNA, 735 bp, Homo sapiens
cttctgcaaatcccatcctggctcagtgaaaggcaccaccatcttgctggtcaccaagcaaacacctgggagacatccctgcctccatctccctctcctgccatcagatcaaaggcccatcacttcagcttcctctgaaaatccctctcttcttctctggccccacaatcaatcatctctcccttggcctgcgtttcctgcctgaggcatcgaactcgaggtcttcctgcctggaatcctccaagctaccttccatttggccacggcataatcttaggatgcaggtgtgaccaagtgcatgctttgattaaaaccctcagtgacttctctcaccggtaggataaagccacagctcttccgcagggcctcagaggccctccctcaacaacactgtccatcctgcctctcttctgctcagttttggctgtcaagctgctgtggaatgtgccgtgcctgctgccaggagggccctcctgaggagtctgtactcacagtcagcctcttgtaaagccatttccaggcaggatgggggacttccctcatcccagtacttgtcacatgctaatatgcttgtccagttttgtgtcagtctccccactggacagcttcttctgggtgagaacttaactgtgtcacactttggctgccagtatttgtagaagtgtttgctgaatgaataaatgactgactgaagcaagtcctcagcttggaggaatccagcaagcaacttctcag

SEQ ID NO: 28353 - DNA, 404 bp, Homo sapiens
agttttgctcttgttgcccaggctggagtgcaatggtgtgatcttggctcacgacaacctgcacctccagggttcaagcaattctcctgcctcagcctcctgagtagctgggattacaggcatgtgacatcatgcttggcaaattttgtatttttgggagagacggggtttctccattttggtcaggctggtctcgaactcctgaccttaggtgatcctcccacagtgctgggattacaggtgtgagccaccgtgcccagctgccttttcttatttataaaatgagcagagtaacattgtttcttcctctctcaaaaggaagatgaaagtggtgattgctcaaacactcagaacataaaatgctctacaaatgtaacaagttacaattagtgtgctatatttgt

SEQ ID NO: 28354 - DNA, 363 bp, Homo sapiens
cagctagtacatgacagaactgagattcactctgcagtctgtagacttccagtaactccaaacctcatactttttcttttatgttacacggactctgtttttaatggcatatttaaatgagatatttaagtgggaaagtaatagacaaccactcttacctgttaaaatccaaagtaattctctagtttttaaatggagcacatttaaaaaactttgtgcaccagtttgaactaccactgcaacagagaaatactagaacatcagagtattctctaaaccagatcattacttcattcactttgattgaatggagttgcatattttaaaaagacttctggatgcatggaaaacatatatagtttg

SEQ ID NO: 28355 - DNA, 216 bp, Homo sapiens
agactccagcattagtcaactaagggatgttgtaggtcatccctgagaacgagggctgcttgctctggggaagctgggaaatggcaccaggtgtcaggccctactgcccaggatgggatgacagctgctggtgttaattacgtttctgggcagaacagggtaaagtccttgggggtgagagtttttgtttaggcactgtgttccctgtacctgttg

SEQ ID NO: 28356 - DNA, 687 bp, Homo sapiens
ggcatgatcccttctggaattgaattctgcattcttcttctatcactaatcaaacaaaacactatcagaagaaaacatttccataactggatccggagtgaaggaaaatttcagatacttagacatgcatatacaataaacagtgtttcctgacaggctcattaaaaaagaatgactccactatgtgtcaactgcacaaatagaatccattataagactatggactcttacttctgaagtctgcctttgtgcccacctaagattaggaaaactaaatcttccactagaatttaaatatcacagaagcagaaacgattgcaatctctttccccagtgccttccttcctctttctctcagtcttgggtaggtcctggtacatatgaggcacttgcttaaaaaaataactgaaggaacgaatgaagttgcttaaggccgggagcagtagtctgtagatgagtcgactctcacctgtagtcccagtactttgggaggctgaggcaggaggatcgcttgaggccaggagttcgagactagcctgggcaacattgtgagatcccatctttacaaagaaattttaaaaattagccaggtgttgtgacatgtacctgtagtcccagccaattgggaggctgaaacagtaggatcacttgagcccaggagtttgaggctgagcaagatcttgtctt

SEQ ID NO: 28357 - DNA, 323 bp, Homo sapiens
gcaaattccttgaaaacagggccgtgtcttgttaatctctgatccctacttatatcaagcatagtaccctgcataaagtttccatattgtttatttggtttctcaacagttcctatgtataactcttgtttctctaatcaggtcaaaaaagtcaagtctctgaaggagggcctgtggtttctccttttctcaaatcctccgcagcttttagcaccaggttttgcagacagaatatgattaatacatacccaatagatgtcagaatgtaatcgactttaaaaaatgacccaagcaacatttttcaaaacacatttttgaaagta

SEQ ID NO: 28358 - DNA, 452 bp, Homo sapiens
gaaggatggcatccccaatgtcactcttgtttcttcctctgcctctctactagtatttatgtctgtgttcctaaactttgctgttcatcagaattactaggaggtttcattataccaatttctggatctcatcatagacctactggagcgtagcacctggaaatcccatttttaaagtgttttttgggtgattctttcgcaactagtcttagacttttggatttgttacacaggtcagttttcaaatccttttgacacatgaaccctttttagtataatagataagtaatgaaccttgggaattgaaaatcatttcatgaataattacatagtgttggaagtattttcaactaaaaatcacttagattagtaatgttcattaaaaatggtatgttgtaaagttgaaacacagtttttaataataattaaagaaaaactaattttttccccat

SEQ ID NO: 28359 - DNA, 124 bp, Homo sapiens
ttcagatttctaaatatcatccccacattggcaattatgcctgctttagagacaaaggaactatgctcaagaaaagtatctgttcagggctatacagtttttcagtgtcagaggtaagttttta

SEQ ID NO: 28360 - DNA, 339 bp, Homo sapiens
ctgggcaactgagtgagactccatctcaaaaaaagaaaattagcagttagagctgaggttacatcgaagattttttactatgctttaaaagacttggacagcatgtcctggaacacaatctaacaacaaagtgaagtatgcattttatacatgttcacttaaaagcagtagctctggaaggaatcaattctttttttgtgtgccccccaaaattaaaaagagtgataaattactggaggatgtgtgaactggtcatgttttgattcactttccataagagtggcaatttgaaaataaaaagtggagagagaaatatttgttctactttggaaattataa

SEQ ID NO: 28361 - DNA, 2292 bp, Homo sapiens
ggagtatgttccttcagggagaagttctggcccattgcacaaacacttggaaattaacttttccctaaattcaagatagtgtggtgtcggaaggaaatgggacagtaaattaggagacgcgggctccacctttaccttactacgtggcctttgatgagctggcttaacatccctgagtgattccatgatagagatctatactccaaactttattcctggtatctagttggcttcactgccacagacactgtactctctctttttagaagtttttttccttttttttccccctcaattggcttatttagtaaatttaggtctgaatgaattggtacctaaaagcttccaaatctatacatttcagaatatgggaattttcttcctcttcttcccccatatcccaacatggaattctggaaaactgtgcctcttcccctgttctgccttcatgggggagagactggatgaaatctacaaaaacagccaaaagtgccaccctggcttcatgtcttgaatttctaacttgctcttggcaaaggtcgctttattttttaatttttttccttgcattttcttttttattctattgctgctgcaaaaattaaggcaaaagtagctttcgatctttcatatttcatcctggtttcacaaggagtcacttatcttaggaggtctgtaagtcaggttacaaggccgggagcggtggctcacacctgtaatcccaacactttgagcggctgaggtgggtgtatcacctgaagtccggagtttgagaccagcctggccaacatggtgaaaccccgtctctactaaaaatacaaaaaattggctgggcatggtggtgggtgcctgtaatcccagctacttgggaagctgaagcaggagaatcacttaaacccaggtggcggaggttgcagtgagccgacatcgcgccattgcactccagcctgggtgacgagtgaaactccatctcaaaaataaaaattgaaaaatcaggttacaaaacaccatttttcccgaaataagacaataagaggcttttctctgaattcctttatattgagcctttcagaattctccctgggtgggcaatttctttaaatagtatttgaccctcagatcaatcctgggaatttttttcatttgggtagcaaaagctagagtattgctgtggcgattataatacttttaaaaagttttaccattttaaagttgccaacatttaattaaggttttcctttgaagcctcctttaatttagggagtaaaatgttagctaaaccaattatatactatatactatacactgtatctcctgtggccatgagaggtgtggctataccgaacagaaacatgcctactgttcaggaaagatgtcagttctggtaacacctctctgtattgggatctgttaattttgtaaatctaaattcttctgctcttggccaggtgcagtagttcatgccctgtaatcctagaactttgggaggctgaagggggggcggatcatttgaggtcaggagtttgagaccagcctggccaacatggtgaaaccccatctctactaaaaagtacaaaaattagctgggtgtggtggtgcgtgcctgtaatcccaactacttgggaggctgaggcaggagaatcgcttgaacctgggaggcagcggttgcagtaagccaagactatgccactgcactcccgcctgggtgacaaagcaatattctgtgtcaaataaataaattcattcttctgctctcctgacttagagaaatggtttgcttaaaatgctagtaacaaacatcacagtcaacaggagcttgcttcatgcgaaggatcaatgtgatttgtggatggagatgatagtgatgaaattcctgtttcatggggctgtttttcttttcatctcactgggcagcaggtttagtgaggcagtgagatgctgctgctgtggattcttgtagctatgcctcggcttcttggcatatcaggtaggaacctgttacaagtgaaatacttgaaacctctctgaccaagagcctctgatggagtgggaggtgagctaattctctgaccagcttggggcactgtttcagccactggtcacattccttgcttcaaactgaaattcagtttggctttgagtatagggatacatggtggattcatgtacttcagtgtttgttttgaccaaagtttatttttctagtgcattttctaagtcaaagtggtgaaaatatgtaataattttagtatgcatgactcagtctgaaacaataaaaatctctgaaaaatg

SEQ ID NO: 28362 - DNA, 2793 bp, Homo sapiens
ggagtatgttccttcagggagaagttctggcccattgcacaaacacttggaaattaacttttccctaaattcaagatagtgtggtgtcggaaggaaatgggacagtaaattaggagacgcgggctccacctttaccttactacgtggcctttgatgagctggcttaacatccctgagtgattccatgatagagatctatactccaaactttattcctggtatctagttggcttcactgccacagacactgtactctctctttttagaagtttttttccttttttttccccctcaattggcttatttagtaaatttaggtctgaatgaattggtacctaaaagcttccaaatctatacatttcagaatatgggaattttcttcctcttcttcccccatatcccaacatggaattctggaaaactgtgcctcttcccctgttctgccttcatgggggagagactggatgaaatctacaaaaacagccaaaagtgccaccctggcttcatgtcttgaatttctaacttgctcttggcaaaggtcgctttattttttaatttttttccttgcattttcttttttattctattgctgctgcaaaaattaaggcaaaagtagctttcgatctttcatatttcatcctggtttcacaaggagtcacttatcttaggaggtctgtaagtcaggttacaaggccgggagcggtggctcacacctgtaatcccaacactttgagcggctgaggtgggtgtatcacctgaagtccggagtttgagaccagcctggccaacatggtgaaaccccgtctctactaaaaatacaaaaaattggctgggcatggtggtgggtgcctgtaatcccagctacttgggaagctgaagcaggagaatcacttaaacccaggtggcggaggttgcagtgagccgacatcgcgccattgcactccagcctgggtgacgagtgaaactccatctcaaaaataaaaattgaaaaatcaggttacaaaacaccatttttcccgaaataagacaataagaggcttttctctgaattcctttatattgagcctttcagaattctccctgggtgggcaatttctttaaatagtatttgaccctcagatcaatcctgggaatttttttcatttgggtagcaaaagctagagtattgctgtggcgattataatacttttaaaaagttttaccattttaaagttgccaacatttaattaaggttttcctttgaagcctcctttaatttagggagtaaaatgttagctaaaccaattatatactatatactatacactgtatctcctgtggccatgagaggtgtggctataccgaacagaaacatgcctactgttcaggaaagatgtcagttctggtaacacctctctgtattgggatctgttaattttgtaaatctaaattcttctgctcttggccaggtgcagtagttcatgccctgtaatcctagaactttgggaggctgaagggggggcggatcatttgaggtcaggagtttgagaccagcctggccaacatggtgaaaccccatctctactaaaaagtacaaaaattagctgggtgtggtggtgcgtgcctgtaatcccaactacttgggaggctgaggcaggagaatcgcttgaacctgggaggcagcggttgcagtaagccaagactatgccactgcactcccgcctgggtgacaaagcaatattctgtgtcaaataaataaattcattcttctgctctcctgacttagagaaatggtttgcttaaaatgctagtaacaaacatcacagtcaacaggagcttgcttcatgcgaaggatcaatgtgatttgtggatggagatgatagtgatgaaattcctgtttcatggggctgtttttcttttcatctcactgggcagcaggtttagtgaggcagtgagatgctgctgctgtggattcttgtagctatgcctcggcttcttggcatatcaggtaggaacctgttacaagtgaaatacttgaaacctctctgaccaagagcctctgatggagtgggaggtgagctaattctctgaccagcttggggcactgtttcagccactggtcacattccttgcttcaaactgaaattcagtttggctttgagtatagggatacatggtggattcatgtacttcagtgtttgttttgaccaaagtttatttttctagtgcattttctaagtcaaagtggtgaaaatatgtaataattttagtatgcatgactcagtctgaaacaataaaaatctctgaaaaatgtgcatggggttcttttgtgatgatgacagtttggataaaggttccaaggttcattattcacagcccgggtagaccacctcctctgcaggtgagggagggaggggcactgtgataggacagtgcattctgtagatgcgctggctgcctctgaagatcatacacaattagactgctgcagtatggagaggagaatgcagctagctacacagagcagtagaggtgatatgcaaatttttacattcttgaggcccagctatacttcttggactggccttgagtctttccagtgatagccagcgatttcctcaatgtgcgcatgtgggctgggcacacatgtgttaaggacactcataaataatgtattttaaccttcagctacccttaatgaagctgcattactgttcctgttggcaaaatgtagcttgcccagtgacacacaactagccaaatactaaggatgggattcaaacccaggaagtatgacaagcccactgttttctc

SEQ ID NO: 28363 - DNA, 2564 bp, Homo sapiens
ggagtatgttccttcagggagaagttctggcccattgcacaaacacttggaaattaacttttccctaaattcaagatagtgtggtgtcggaaggaaatgggacagtaaattaggagacgcgggctccacctttaccttactacgtggcctttgatgagctggcttaacatccctgagtgattccatgatagagatctatactccaaactttattcctggtatctagttggcttcactgccacagacactgtactctctctttttagaagtttttttccttttttttccccctcaattggcttatttagtaaatttaggtctgaatgaattggtacctaaaagcttccaaatctatacatttcagaatatgggaattttcttcctcttcttcccccatatcccaacatggaattctggaaaactgtgcctcttcccctgttctgccttcatgggggagagactggatgaaatctacaaaaacagccaaaagtgccaccctggcttcatgtcttgaatttctaacttgctcttggcaaaggtcgctttattttttaatttttttccttgcattttcttttttattctattgctgctgcaaaaattaaggcaaaagtagctttcgatctttcatatttcatcctggtttcacaaggagtcacttatcttaggaggtctgtaagtcaggttacaaggccgggagcggtggctcacacctgtaatcccaacactttgagcggctgaggtgggtgtatcacctgaagtccggagtttgagaccagcctggccaacatggtgaaaccccgtctctactaaaaatacaaaaaattggctgggcatggtggtgggtgcctgtaatcccagctacttgggaagctgaagcaggagaatcacttaaacccaggtggcggaggttgcagtgagccgacatcgcgccattgcactccagcctgggtgacgagtgaaactccatctcaaaaataaaaattgaaaaatcaggttacaaaacaccatttttcccgaaataagacaataagaggcttttctctgaattcctttatattgagcctttcagaattctccctgggtgggcaatttctttaaatagtatttgaccctcagatcaatcctgggaatttttttcatttgggtagcaaaagctagagtattgctgtggcgattataatacttttaaaaagttttaccattttaaagttgccaacatttaattaaggttttcctttgaagcctcctttaatttagggagtaaaatgttagctaaaccaattatatactatatactatacactgtatctcctgtggccatgagaggtgtggctataccgaacagaaacatgcctactgttcaggaaagatgtcagttctggtaacacctctctgtattgggatctgttaattttgtaaatctaaattcttctgctcttggccaggtgcagtagttcatgccctgtaatcctagaactttgggaggctgaagggggggcggatcatttgaggtcaggagtttgagaccagcctggccaacatggtgaaaccccatctctactaaaaagtacaaaaattagctgggtgtggtggtgcgtgcctgtaatcccaactacttgggaggctgaggcaggagaatcgcttgaacctgggaggcagcggttgcagtaagccaagactatgccactgcactcccgcctgggtgacaaagcaatattctgtgtcaaataaataaattcattcttctgctctcctgacttagagaaatggtttgcttaaaatgctagtaacaaacatcacagtcaacaggagcttgcttcatgcgaaggatcaatgtgatttgtggatggagatgatagtgatgaaattcctgtttcatggggctgtttttcttttcatctcactgggcagcaggtttagtgaggcagtgagatgctgctgctgtggattcttgtagctatgcctcggcttcttggcatatcaggtaggaacctgttacaagtgaaatacttgaaacctctctgaccaagagcctctgatggagtgggaggtgagctaattctctgaccagcttggggcactgtttcagccactggtcacattccttgcttcaaactgaaattcagtttggctttgagtatagggatacatggtggattcatgtacttcagtgtttgttttgaccaaagtttatttttctagtgcattttctaagtcaaagtggtgaaaatatgtaataattttagtatgcatgactcagtctgaaacaataaaaatctctgaaaaatgtgcatggggttcttttgtgatgatgacagtttggataaaggttccaaggttcattattcacagcccgggtagaccacctcctctgcaggtgagggagggaggggcactgtgataggacagtgcattctgtagatgcgctggctgcctctgaagatcatacactaacttgtctttgtcagtgatgggtagaggagcaaacactctgtgcctgagagtagacaaaaactaggttcccatggtagatctggtgagttggtgatgagtcattagtg

SEQ ID NO: 28364 - DNA, 677 bp, Homo sapiens
  misc_feature (51)..(51): n is a, c, g, or t
  misc_feature (53)..(54): n is a, c, g, or t
  misc_feature (78)..(78): n is a, c, g, or t
  misc_feature (93)..(93): n is a, c, g, or t
tgccgtttttttttgagacggagttttgctgttgttgcccaggctggagtncnntggcatgatctcagctcaccgcancctcgcctcccaggntcaaagcaatattctgtgtcaaataaataaattcattcttctgctctcctgacttagagaaatggtttgcttaaaatgctagtaacaaacatcacagtcaacaggagcttgcttcatgcgaaggatcaatgtgatttgtggatggagatgatagtgatgaaattcctgtttcatggggctgtttttcttttcatctcactgggcagcaggtttagtgaggcagtgagatgctgctgctgtggattcttgtagctatgcctcggcttcttggcatatcaggtaggaacctgttacaagtgaaatacttgaaacctctctgaccaagagcctctgatggagtgggaggtgagctaattctctgaccagcttggggcactgtttcagccactggtcacattccttgcttcaaactgaaattcagtttggctttgagtatagggatacatggtggattcatgtacttcagtgtttgttttgaccaaagtttatttttctagtgcattttctaagtcaaagtggtgaaaatatgtaataattttagtatgcatgactcagtctgaaacaataaaaatctctgaaaaatg

SEQ ID NO: 28365 - DNA, 375 bp, Homo sapiens
atgtctcttgagcagaagagtcagcactgcaagcctgaggaaggccttgacacccaagaagaggccctgggcctggtgggtgtgcaggctgccactactgaggagcaggaggctgtgtcctcctcctctcctctggtcccaggcaccctgggggaggtgcctgctgctgggtcaccaggtcctctcaagagtcctcagggagcctccgccatccccactgccatcgatttcactctatggaggcaatccattaagggctccagcaaccaagaagaggaggggccaagcacctcccctgacccagagtctgtgttccgagcagcactcagtaagaaggtggctgacttgattcattttctgctcctcaagtattaa

SEQ ID NO: 28366 - DNA, 736 bp, Homo sapiens
tgtgtgtgtgtgtacttttgttttctagaatattgtaaattgatagatttagggtataaatatatgtgttttcagagattaactcagtttgctgccagtgcttctactgtgctcttactggctattttcatttatacctgctgctgagtcatgaccacccaaaatctacatgttgaagctctaactcccagtaactcagaatgtgactgtttatttggggattgggcttttagtggggtgattaggttaaagtgaggctgttagggtcggccctaatgcaatctgtctggtgtctttataagaagagggaatttggacacacagagacaccagactagtgtgtgcacagaggaaacgaagacacagcaagaaggcggccaccctgcaggccatgaagagagggctcaggagaaaccagacccaccaacagtttgatcttgaactctgagcctccagaactgtgagaaaataatcgtctgttgttgaagccacccagtctgtggtactttgttacggcagccccagcaatggatacacgtgctgtaatgcagaagcttatgccagactctgtcttcttctgaccagacactaaagagatttgtaaaactgtaaaacagtgccactctcttactaatttgggggagcggtagagacggttgtttttcataaaatattctgttaatatgaaatgggtacatttattattttaaaataaatttaaattcttaatttgatt

SEQ ID NO: 28367 - DNA, 3215 bp, Homo sapiens
agattttaattaatgcaagttctgggaccttttggggcacatgtatcattttacaaatgagctttcaagaccatttaaggaaacagatgcttcatttgctcttatctcatatttcatgacttaagaattttttagtgataataaacatagacttaattccaataattagggaaaattgataaatatctgtcaccaaaccacaagaaatccaaaatcattttaggtttaccaaacattggtggaattccatctttctgagaaaaagggaagatcatagctaatttataatagctcaaattactaatttaataactgggtcaccagtgtttcttgagccatttcagatgtatgtaaaacacaaaatatgccaaatatatattgctataatacactcaagcagtattaatcaatatggtatcacaatgcctattaagaggctttttacaaattacttacttagtaatatctgttaaattaagcattatcttctaagaccttttttggatagtcaaatataagagataaatagtttaattttttcagaccttttttggatagtccaatattagagataaatagtttaattttttcagatataatgccagtcgatgtgatctgaattttagtactagtttacacgtataaatacagtcttaaacctttatgtctgagtctgaaatgaacctgttcacttagactagattttatagtaacaaaatgtgcttttaaatgtctatgaatgaaattcttattcatggtttttattctctccatgattttattacaattttgacactagacaagaaaaaaaaatattatttgtctttcctgccccctatctgtttgctgtgatagtgcaaagaagcacaggaaaatgtttaattatccatttttctgtgatttgtaattgaaaattgttctgtggggttctgaaagtattatctttcttaagtagtaaaaatgacagtggtaatgtagatgtttttataacatactatgtactttcattttagaccaaactagagtcagaacgaatactagcatcagtggggaagaaacctccccaggaaattggaattaaagtgaaaaatcattctggaggtggcatgtccttgactcacaataaaaattttagaaaactattgaaagaaatcacaggggaaactgcacttagactgacagaattgaacaccaaagaatttgctggcttccaaattgggctcttaaacaaggatttgaaacctcagacatacagaaatgcttatgatattccccgtagaggtcttttagaccagctgaccagaatgagatccaatctgctgaaaacgcacaagtttattgttggacaagatgaagattcccttcatagtgttccagttgcacaaatgggtaactatcaggaatatctgaagacattggcttctccactgcgagagattgatccagaccaacccaaaagactgcatacttttggcaatccgtttaaacaagataagaagggaatgatgattgatgaagcagatgagtttgtagcagggccacaaaacaaagtgaaacgtccaggggaacccaacagtcctatgtcatctaagagaaggcggagtatgtccctgctgttgaggaaaccacaaacaccacctactgtaactaaccatgtgggcggaaagggaccaccctcagcctcgtggttcccatcttatccaaacctcataaaacccacccttgtacatacagatgctactatcattcacgatggccatgaggagaagatggaaaatggtcagatcacacctgatggcttcctgtcaaaatctgctccatcagagcttataaatatgacaggagatcttatgccacccaaccaagtggattctctgtctgacgacttcacaagtctcagcaaagatgggctgattcaaaaacctggtagtaacgcatttgtaggaggagccaaaaactgcagtctctccgtagatgaccaaaaagacccagtagcatctactttgggagctatgccaaatacattacaaatcactcctgctatggcacaaggaatcaatgctgatataaaacatcaattaatgaaggaagttcgaaagtttggtcgaaaatatgaaagaattttcattttgcttgaagaagtgcaaggacctctggagatgaagaaacagtttgttgaatttaccatcaaggaagccgcaaggtttaaaagacgagtcctaattcagtaccttgagaaggtactagaaaaaataaattcccaccaccttcacaacaacattagtcacatcaacagcagatcatcatgttagtgcaaagaccagtgagaaaaaaatgacaagttttctgtgctgtaggatggaacaggatattgttgaagcctcctggaatgtttgagtcaagggaattgctttccagatgctaagaagcagcagtggggcttttgaattttatgattatctggcagtgaaagctgggcttttgccttaataattttttaaagtatgaattgttttgttttgttttcctcaattgaggaagctgatgttattaattcacaggctaaattcggtaaacaccactgcccctaccacgggtaatgagaggtcactcacttgaactttgccattccaggcattctcagagtggcgaggggccacctgcaagtggagcacaacttggtgctcttactgtgtccttcagaaagaataggtgtacagaaaggaaatggcaatcttatgtgtgctgaacaaagttttcaacaattcctagttgtgccttttaaaccatgcaatattcaggatagtttgaatcaaagaagtaagaagctgctatttgggtaacttatttctctgtgggaaggggcagggagagtcaccaaacaatctacctccaactctcttctcttttgtctagagacattacaaagtgcacttgaggctgcccccaacctctgacatttgttcttgcatgtgatgatagaaagtcttcagatggacttatacattctgtgctttggaagcacaagaagaacaaaatatgtgtatatttcctttaatgtttatacaaaagtttatatggagcagtattgttatgtttgtatgaatttgcaaaaattaaagtgtacaaagagattttgattttgcatatataaaataaatcattttattgattttcacaagttcattaatgctggataaatttctacttatatg

SEQ ID NO: 28368 - DNA, 2591 bp, Homo sapiens
ggtcgcgggtcggagctcggtcctgctggaggccacgggtgccacacactcggtcccgacatgatggcgagcatgcgagtggtgaaggagctggaggatcttcagaagaagcctcccccatacctgcggaacctgtccagcgatgatgccaatgtcctggtgtggcacgctctcctcctacccatgacttgtttaaagttcacaagcttaagccaaatctgaagtggcgacaggcttttgacagctacttaaaaactctgcctccatactacctattaccattaaagaaagcactaaggatgatgggagctccaaatctgatatcagataatttagattgtggacttagttacagtgttatctcttaccttaaaaaactcagccaacagaccaaactagagtcagaacgaatactagcatcagtggggaagaaacctccccaggaaattggaattaaagtgaaaaatcattctggaggtggcatgtccttgactcacaataaaaattttagaaaactattgaaagaaatcacaggggaaactgcacttagactgacagaattgaacaccaaagaatttgctggcttccaaattgggctcttaaacaaggatttgaaacctcagacatacagaaatgcttatgatattccccgtagaggtcttttagaccagctgaccagaatgagatccaatctgctgaaaacgcacaagtttattgttggacaagatgaagattcccttcatagtgttccagttgcacaaatgggtaactatcaggaatatctgaagacattggcttctccactgcgagagattgatccagaccaacccaaaagactgcatacttttggcaatccgtttaaacaagataagaagggaatgatgattgatgaagcagatgagtttgtagcagggccacaaaacaaagtgaaacgtccaggggaacccaacagtcctatgtcatctaagagaaggcggagtatgtccctgctgttgaggaaaccacaaacaccacctactgtaactaaccatgtgggcggaaagggaccaccctcagcctcgtggttcccatcttatccaaacctcataaaacccacccttgtacatacagatgctactatcattcacgatggccatgaggagaagatggaaaatggtcagatcacacctgatggcttcctgtcaaaatctgctccatcagagcttataaatatgacaggagatcttatgccacccaaccaagtggattctctgtctgacgacttcacaagtctcagcaaagatgggctgattcaaaaacctggtagtaacgcatttgtaggaggagccaaaaactgcagtctctccgtagatgaccaaaaagacccagtagcatctactttgggagctatgccaaatacattacaaatcactcctgctatggcacaaggaatcaatgctgatataaaacatcaattaatgaaggaagttcgaaagtttggtcgaaaatatgaaagaattttcattttgcttgaagaagtgcaaggacctctggagatgaagaaacagtttgttgaatttaccatcaaggaagccgcaaggtttaaaagacgagtcctaattcagtaccttgagaaggtactagaaaaaataaattcccaccaccttcacaacaacattagtcacatcaacagcagatcatcatgttagtgcaaagaccagtgagaaaaaaatgacaagttttctgtgctgtaggatggaacaggatattgttgaagcctcctggaatgtttgagtcaagggaattgctttccagatgctaagaagcagcagtggggcttttgaattttatgattatctggcagtgaaagctgggcttttgccttaataattttttaaagtatgaattgttttgttttgttttcctcaattgaggaagctgatgttattaattcacaggctaaattcggtaaacaccactgcccctaccacgggtaatgagaggtcactcacttgaactttgccattccaggcattctcagagtggcgaggggccacctgcaagtggagcacaacttggtgctcttactgtgtccttcagaaagaataggtgtacagaaaggaaatggcaatcttatgtgtgctgaacaaagttttcaacaattcctagttgtgccttttaaaccatgcaatattcaggatagtttgaatcaaagaagtaagaagctgctatttgggtaacttatttctctgtgggaaggggcagggagagtcaccaaacaatctacctccaactctcttctcttttgtctagagacattacaaagtgcacttgaggctgcccccaacctctgacatttgttcttgcatgtgatgatagaaagtcttcagatggacttatacattctgtgctttggaagcacaagaagaacaaaatatgtgtatatttcctttaatgtttatacaaaagtttatatggagcagtattgttatgtttgtatgaatttgcaaaaattaaagtgtacaaagagattttgattttgcatatataaaataaatcattttattgattttcacaagttcattaatgctggataaatttctacttatatg

SEQ ID NO: 28369 - DNA, 3029 bp, Homo sapiens
agattttaattaatgcaagttctgggaccttttggggcacatgtatcattttacaaatgagctttcaagaccatttaaggaaacagatgcttcatttgctcttatctcatatttcatgacttaagaattttttagtgataataaacatagacttaattccaataattagggaaaattgataaatatctgtcaccaaaccacaagaaatccaaaatcattttaggtttaccaaacattggtggaattccatctttctgagaaaaagggaagatcatagctaatttataatagctcaaattactaatttaataactgggtcaccagtgtttcttgagccatttcagatgtatgtaaaacacaaaatatgccaaatatatattgctataatacactcaagcagtattaatcaatatggtatcacaatgcctattaagaggctttttacaaattacttacttagtaatatctgttaaattaagcattatcttctaagaccttttttggatagtcaaatataagagataaatagtttaattttttcagaccttttttggatagtccaatattagagataaatagtttaattttttcagatataatgccagtcgatgtgatctgaattttagtactagtttacacgtataaatacagtcttaaacctttatgtctgagtctgaaatgaacctgttcacttagactagattttatagtaacaaaatgtgcttttaaatgtctatgaatgaaattcttattcatggtttttattctctccatgattttattacaattttgacactagacaagaaaaaaaaatattatttgtctttcctgccccctatctgtttgctgtgatagtgcaaagaagcacaggaaaatgtttaattatccatttttctgtgatttgtaattgaaaattgttctgtggggttctgaaagtattatctttcttaagtagtaaaaatgacagtggtaatgtagatgtttttataacatactatgtactttcattttagaccaaactagagtcagaacgaatactagcatcagtggggaagaaacctccccaggaaattggaattaaagtgaaaaatcattctggaggtggcatgtccttgactcacaataaaaattttagaaaactattgaaagaaatcacaggggaaactgcacttagactgacagaattgaacaccaaagaatttgctggcttccaaattgggctcttaaacaaggatttgaaacctcagacatacagaaatgcttatgatattccccgtagaggtcttttagaccagctgaccagaatgagatccaatctgctgaaaacgcacaagtttattgttggacaagatgaagattcccttcatagtgttccagttgcacaaatgggtaactatcaggaatatctgaagacattggcttctccactgcgagagattgatccagaccaacccaaaagactgcatacttttggcaatccgtttaaacaagataagaagggaatgatgattgatgaagcagatgagtttgtagcagggccacaaaacaaagtgaaacgtccaggggaacccaacagtcctatgtcatctaagagaaggcggaatgctactatcattcacgatggccatgaggagaagatggaaaatggtcagatcacacctgatggcttcctgtcaaaatctgctccatcagagcttataaatatgacaggagatcttatgccacccaaccaagtggattctctgtctgacgacttcacaagtctcagcaaagatgggctgattcaaaaacctggtagtaacgcatttgtaggaggagccaaaaactgcagtctctccgtagatgaccatcctgctatggcacaaggaatcaatgctgatataaaacatcaattaatgaaggaagttcgaaagtttggtcgaaaatatgaaagaattttcattttgcttgaagaagtgcaaggacctctggagatgaagaaacagtttgttgaatttaccatcaaggaagccgcaaggtttaaaagacgagtcctaattcagtaccttgagaaggtactagaaaaaataaattcccaccaccttcacaacaacattagtcacatcaacagcagatcatcatgttagtgcaaagaccagtgagaaaaaaatgacaagttttctgtgctgtaggatggaacaggatattgttgaagcctcctggaatgtttgagtcaagggaattgctttccagatgctaagaagcagcagtggggcttttgaattttatgattatctggcagtgaaagctgggcttttgccttaataattttttaaagtatgaattgttttgttttgttttcctcaattgaggaagctgatgttattaattcacaggctaaattcggtaaacaccactgcccctaccacgggtaatgagaggtcactcacttgaactttgccattccaggcattctcagagtggcgaggggccacctgcaagtggagcacaacttggtgctcttactgtgtccttcagaaagaataggtgtacagaaaggaaatggcaatcttatgtgtgctgaacaaagttttcaacaattcctagttgtgccttttaaaccatgcaatattcaggatagtttgaatcaaagaagtaagaagctgctatttgggtaacttatttctctgtgggaaggggcagggagagtcaccaaacaatctacctccaactctcttctcttttgtctagagacattacaaagtgcacttgaggctgcccccaacctctgacatttgttcttgcatgtgatgatagaaagtcttcagatggacttatacattctgtgctttggaagcacaagaagaacaaaatatgtgtatatttcctttaatgtttatacaaaagtttatatggagcagtattgttatgtttgtatgaatttgcaaaaattaaagtgtacaaagagattttgattttgcatatataaaataaatcattttattgattttcacaagttcattaatgctggataaatttctacttatatg

SEQ ID NO: 28370 - DNA, 2539 bp, Homo sapiens
agattttaattaatgcaagttctgggaccttttggggcacatgtatcattttacaaatgagctttcaagaccatttaaggaaacagatgcttcatttgctcttatctcatatttcatgacttaagaattttttagtgataataaacatagacttaattccaataattagggaaaattgataaatatctgtcaccaaaccacaagaaatccaaaatcattttaggtttaccaaacattggtggaattccatctttctgagaaaaagggaagatcatagctaatttataatagctcaaattactaatttaataactgggtcaccagtgtttcttgagccatttcagatgtatgtaaaacacaaaatatgccaaatatatattgctataatacactcaagcagtattaatcaatatggtatcacaatgcctattaagaggctttttacaaattacttacttagtaatatctgttaaattaagcattatcttctaagaccttttttggatagtcaaatataagagataaatagtttaattttttcagaccttttttggatagtccaatattagagataaatagtttaattttttcagatataatgccagtcgatgtgatctgaattttagtactagtttacacgtataaatacagtcttaaacctttatgtctgagtctgaaatgaacctgttcacttagactagattttatagtaacaaaatgtgcttttaaatgtctatgaatgaaattcttattcatggtttttattctctccatgattttattacaattttgacactagacaagaaaaaaaaatattatttgtctttcctgccccctatctgtttgctgtgatagtgcaaagaagcacaggaaaatgtttaattatccatttttctgtgatttgtaattgaaaattgttctgtggggttctgaaagtattatctttcttaagtagtaaaaatgacagtggtaatgtagatgtttttataacatactatgtactttcattttagaccaaactagagtcagaacgaatactagcatcagtggggaagaaacctccccaggaaattggaattaaagtgaaaaatcattctggaggtggcatgtccttgactcacaataaaaattttagaaaactattgaaagaaatcacaggggaaactgcacttagactgacagaattgaacaccaaagaatttgctggcttccaaattgggctcttaaacaaggatttgaaacctcagacatacagaaatgcttatgatattccccgtagaggtcttttagaccagctgaccagaatgagatccaatctgctgaaaacgcacaagtttattgttggacaagatgaagattcccttcatagtgttccagttgcacaaatgggtaactatcaggaatatctgaagacattggcttctccactgcgagagattgatccagaccaacccaaaagactgcatacttttggcaatccgtttaaacaagataagaagggaatgatgattgatgaagcagatgagtttgtagcagggccacaaaacaaagtgaaacgtccaggggaacccaacagtcctatgtcatctaagagaaggcggagtatgtccctgctgttgaggaaaccacaaacaccacctactgtaactaaccatgtgggcggaaagggaccaccctcagcctcgtggttcccatcttatccaaacctcataaaacccacccttgtacatacagatgctactatcattcacgatggccatgaggagaagatggaaaatggtcagatcacacctgatggcttcctgtcaaaatctgctccatcagagcttataaatatgacaggagatcttatgccacccaaccaagtggattctctgtctgacgacttcacaagtctcagcaaagatgggctgattcaaaaacctggtagtaacgcatttgtaggaggagccaaaaactgcagtctctccgtagatgaccaaaaagacccagtagcatctactttgggagctatgccaaatacattacaaatcactcctgctatggcacaaggaatcaatgctgatataaaacatcaattaatgaaggaagttcgaaagtttggtcgaaaatatgaaagaattttcattttgcttgaagaagtgcaaggacctctggagatgaagaaacagtttgttgaatttaccatcaaggaagccgcaaggtttaaaagacgagtcctaattcagtaccttgagaagagacattacaaagtgcacttgaggctgcccccaacctctgacatttgttcttgcatgtgatgatagaaagtcttcagatggacttatacattctgtgctttggaagcacaagaagaacaaaatatgtgtatatttcctttaatgtttatacaaaagtttatatggagcagtattgttatgtttgtatgaatttgcaaaaattaaagtgtacaaagagattttgattttgcatatataaaataaatcattttattgattttcacaagttcattaatgctggataaatttctacttatatg

SEQ ID NO: 28371 - DNA, 1836 bp, Homo sapiens
agattttaattaatgcaagttctgggaccttttggggcacatgtatcattttacaaatgagctttcaagaccatttaaggaaacagatgcttcatttgctcttatctcatatttcatgacttaagaattttttagtgataataaacatagacttaattccaataattagggaaaattgataaatatctgtcaccaaaccacaagaaatccaaaatcattttaggtttaccaaacattggtggaattccatctttctgagaaaaagggaagatcatagctaatttataatagctcaaattactaatttaataactgggtcaccagtgtttcttgagccatttcagatgtatgtaaaacacaaaatatgccaaatatatattgctataatacactcaagcagtattaatcaatatggtatcacaatgcctattaagaggctttttacaaattacttacttagtaatatctgttaaattaagcattatcttctaagaccttttttggatagtcaaatataagagataaatagtttaattttttcagaccttttttggatagtccaatattagagataaatagtttaattttttcagatataatgccagtcgatgtgatctgaattttagtactagtttacacgtataaatacagtcttaaacctttatgtctgagtctgaaatgaacctgttcacttagactagattttatagtaacaaaatgtgcttttaaatgtctatgaatgaaattcttattcatggtttttattctctccatgattttattacaattttgacactagacaagaaaaaaaaatattatttgtctttcctgccccctatctgtttgctgtgatagtgcaaagaagcacaggaaaatgtttaattatccatttttctgtgatttgtaattgaaaattgttctgtggggttctgaaagtattatctttcttaagtagtaaaaatgacagtggtaatgtagatgtttttataacatactatgtactttcattttagaccaaactagagtcagaacgaatactagcatcagtggggaagaaacctccccaggaaattggaattaaagtgaaaaatcattctggaggtggcatgtccttgactcacaataaaaattttagaaaactattgaaagaaatcacaggggaaactgcacttagactgacagaattgaacaccaaagaatttgctggcttccaaattgggctcttaaacaaggatttgaaacctcagacatacagaaatgcttatgatattccccgtagaggtcttttagaccagctgaccagaatgagatccaatctgctgaaaacgcacaagtttattgttggacaagatgaagattcccttcatagtgttccagttgcacaaatgggtaactatcaggaatatctgaagacattggcttctccactgcgagagattgatccagaccaacccaaaagactgcatacttttggcaatccgtttaaacaagataagaagggaatgatgattgatgaagcagatgagtttgtagcagggccacaaaacaaagtgaaacgtccaggggaacccaacagtcctatgtcatctaagagaaggcggagtatgtccctgctgttgaggaaaccacaaacaccacctactgtaactaaccatgtgggcggaaagggaccaccctcagcctcgtggttcccatcttatccaaacctcataaaacccacccttgtacatacaggtatagagtagtggttgtgatttccttatggctcctagaggactaagacgctaaacaattttatttccctttttgtgttccttcctttgtgttcagtttgtg

SEQ ID NO: 28372 - DNA, 2234 bp, Homo sapiens
  misc_feature (1321)..(1321): n is a, c, g, or t
ctatttttatcaggacagattgaaattataagagtgtacatagagaacatgtttgtttagctaaattagctctataatcagatgagatcacctagagggtcagaggatgagagtgaaagagagaaagagaaaaagaagagcagaggcttggagctgacttatctgaaggttccgtcctcaggtctctttctacccttcacttttcatgccatttttcttagagattctcaccctttcctacaacttcagccattttgccgatgacacccagatgactctaaatctgctgttttcctaagtcctattctagaatcttcatgctgggacatttttaacttggatatcttgctattcaagttgtatcggatttgtatcaaatttagcatgcttgcaacctaagcacactccattctatagtcagttccactcttgactttaatatttatggtacggttagtctccacatcttccaagttcaagcttcataaccaaagatcatcttcaccttccttctcactctgcattccattggtcagcttctgttaaaatggccttcctaaggcaggcctctgaacgatcatttatttttaggaaaacttataaaaagtcactgagatttaaaaacacccacacatatatttgcaatcatatttgtgtgcttggttaaacatgtcaacatttaacagatttgagccttctaaatttaatccagcatgaatgtcgtttttactaaaatatttgctattttactcacttagctggttccttacacaagtccagttaaatttcacatgtgaaaaaaatgactgaaaacactgaatggaatgtgatactccttgtgtagtagaaatgagttgactttcatatttaagagctgatcctatgaatgagtagacaataagctgaatagctgttacgatctgagttttaaaaatggaaaatgtttcatgttttagagaatgtaaacttccacaagggcagagattgttaatacgttgtccccccagtgacttaaaacagtactggcacatagtaagcactcaataaatagttgttgaatgagtgaatgtaggaaccatactggaatcaatattgaagctacatagaaagcaccacactgtggagttcaaacaatgtctttaagttgttctcttgaaaactatttaatttgtctgttactgccacttcttccatgcccagaggaacagccaaagttactcaagtctggaacacatgatttaaaaaataattctgggataggcttttggcttttggaaagtagcgcaaataaaactttttaaaatactgtattctgacttcnggtcttgacaagagagtgtagatttatttctccctgctcctccctgaaaagtgtaattataaactctgggtaagtataattataaaataatgcaagaggaatcagaaggagaattctgaaaggtgggaccaggaagacacactgcggagggaccccaagactagaggaacaacatggttccaagacatctgacccctcacccaacagaggaaggttacccaggcttgatgtttcccgacctacaaccacacaatagaagacagcccagagaggctcgttcctacagaagagggaactgaagtctggtcggtaataccagatgagtctggctctaccagcacgggggtatatcaggaatcccactgacaaacatccagacctgagacttgtcttttgtgctgagagatgagcatccaggggcctctggcaaaaagcatctaacccaggaagattttttattaccctgagcctgagactcccttctcccagagataccatgggacctggcttgggagaaaatccttctttccctaaagtagcatcatgaaggaccattcgggaaccccagcagcaccagataaaccaagcagaccaaaataacactgcaaaggctttaaaaactaaattaccactggactcatagcccacaaaaactaagccagggcttgcatgctaaacacaaatggagtgactgcctactaaaaataaaagattaaaataatagacaaaaggttcaggatacgatgtaaaatagcctgtcataccaagaaccagaaaaatcacaacttgaataagaaatgacagtcaacagatgacaacactgagacaaatcagatgttggaattacttgacaaggattttaagcaactctcataaaaatgcttcaacaggtaattacaagttgtcttgccac

SEQ ID NO: 28373 - DNA, 1266 bp, Homo sapiens
tgcgcagggccggccgccggcggccgaggcgatgagggtgttggtgcggcgctgttggggtcctccgctggctcatggcgccaggcgtgggaggccgagtccccagtggcgagcactggcccgactcggctgggaggactgccgggactccagagtccgcgagaagcctccctggcgggtgctcttcttcggcacggaccagttcgcccgcgaggcgctgcgggcgctgcacgccgccagggaaaacaaagaagaagagttaatcgacaaactggaggtggtcacaatgccttccccatcaccaaaaggactgccagtgaagcaatatgctgtgcagtctcagcttcccgtatatgagtggccggatgtgggatctggagaatatgatgttggagtagtggcttcgtttggccgacttttgaatgaggctcttattcttaaatttccctatggcatattgaatgttcatcccagttgcctcccgagatggcgtggcccagcccctgtaatccatacagtgcttcacggagacacagttactggagtaacaattatgcaaattagacctaaaaggtttgatgtaggcccaattctcaaacaagaaactgttcctgtgccacccaagagcactgcaaaggaattggaagcagtgttgtcaagactgggtgccaacatgctcatttcagttttgaaaaatttgcctgaaagtctgagcaatggaaggcagcagccaatggagggggcgacttacgcccctaagatttctgctggtaccagttgtataaaatgggaggaacaaacttcagaacaaatattcagactttaccgtgccattggaaatataattccgttgcagacgctctggatggcgaataccattaaacttctggatttggtagaagttaacagttcagtccttgctgatccaaaattaacgggacaggctcttattccaggatcagtaatataccacaaacagtcacaaatactattggtttattgcaaggatggttggattggtgttcgatcagtgatgctcaagaaatcactaacagctactgacttctacaatggatatttgcacccctggtaccagaaaaattcccaagctcaaccaagccaatgcagatttcagactctcagacttccaacaaagaagaagcagaaaaaaactgttgctatgcaacaatgcattgagtagttaggaagaagatggataaaaacctattacatatttgtaatttattaaaaaccttatttacaagg

SEQ ID NO: 28374 - DNA, 532 bp, Homo sapiens
tgcgcagggccggccgccggcggccgaggcgatgagggtgttggtgcggcgctgttggggtcctccgctggctcatggcgccaggcgtgggaggccgagtccccagtggcgagcactggcccgactcggctgggaggactgccgggactccagagtccgcgagaagcctccctggcgggtgctcttcttcggcacggaccagttcgcccgcgaggcgctgcgggcgctgcacgccgccagggaaaacaaagaagaagagttaatcgacaaactggaggtggtcacaatgccttccccatcaccaaaaggactgccagtgaagcaatatgctgtgcagtctcagcttcccgtatatgagtggccggatgtgggatctggagaatatgatgttggagtagtggcttcgtttggccgacttttgaatgaggctcttattcttaaatttccctagtaagttttatttgtaaggaaatacagtatagaaaccttggtctttataaatggaccttgtatataaaatgtgataatttga

SEQ ID NO: 28375 - DNA, 396 bp, Homo sapiens
  misc_feature (13)..(13): n is a, c, g, or t
  misc_feature (22)..(22): n is a, c, g, or t
  misc_feature (42)..(42): n is a, c, g, or t
ttcgacacgtttnattttattntcacacctttcaacaatcanctcaccttactatccaaaattaacgggacaggctcttattccaggatcagtaatataccacaaacagtcacaaatactattggtttattgcaaggatggttggattggtgttcgatcagtgatgctcaagaaatcactaacagctactgacttctacaatggatatttgcacccctggtaccagaaaaattcccaagctcaaccaagccaatgcagatttcagactctcagacttccaacaaagaagaagcagaaaaaaactgttgctatgcaacaatgcattgagtagttaggaagaagatggataaaaacctattacatatttgtaatttattaaaaaccttatttacaagg

SEQ ID NO: 28376 - DNA, 948 bp, Homo sapiens
tgcgcagggccggccgccggcggccgaggcgatgagggtgttggtgcggcgctgttggggtcctccgctggctcatggcgccaggcgtgggaggccgagtccccagtggcgagcactggcccgactcggctgggaggactgccgggactccagagtccgcgagaagcctccctggcgggtgctcttcttcggcacggaccagttcgcccgcgaggcgctgcgggcgctgcacgccgccagggaaaacaaagaagaagagttaatcgacaaactggaggtggtcacaatgccttccccatcaccaaaaggactgccagtgaagcaatatgctgtgcagtctcagcttcccgtatatgagtggccggatgtgggatctggagaatatgatgttggagtagtggcttcgtttggccgacttttgaatgaggctcttattcttaaatttccctatggcatattgaatgttcatcccagttgcctcccgagatggcgtggcccagcccctgtaatccatacagtgcttcacggagacacagttactggagtaacaattatgcaaattagacctaaaaggtttgatgtaggcccaattctcaaacaagaaactgttcctgtgccacccaagagcactgcaaaggaattggaagcagtgttgtcaagactgggtgccaacatgctcatttcagttttgaaaaatttgcctgaaagtctgagcaatggaaggcagcagccaatggagggggcgacttacgcccctaagatttctgctggtaccagttgtataaaatgggaggaacaaacttcagaacaaatattcagactttaccgtgccattggaaatatagtaagttgggaagtcaggttgcagttctacctagttggttttctatgtgtgtaatttgctttctaaatatttttatttaggaataatcccaaataaaaatatcc

SEQ ID NO: 28377 - DNA, 1038 bp, Homo sapiens
tgcgcagggccggccgccggcggccgaggcgatgagggtgttggtgcggcgctgttggggtcctccgctggctcatggcgccaggcgtgggaggccgagtccccagtggcgagcactggcccgactcggctgggaggactgccgggactccagagtccgcgagaagcctccctggcgggtgctcttcttcggcacggaccagttcgcccgcgaggcgctgcgggcgctgcacgccgccagggaaaacaaagaagaagagttaatcgacaaactggaggtggtcacaatgccttccccatcaccaaaaggactgccagtgaagcaatatgctgtgcagtctcagcttcccgtatatgagtggccggatgtgggatctggagaatatgatgttggagtagtggcttcgtttggccgacttttgaatgaggctcttattcttaaatttccctatggcatattgaatgttcatcccagttgcctcccgagatggcgtggcccagcccctgtaatccatacagtgcttcacggagacacagttactggagtaacaattatgcaaattagacctaaaaggtttgatgtaggcccaattctcaaacaagaaactgttcctgtgccacccaagagcactgcaaaggaattggaagcagtgttgtcaagactgggtgccaacatgctcatttcagtccttgctgatccaaaattaacgggacaggctcttattccaggatcagtaatataccacaaacagtcacaaatactattggtttattgcaaggatggttggattggtgttcgatcagtgatgctcaagaaatcactaacagctactgacttctacaatggatatttgcacccctggtaccagaaaaattcccaagctcaaccaagccaatgcagatttcagactctcagacttccaacaaagaagaagcagaaaaaaactgttgctatgcaacaatgcattgagtagttaggaagaagatggataaaaacctattacatatttgtaatttattaaaaaccttatttacaagg

SEQ ID NO: 28378 - DNA, 182 bp, Homo sapiens
agcgatatgtgaagtagttttagctttgagtcattgccttaacactgtcacatttttcttcctatctaatttagggaaaacaaagaagaagagttaatcgacaaactggaggtggtcacaatgccttccccatcaccaaaaggactgccagtgaagcaatatgctgtgcagtctcagcttcc

SEQ ID NO: 28379 - DNA, 388 bp, Homo sapiens
ccaattcctctaattgaaagaaaagtccagattaacacaaaatagtagttgaaaagggtttgggagttgagtgtattcctttatcataccttctttaattttacttgcagattccgttgcagacgctctggatggcgaataccattaaacttctggatttggtagaagttaacagttcagtccttgctggtactaacttttgaatagctaacatggaagctgttttcactgtagtgtatctggaaatacgtctgttttatcatatgtcacaattactaaaaataacttttagtttgtttcagttcagtaattataatactttacattcacttattgtcttattctttgcaacactcattctcatatattttctcatttaatcattaca

SEQ ID NO: 28380 - DNA, 560 bp, Homo sapiens
gacattttaaggcaagtgccaagagatgtcaccaattaatgttaagaataaaaagagggtaaccgtttttttttttctagagtcagtaaatataagcttgagttgaaagactttacttattcctgctgctacaatttaattctctaataataatattatattcagagtatggcttattaagtacagggcccacatattgaaccaagttcatgcagatttggattgaagttaatactaacccaattacaggttgactataacttgactcttaaatttgatattatcttcaaaattataaatagattacagagatttagaactggttataatttagtaagattaactttgcagtgttagaatttttagcaacaaatttttagaatttttttagcaaaaagaggaaatacacattaacaataaaatatgctagactgcctctgttgcctaaacagagcatcatgtggttaaagaactgtagaaccgggcttacaaaggtctgaattctagccactgctctccggtgatgtagctgtgtaaccctctctgctgtattctcgggt

SEQ ID NO: 28381 - DNA, 511 bp, Homo sapiens
ccactaaaaatagcatccccccaaagtgtctgtgctctgcccttctccctctgctttctgcactgtatttcatgtctggcgaggcagcccctggtttctaatttggagccgtgtggaaatgacacccagcacggtctctagtcctcactcctctttttggcttcggagtagcatttccacctctagcctggtggtcacttgggcattctgcagtcgccttggatttaccatacccctaactgaaataatcatttccatgtccttctaacccctcctcctccatctggctctgctgcttctttactgttaacctgttttccttttctctttggcgtcatctgtgacatgcctccctctgtgttgtccctcactcccttactgttgtacagtcttgagattcctcacgcacagtgctctgcctttgttctcaagggctctatctcttttttttataataaaagtcaatgcttattgttgaaaatttactatattcagaaaaataccaaaaaaa

SEQ ID NO: 28382 - DNA, 555 bp, Homo sapiens
tttcacctatgaatactgtcaaagcattataaatgccttaatattacctatatatttttttacaaaccattaagcagtaaccttcctaaaataaaagtatttccccccctataggttaaggtctccctaagtatcccttatagatcatcatttaagctgactattcattgagtgacataaactgaaagctgctagagtagaatgacatgagaaaggaaacacagctgtagatggaatggaagggacacctgtggagctccatcccatggatctcagtccaaatccaaacttcacagctgaggcccaggggaagggaagacaggttttccttactgaaaagacttcactttttcagtcacacaaacattttagaccacaatagatttaatagcataaatatattttatgaaggtaacccaatcgatcataaaccaaaaaaaaaaaaagaaagagaaaaaggcaaatctactagagtgcttttttaatacaacaaagactgtaaaatattgaaaatatcagggatatcacattttcctcttcactgacaaataataa

SEQ ID NO: 28383 - DNA, 604 bp, Homo sapiens
tttttttttttcagacagggtcttactagtcactcaggatggagtgcagtgctgcgatcgtgatcactgctcactgcagtcttcagctccccaggcttaggcgatcctcccatctgtctcctgaataatagggactacaggtgttaggcaccacgcctagctaatttttgtattttttgtagagatgaagttttgccatgttgcccaggctggtttcaaacttctggactcaagtgattcgactgcctcagccttccaaattgctaggattacaggatgaggcaccacttccggccttatatccatttatagtaaacacaagccaacactatgacccaacattttactcctagattatatagttaagagtgtgtatgtcaatcaaaagtatatgttagagtgctcatagcagcttctcataattccaaaatgtggaaacaactttaaaaactagtaactaaagaatgtttaggtgacgtgtaatagatttacataatagagttctatataaaaataaaaataaacaagctactgataacacacaacaacattgctgaatctcacagatacgttgaatgaaacaacaggtcgacacaaagagaat

SEQ ID NO: 28384 - DNA, 480 bp, Homo sapiens
cgtgttcttatatcagcaagcagaaactatggggagttggttttcaattattgagttttatttttgcttgttttaatcctgatttgtttcataattttctttcccattagattgctaataagtgtattctgctggccagctcttactcttaacttaccaagagagctccctaaggggaaagacgtattttacttgtcttctcttgttctctctggacaaggaccagtgcttatcaagtgcctactacttgcttagcagacattttctccatattttatgaatgaatgactgaagaaaggacatttacttataattcaccaaaaatatgtatattatatacgtacaatggtgaattataagtttttcatccaggaaagagcctgcctttctgtgctacagatattggaatggttcttacttccagctttctcccaacagacattttatttccttcctacagggagttctcctttctctttg

SEQ ID NO: 28385 - DNA, 465 bp, Homo sapiens
ttttataatctagcacctgttgtaacatctagcattttatggatatgtttgaaacctgtaatctaaatgacgatagaaatatggttcttgttttgtgcaggaagtgaagaagtaactgttgctgtgttaagttctagctgaattcaaagagtgcaaggccagaggcaggctttgtttatagcctcctatctgatttccaaaagtgaaataactatttttcagaaaacctcttgggttctcaggcaactgacctacaaacagaaggtcagacttcaataactctaggattccttttaaatgctgaagatgaaatattcaatgatcaataattaagcaaaaacttccccacaaaagatcccttttatagagtgcttgatttttaaagacgttttactgttcaacttggacacatgagattataaaagccagtgtgatatgaaataaatctatacacaactacttagc

SEQ ID NO: 28386 - DNA, 486 bp, Homo sapiens
gactccaactgggttcaagagatcctcccacctcagcctttcaagtagctgggactataagcatgtgctaccatactcagctgttttcagttttcgaatattgaacatgatgctgtcatgaacatcgttgggcatcataatactttatttagaggtgagtgggcagagtttgacaggcagatcagaaaatggggtaggaggctgggcgcggtggctcacgcctgtaatcccagcactttgggaggctgaggtgggcagatcacgaggtcaagagattgaggccatcctggccaacattgtgcaaccccatctctactaaaaatacaaaaattagctgggtgtggtggcacacacctgtagtcccagctactcaggagggtaaggcaggagaattgcttgaacccaggaggtggaggttgcagtgagccgagattgcatcattgcattccagcctggcgacagagtgtgactccacctcaaaaaata

SEQ ID NO: 28387 - DNA, 369 bp, Homo sapiens
ccattcacgccctttacactttgtaacttcacattcatcctctccatttacacagaccacacactccaagaaacatcctctccatttatactttgtaacttcacattcatcctctcccaccaagtaacatcctctccatttgcacatcctctccatttgcaatagggcacattctgagtaaatgactctgtgacttcacttcattctcttcatttacatagaatattcaccaagtaaccaatgggaaacctctagagtattgagaccctagaaaattctgtaagcagagctcttgagcctctacgctcaagcctgctcccaaactgtggggtggacttttcgttctcagtaaatccttgcttttgcttt

SEQ ID NO: 28388 - DNA, 346 bp, Homo sapiens
ccaagaccggcctggtcaacatggtgaaacgccgtctctcctaaaaatacaaaaattagccgggtatggtggcaggtgcctataatcccagctactcgggaggctgaggcaggagaatagcttgaacccaggctacggaggttgcagtgagccgaaatcacgtcacttcactccagcctgggcgaaagagccaaactccatctcaaaaacaaacaaaaacaaaaacaaaaaaacagaaaaagaaacagtgctttgtggtatgtataaagcttacatttgtgtttataaataaattgaataaagcttacatttgtgtttataaataaagttttattgcatgcattaa

SEQ ID NO: 28389 - DNA, 519 bp, Homo sapiens
tttttagtgattccatgtcagaaaggtggaagaaaatttgaaatgttagttttaagaggtttgcaaagtcttagccaaatattagaagaattcggggtcagttaaagtttacaggtagatcgcaaaacctcaaagacaataaacaggagtagagtctaataacaggtgtactatagttttctattggaacataatttttctctctacagccacccctacttctgccaaagatagttgcagtaagaatagtttacaaaataagtctactgtcatcatgtcctgattatttacataagtgtagcaatagtagtgattaaccataaaggctctttttaagttggcttcactggaactttaataagaaatatcagattggactttttaaagcatcataaggctaagatgccaacctaagaacttgtcatcagatattgtagcatgataaattttttttcctctcactcctttgtctgtactctgcccatttctgtgaaaacagagagttgattgaaaaaaaaa

SEQ ID NO: 28390 - DNA, 1118 bp, Homo sapiens
aggttttccagataaaagattatacaggtttggaatcttaatatccaacccccaactccaagccctgccccaacaacaacagctaattattttacatcttgatgatggtaaatttttcatgattaaccaattttgggcacctattccgccatatatggttttatttaattttcacagcaacacttcaaagttgatattcatattctaaatttatagatgaacgaagaggctcaaagattaaacaacttgctaataagtgatttttacccatgctttttccattatattatgttttggatttttccagagtacccaaacccagcagatgcatactgctccaaaataaatggaactcaatactggctctgtcaagtgtctcttgccaatcaattgtccttctaatcttttgaggggcagttctctcagttgtaccaagtcactgtcatccccaaacttttcaatgattccaggcctttaacaactcccctccacctccaaaccctctctcaccaaattgtgtaatttctttgtttactgctggcttcatcatgcacttttccttcatagcctattttaagaagttgacttgctgaactgctttttagccaagctatttgtaaatcaagctacacaaagtatgtggccataatttccaaaaggcaaatgatcattgttcaattgctgttgctctgcagtgtgcattcatgcagttaaaaattgtactgcattgatagtacggcatcagagaatagatcacttaggttcaaatcccagtgcatgatcctgagcaagattatcatatctagatacattagtttttatctgtgaaatgggaatgatagcacaatcttcatagaattgttggtaaggattaagtgagttgatatgctcaaagtgtgcatgctggcatagaacaagtcactgtttacaagcctttaaagaaggagctgttctggcactgtaaacttgaaccttttttccccaaatctaatggatataggcaaggaaattatatttatataaaataaatgtttgactacctttgatcataaactttattctcatcttgacctgttcctttgaaaagataataaatactgatatgtgaaaaatgtatg

SEQ ID NO: 28391 - DNA, 465 bp, Homo sapiens
ttaattgctcatcctatcactgcttagtcttgccatctgacccttggttgttttattcttgtaaaatgaagtcactggagtaagtagattaatgattcataacccaaaggtaaattgcaagctgatatatccccagcagtgacgcagagtattgcgggaagcaagggataaaggagctgagttcctgccaggaaggagggctcacacacaagacaatgcagtgtgcctggcaaaacacttgactagatcatctctacagtcctctgtaggttttaactgttcgtgctgttgcgatttcatgtttcacctcaaccttctctttgagaagcttagcatcctttagatataatcagtttcggaataaagaatgtttgggattttaagatgccttagcagttatctcatactgtatttctcagctctactcacagcctactttatcagtagcactgataatatgattgc

SEQ ID NO: 28392 - DNA, 405 bp, Homo sapiens
tttccattatagttctcattgtcatctgatacattgtatttttacttattatatgatttaaaagaaaaacaacaaggcaaaataagagattttgtctgagcacagtggctcacacctgtaatcacagcactttgggaagatgaggtgggaggattgcttgagaccaggagttcgaggctgcaatgagctatgatcacaccactgtactccagactgggtgatagtgcaaggccctgtctctaaaaaaaatgaagaagaagccagtggaggaaggggggagatttttgtctattttgcatatttctgtatacaagtgcctagaatatagtactaagaacactcagaatggtgtctggaatatagtaggtgctcaaaaagtagtagttgcagaataaataaataaag

SEQ ID NO: 28393 - DNA, 1221 bp, Homo sapiens
ccaatcaaaagtaacagctgccacctttttctatgagacttgattataattttctatggccaagggtttgctgtgacacttccacatcattcttcagtatgtagtccagagattagctacagattcaagaaacacagactgtaaactattatatacagacatatctcaaaataagcatacccattagtgccagctgccctgaaagactgaatgaccccagctattttccaaatgttttttcagaaagccatgaacacacctttctgggatcctatctatttcaaagacaggcaaagctctgtggttcagttccaccacccagtaccaagcccacagtatgcagaccatacgccttacacatggccttttctctttatgtaattgctgtaccatattcagcagatctagactgactcaaagcatgttccctcaagaagctccacagaaaaaaaggtttctgtgatcaaaaatcatttgggaaatgctgcaaaccctatctgcctcttagagcttaaccatgcatgtcggggcataatataaaccttttccagtctgggccacagagtgagaccccacctctaaaataataaatcaataaactcttgagaagtacacagaaaagaaacttctgtaactttttaggtcttaattacaagcaattgtagcttaatctaaacttgctcttcactttatttctatgctcttgaaaactagtgacataagccttatgaattttttgtttgtttgtttcttctttttttaagagagagacagggtctcattctgttgctcaggttggagtgcagaggcacaatcatagctcaccgtaaccttgaattcctagtctcaagtaatcctcccatctcagcctccctaataactaggactacaggcacataccaccacatctggctagtgtgtgtgtgtgtgtgtgtgtgtgtgtgtgtgtaaagacaggggtctcattatgttccccaggctggtcttgaactcctgggcttaagcgatcctcccaccgcagcctcccaaaactttgggattacaggcatgagccactacacctggctggattattctttctttaaaaaaatttttttggccgggcgccgtgactgtaatcccggcactttgaggggccgaggcgggcgaatcacgaggtcaggagatagagaccatcctggctaacacggtgaaaccccgtctctactaaaaaaaaataca

SEQ ID NO: 28394 - DNA, 564 bp, Homo sapiens
aagatattaaggggtgtgcatttccaaagtaatggaataaataaaaacaacaacaaaggaaaataagtgattcagggaaaacaaaatctaaccacaataggaaaagacgaaggtaatttccaggatgacagttgggcagccgacttaactaagtcttaccacaaacactaagactgattcaagaatttaaggacatttaagatagatgtctttataataaggtttgcacaagaacaaaaatgtaatcaaagtgtatcatctgtttcagcaatgaataacataaaaacaaacagcagacaacaatttaaccacaaaacaaaattaagagtctgagaagaggaaaggagaaagagagatacagacatacattagaatttttttttttttaattaaagcagcagtaggaaaatggaagcaaataccagaagaaacagttaaaataatggaaagcagctgcctctggggagaaggcctaggaaatgggaaaaacaccagaaaacaggatgactatttttcattataaatgttgtagtccaatttcaccttttcaattgctctggtttc

SEQ ID NO: 28395 - DNA, 443 bp, Homo sapiens
ccaagaccatggggctgagtattttggaatgaatatcttacagtgagaacataattgaatgggctgctttatgacaaggtgagccctctgtcaatgagatgctcattcattcactaattcattgcaaagcatctgttcactggaaattggatgctatagtaagtactaaagaaaaagaagccattaagacaaatcgagtccttcttctgaaggagcttagtgcctagtggtggaggaagagtcagacaactcattaatgatgaccccactgtgtgataaatgctgtcaagggaattgtagggtgttgtggaggcacagagagattcaagggaggtgccttggaaaagtgacatggaaacagctaactagacagatcagcaaaggggtgtgtgttggggagaaggaagaaatatatgtagtaggcacaggcatggatagtatgt

SEQ ID NO: 28396 - DNA, 242 bp, Homo sapiens
ccaagaccatggggctgagtattttggaatgaatatcttacagtgagaacataattgaatgggctgctttatgacaaggtgagccctctgtcaatgagatgctcattcattcactaattcattgcaaagcatctgttcactggaaattggatgctatagtaagtactaaagaaaaagaagccgcgtagtctatcgagccgcgtagtcagtcgagccgcgtagtcagatcgaccgcgtagtca

SEQ ID NO: 28397 - DNA, 1171 bp, Homo sapiens
taccctttcatgcacatgtcctcttaaccctccaaccctccgtgggttccaacaccctatgccagttccacatggtcatgtggataccttcctattctcagtcagactccaataccctgctctgggccaccatgtccttcccttctcccatctgaatgcctgtctccctcaaccccatctaatgactttggactgaattgttagagtgagactaaatatgcagttcatgtgcctggggtcagctactccagtctggttttgtatttcttgtctcttaactacattctaagctacctatcttgcaaatagcagcagatatcaaataaattgataaaggagtactctgcaacttttatattttatgttataacatgaaaagtcatgttgtaacatttttagtggagtgtatattggcacagctcctatggagggtatggcagtgtctccaggagcatctcttcatttagagattctctaggatgtattcagagttgagatttattgcagcaatagagtaaagacactgtcagatcataagagaaaaagacactggaggaatctggaagaatccgtgtgcctgtttttttatgcccactccctttaggggtgacacagagcacactcttttcctagtcatgaaaatgcagcaatgcatgtgtggtattcctgcccagggaaatccattagagactcagcatccaggattttcattggtgctagccatataagcactctttaccaaacatgtacccaaattccagactcccagaaggaaggcagatgttcagcattaaccatattgtttgtacaaacagtctaggcatactgagccttctcccttccccacttaccaattaacttggagcgtctaaaagccaaggtcccagatgctagccaagagcaagccttgcaagcaggcatttctaaggacagtagtctaagagctgctatgctaactcttttctgcactgaggcttattggctgtattgcttgaaagaactaaatacttatactttttacacataggtatttacctgcaaaataagatgtgtgcagaattgcttattgtagcaatttgtaatagtaaaatactggaaataacctaactatccttcatttaaaataaggttttactacattcatactgtagagtgccaggtagctgttaac

SEQ ID NO: 28398 - DNA, 578 bp, Homo sapiens
aatcagtttacacaaattaaaaaaataaatcataacatttaattagtgatttcttcaaaaatatactaaaacaactctattaacctatcaactgcaaactcctagaagccaatttattttttactcttgagttttcttgtgtatttaagaataaagagaaaacaactaataatttctgggacagcccagccatatggactctgactttctcctccttcaggactcacaggtcagcctgctgctcttattgccaaggagaaggatatttctatccccagcccattcaggacttaatcttgtgtaaactgattgtgtccagtgaagaatctcttcccctctttctctttcggtccattggttgagttgtgagtgctgaaaagatcattcatatgaccaagattgtgatgcttagatgtttatccccagcaaacatgtaaactatagaaatctcagttgtctccaccaaacatctaaactgtatagcatctaagcagcctgaggctttcaccagatgcccagtcttccagccagcagcattgtgagccaaataaacatttttttctttataaattactcag

SEQ ID NO: 28399 - DNA, 334 bp, Homo sapiens
ctttttatatttattttcatcgctacacaaacattttttaggagtttgattctacctccattttggttagatatacaaactctaccccatgagggatgtatggtgtatttctagatttagcaacaattttcttgaaaaatgtacaatactatagaaaaatgaagatagtaaataccaggtataagttaataacagtgtttcttttgttcagtaataatgaactgtgtactagcactgaactttaggccctcctatttgcgtattttctgtttgtatatttttaaatagaggaattgtgattataatattattattttggaatatcctaaatcat

SEQ ID NO: 28400 - DNA, 179 bp, Homo sapiens
tcatgtttaacacccaaattttaatagactttattctttagaccagttcaggttcacagcaaaattgggtggaaggtagacagtttccataaacccccagcccctccacacacacagactcccccactatctacatcctcatcggagtggtccatttgttacagccgatgtcgacgcgg

SEQ ID NO: 28401 - DNA, 561 bp, Homo sapiens
cagttgtgttaatccatatatattcatactgtttttttttgttgttgttgttgttttgttttgttttgttttgtctgttctgttactgagaggcatatgttaaatctcccactgtgattatggatttgtctatttttccttgaatatctgttcaatttttgctttatttatgttgcaacatagttaatagtaacatatctactcaagtgctcccctacagctctcctcccaacatatacaaaggcatgtcatcagtttaaaacagccctggccgggtgcagtggctcatgcatgtaatccctgtactttggaaggccaaggtgggtagatcacgaggtcaggagttcgagaacagcttgaccaacatagtgaaactccgtctctactaaaaatacaaaaaattagccaggcatggtagcaggtgcctgtaatcctagctactcaggaggctgaggcaggggaatcgcttgaacccaggaggcggaggttgcagcgagccaagatcctaccactgcacaccagccaggacaacagtgcaagacttcgtccccccccccccaa

SEQ ID NO: 28402 - DNA, 487 bp, Homo sapiens
catttaacaccctccccttaacgatctccacctggcagcctccatttaacccaaaattcagggcatcaatcccctgtacagcccatgttccattggacaggttgggggctcagatgtttctcatagacaaggaatgaatctccggattggccactcctggattccctagctcaggacacacattcaggtgcatcatcaatctggggtcattctaaatatatgtttaagttattgctatcaggggcttttaccctacaaaaggcattaaataattaaaagtcataaaatatgctttaattagaaaactaggcatgacatttccaggatgatttcatatttatattaaattgaaaatatgtatgattttctgcagctattttcactcatggtttttaaaacttcatgcaatgggctgagtaaggtagctcatgcctgtacttgcagcactttgggagactgagtcaagaggattgctgagtccaggagt

SEQ ID NO: 28403 - DNA, 2716 bp, Homo sapiens
caaaaaaacaaaaaacaacaacaaaacttgctaccacccagggattttctgctatttaaaaggtgaatttcttttctggtactaaactgtagctgcttaacttagtaaaggctgtgtttggccaggcctgtgccagaggctcacctggagtgctccacccactggcaggcaagtcctattcctattcacccaggatccccaaggctgggctgggatataaatgttgggataggaaagaaatatttcctttttagaggaaagcaagaagaaacattgcctgaaaggtgattttctagtcatttccaattagtacagaaatgttactgcctctgggtgcagtggttcacgcctgtaatcccagcactgtgggcggatcacttgagcccaggagtttgagaccaacctgggcaagatggcgagaccccatctctacaaaaaaatttaaaaattacctgggcatggtggcacacacctttattctcagctactcaggtggctgaggtgggaggatcccttgagcccaggtggtcaaggctgtggtgagctatgatcatgccactgcactccagcctgggtagcagaacaagaccctgtctcaaaaaaaaaaaaaccccaaaaactgttactactaggttggagtagcctaaggcagtagggcaaggaggtgggcccaggctggtctgtggggagctggagaatggtgactcgagtgaccagtggacaggcaggacccaggccagcattacaagcggggatgtcaggcaggagcaggggagcttctcgcttggcagctggtttatggtacacttttgaaaagtaagctcccagggcctggccctcacatgctcagtgaatatttgactgaagggtcccctcatagcttgggagtattcacaggcctaaatgttagttatactattagctaagcctggtcctttgttacgaaatttaaaaatgaaattgcaacattcttgtggaaattcaaagacatcattttctttcaacaaattcacacattcgttcatgcttcttctataccttttacccctaaagtcatccactcctgagttcctcctgctggtttcccaaactgcgcaatgactgccccatcataggcagtggtccgtggagtcggcctcactttcgcctttccccgcatctacttgtttccaaggccagtggtacttaactgggtcaagttgcctgtggaccttcaggaacagaattgccatgttcctcactgcctggcaggaaaggctccattccaagcccagtgaagatgtgtgcctatccagccgcccaccaaggatgtcatctgtagaatgggtggagggcaggggtttatttggtgtatatttttacattaaaatgcacttaatatcactttgtaaagcccagatgagtgcaaatgtgcctgtaacttcctcctttaatctgtccaggtagtatttagtctttagtcttacattttctttctccctttatttcatgaaattccttgagaaaacttcaacagtaaagaaagaaatttcgttcatctcacaactcttccaaacgaggaaacttagtgaaatatttcagagcttctagatgtgaggtacaaaacttgggatcaaatggaatcttgattcactaaccaatttaagatctgacttctaattttaggaactttgggttatgaacgcttccattttatacctgtgtctagttagtttctgcctatctatccaagaagcttttatcaagggtccaccatgtgccagccactgaagtagatataaatacaaggatgtgtaaggtatggatgatggtatacgaactgtcatcttactggatttgtccgctctgttaaagatacggttccgaaaactttttaaagccctagagagggctttaaggcaatgtagcatcatatatagaggcatcaacctgttcatatctttctatttaacagaactgtgcacctgggcacaagggtgtgcacaacaggatgtgtacagcagcactgttaaagtgtagcacatccatactacaggatcttatgcaactgttggaaagaatgaagcgatgctgcactgtggtcatgcagtgatctctaagacatattaactagaaagcaaaaggtttaacaatgtatagcagctgggcgcagtgactcgcgcctgtaatcccagcactttgggaggctgagtagggcggatcacctgaggtcaggagtttgagaccaacctggccaatgtggcgaaacgctgtctctactaaaactacaaaaattagctgggcgtggtggcgcgtgcctgtaatcccagctactcggcaggctgaggcaggagaatcgcttgaactggggaggtggaggttgcagtgagccgagatcacaccactgcattccagcctgggtgacagagggagactccgtctctaaaaaacaacccccccccccccaaaaaaaaaaatgcatagcaagctgtaatgctctttgtgttttagaatagtagaggtctggaaagttgtttgcttttccccagtttttttttgctgtgttacctctgaagggaattgaggtagaggggagagttagaaggaatattcggcttttctattttatatcctcctaggtgaaatttttacaacaaacatgtactggtgtattttgaaatgtttttaaatttttgtatttcaaaataataaaatataaattcaaactgcaagctgg

SEQ ID NO: 28404 - DNA, 480 bp, Homo sapiens
gactatttcagagtttcatcccaacatccattcccaaatctgacacaaagagttttccttaaaaagtgatcccatagaatgtaagtactgtctcagaagcagatcgtagtcttgatagaggcttgagaaatttagcacaactttttaaggaattcatctcaaatgagtattatctttttgttcttaccttcgtccacttttaaatttaagataattttgatgaataaattgagttctgcttttgatgaaagaagcaaagaccagtatttgttttctatttatttgtagggttattctagccttagtttcttctagatttaagtataatcacttattttatttttaaatagttcaacaatttaacatttcccattccccggtgtatattaaaactgaagaggacgttctcatcctcacgagttgtccctttgagtgacctggatgcttgggaacgaggggctaccccgatgcttctctcct

SEQ ID NO: 28405 - DNA, 273 bp, Homo sapiens
gtgaagggcaggaggaaatgaagctaaggcataagcaggagccagcatgattataaggaccttgtaggatatgttgagaatttgagcttttattcctgaaagtagagggaaaccactggagtgtttaaagcaaaagagtgacaggatctggttaggagtggtagttcacacctgtaaacccaatgctttgggaggctaaggcaggaggattacttgagcccaggagttccagacaagtctaggcaacatagtgagaccctgtctcttcaaaaa

SEQ ID NO: 28406 - DNA, 389 bp, Homo sapiens
ggttaacacaccagtgacaggacaagccaccatcgggtgtgtacctcctaatagtggtccactgagaagaacagtgtcatgtctgtggcttcctgtcaaaagtgtataaactgaatctcagcacgaataacaggcaaacccagactgggaggtgttctacaaaaataactggcctgcacttctttaaactctgaaaaacgaatgaagaactattccacagttaaaggcgacatgacagctacatacatggtatgatcctggatttaactctggatcagaaaatggtttttgtgctgtaaagaatacaggtagggcaattaatgaaatctgaagatggtctgtagattatagtattgcatcagtgttgagtttccagttttcataattgc

SEQ ID NO: 28407 - DNA, 375 bp, Homo sapiens
cctggggttcaacatcacccccaatgggctgtgtgtcttgaggcaagtcactatccctctctgggcattgatctgaatgcaggggagggataatccaccacttgcaagggtgttggaagggtagagagactctgagtggggtggtgggggcggggggctttataaactggagggctgtaccctctggcgccgtggatacaaacgcctcattctttctccttctttctctttatcccattcccaatctgtcagtggagagagccccgagcagggtaagtgagtggcaccctgggactctttttatattcttgggaggccaacgctggttctgagctgatgggggcctcagaatgagacctaggtcgatcatggtgg

SEQ ID NO: 28408 - DNA, 302 bp, Homo sapiens
aaaggtaaaatcatgactcacatgcaaatgtaacatgaataaatgtcaaaaattttacttaacccattaattaattagggaatgagtaagatgctaaaatgagttcaaggagaatttgaagaatacacacacacacacacacacacacacacacacacacaaaatcaggagtgctgaaatgaatttgctaaaaagataaatgacgagttaatgggtgcagcacaccaacatggcacatgtatacatatgtaacaaacctacatgttgtgcacatgtaccctagaacttaaagtataataata

SEQ ID NO: 28409 - DNA, 387 bp, Homo sapiens
ccaaagggcaaagctgagagcaggggtgaattacacctaggaattgagactcacctaaggattggctgattggatttcagaattgttacagaccagggattcccttgtgcctactatctcttggcacccgccccccgctttgataggaatgttttatagaggttaccttaagcctgacccaatactgtatatttggcaagtgtctggagaaaggatgaggaccaggtaacatatcgctttggctttacaggtcagcaggaattgtacttgagaagctgtacttaaggaacatccaagaagtcccaactgtacctgaatctaacttagatgagattctagactttgagctgtgataggataagacttttgaatataacagctaaaaaa

SEQ ID NO: 28410 - DNA, 385 bp, Homo sapiens
gggaagggtttttcagccaggaaagtgaaatgtgccaatttcacttaaaaacagatccacttgggagaatgtgtgcaagatgcaagcgtggcagtgggaggtccggctggagcacttgtgagcttgggtgagagtggggtgtcatggcggacgtgactgtgggaagggctctgaagaggggtcggggacagtgaccagcaacaaggtggatggtgtggccggttactgagatggggaagcctggaagaggatcagatttaaaggggtaagtaagaaatgtggttgcagaggcagtaatttgaggtatctgtgtgacatccaaacagagatgtcagattggcagctgtgtgggtacatcttgctcaacacattaaataaaaaaaaa

SEQ ID NO: 28411 - DNA, 304 bp, Homo sapiens
ctcgtagctggaactacaggcgtgcaccaccatgctgggctaatttttggcatttttagtagagacagtgtttcaccaggtttcccaggctgatctcaaactcctgggctcaagtgatatgcccacctcaacctctcaaagtgctgggattacaggcatgagccgaccgtgtccagccaaataccacttattttttaatcgagtatacatcaaagcaaagacaatgcaaatggtgctcagagggacttgtagttgttttcactatcaatctctttggctccagaggtgttaaatactgtcagtt

SEQ ID NO: 28412 - DNA, 181 bp, Homo sapiens
gatcatctggatagattaaaaagggattcataaaatcgtgcaccctttacaacctctctttgaccatcataatgagtaaaagagcttgtgggggcaactcaaaagagggttctcctagggctcttcaatagaaggggatggggtaatcaagacttgggaatctatccatatcaggttgata

SEQ ID NO: 28413 - DNA, 1404 bp, Homo sapiens
atggccacccagacctgcacccctaccttctccactgggtctatcaagggcctctgtggcacagcaggcggcatctctcgggtgtcctccatccgttctgtgggctcctgcagggtccccagtctcgccggtgctgcagggtacatctcttctgctaggtcgggcctctctggccttgggagctgcttgcctggctcctacctgtcttctgagtgccacacctctggctttgtggggagcgggggctggttctgcgagggctccttcaacggcagcgagaaggagactatgcagttcctgaacgaccgcctggccaactacctggagaaggtgcgtcagctggagcgggagaacgcggagctggagagccgcatccaggagtggtacgagtttcagatcccatacatctgcccagactaccagtcctacttcaagaccatcgaagatttccagcagaagatcctgctgactaagtctgagaatgccaggctggtcctgcagattgataatgccaagctggctgctgacgacttccggaccaagtatgagacagagctgtctctgcggcagctagtggaggccgacatcaacggcctgcgtaggatcctggatgagctgaccctgtgcaaggctgacctggaggctcaggtggagtccctgaaggaggagctgatgtgcctcaagaagaatcacgaggaggaagtcagtgtactccgttgccaacttggggaccgactgaatgtggaggtggacgctgctcccccagtggatctcaacaagatcctggaggatatgagatgccagtacgaggccctggtggagaataaccgcagagatgtggaggcctggttcaacacccagactgaggagctgaaccagcaggtggtgtccagctcggagcagctgcagtgctgccagacggagatcatcgagctgagacgtacggtcaacgcgctagagattgagctgcaggctcagcacagcatgcggaattccttggaatccaccctggccgaaaccgaggcccgctacagctcccagctggcccagatgcagtgcctgatcagcaacgtggaggcccagctgtctgagatccgctgcgacctggagcggcagaaccaggagtaccaggtgttactggacgtcaaggcccggctggagggcgagatcgctacctaccgccacctgctggagggagaggactgcaagcttcctccccaaccttgtgccacggcatgcaagcctgttattagagttccttctgtccccccggtgccctgtgtcccctctgtgccctgcaccccggctccccaggttggcactcagatccgcaccatcaccgaggagatcagagatgggaaagtcatctcctccagggagcacgtgcagtcccgcccgctgtga

SEQ ID NO: 28414 - DNA, 1468 bp, Homo sapiens
agcagcttgaacttagttctcgctgagtcccggctcagggcccttcccttgggtcggggggttggctgtgcagtcaacaataaggaaaaaggcaagacactgagggcagctgaaagacttttacctttgacgagctggtcacctgctccagggaaggtacattcctctccccacaaccctagaggcacctctctggtccacagtgtccctcctgatgctcaggtcgggcctctctggccttgggagctgcttgcctggctcctacctgtcttctgagtgccacacctctggctttgtggggagcgggggctggttctgcgagggctccttcaacggcagcgagaaggagactatgcagttcctgaacgaccgcctggccaactacctggagaaggtgcgtcagctggagcgggagaacgcggagctggagagccgcatccaggagtggtacgagtttcagatcccatacatctgcccagactaccagtcctacttcaagaccatcgaagatttccagcagaagatcctgctgactaagtctgagaatgccaggctggtcctgcagattgataatgccaagctggctgctgacgacttccggaccaagtatgagacagagctgtctctgcggcagctagtggaggccgacatcaacggcctgcgtaggatcctggatgagctgaccctgtgcaaggctgacctggaggctcaggtggagtccctgaaggaggagctgatgtgcctcaagaagaatcacgaggaggaagtcagtgtactccgttgccaacttggggaccgactgaatgtggaggtggacgctgctcccccagtggatctcaacaagatcctggaggatatgagatgccagtacgaggccctggtggagaataaccgcagagatgtggaggcctggttcaacacccagactgaggagctgaaccagcaggtggtgtccagctcggagcagctgcagtgctgccagacggagatcatcgagctgagacgtacggtcaacgcgctagagattgagctgcaggctcagcacagcatgcggaattccttggaatccaccctggccgaaaccgaggcccgctacagctcccagctggcccagatgcagtgcctgatcagcaacgtggaggcccagctgtctgagatccgctgcgacctggagcggcagaaccaggagtaccaggtgttactggacgtcaaggcccggctggagggcgagatcgctacctaccgccacctgctggagggagaggactgcaagcttcctccccaaccttgtgccacggcatgcaagcctgttattagagttccttctgtccccccggtgccctgtgtcccctctgtgccctgcaccccggctccccaggttggcactcagatccgcaccatcaccgaggagatcagagatgggaaagtcatctcctccagggagcacgtgcagtcccgcccgctgtga

SEQ ID NO: 28415 - DNA, 683 bp, Homo sapiens
agcagcttgaacttagttctcgctgagtcccggctcagggcccttcccttgggtcggggggttggctgtgcagtcaacaataaggaaaaaggcaagacactgagggcagctgaaagacttttacctttgacgagctggtcacctgctccagggaaggtacattcctctccccacaaccctagaggcacctctctggtccacagtgtccctcctgatgctcaggtcgggcctctctggccttgggagctgcttgcctggctcctacctgtcttctgagtgccacacctctggctttgtggggagcgggggctggttctgcgagggctccttcaacggcagcgagaaggagactatgcagttcctgaacgaccgcctggccaactacctggagaaggtgcgtcagctggagcgggagaacgcggagctggagagccgcatccaggagtggtacgagtttcagatcccatacatctgcccagactaccagtcctacttcaagaccatcgaagatttccagcagaaggtgagggagacctggcccctttccagctgagcagcccaactcttaggaggcgtctgtctcattccagggcctttccagatgggacggtagcttttagggaattctcctggtagggcaaacttttctctctagggctttggtttcctgggggacccaggct

SEQ ID NO: 28416 - DNA, 531 bp, Homo sapiens
ccttttcccccttctaccttgaaatgtagctgtaattcatttctgccgttcatacagctagagctttccatcctgtgacaaacacaagccaaagtgcttaaggacatctgtttattttatttctttaacgagaaaaccttccaatttctcctgagctcagctgtgtttatttacattttcttggtcatgtgaggcgagcaccttggaagtttaaaggcctggccagacccttgcaggagcctgtagctctgaaacggagaggaagccctgcccaaggaaaacagagtccttggaactctataaaatagattctcaaaataaatactgcctcattcacttggtagatgtggattaagtcaagatgaatacaatttgaaaaggattttctgaggaagtcggagatttctttccccccctgggggttaaaccttgtatttaaatctctcttcccccttccctctctcttttcagctgagtaaaaggtgtttagtctttgtggctaataaagaaaggatgactttgattgggctt

SEQ ID NO: 28417 - DNA, 431 bp, Homo sapiens
ggccaatcttttcttttatatataatacttttaaaatacatttttatttctttcgtcgcccaggctggagagcaatggcgtaatctcggctcacggcaacggcaacctccgcttcctgggctcaagtgattctcctgcctcagcctcacaagtagctggaattacaggcacacgccaccatgcccagctaatttttgtatttttagtagagatggggtttcactatgttgttcaggcgggtcttgaactcctgacctcaggtgatccacctgtctcggcctcccagagtgttgggattacaggcgtgagccaccgcatccagcctcttttataggtaatacttttattgtcaagtctaagaactctttgtgtagcccaatcccaaagattttctactaatttttaaagttttatagttttctgttgtatac

SEQ ID NO: 28418 - DNA, 343 bp, Homo sapiens
ctgggactacaggcgtgcaccaccacgctcagctaatttttgtattttttgtagagatggggtttcactgctttggacaggatggtctccatctcttgacctcgtgatccgcccgcctcagctgcctaaagtgctgggattacaggcgtgagccactgtgcccggcccctagtagcgtttttaatgtgtggtcttgagcaagttggttgatacctctgcacacagtttccctacctgtatgatggagatgataatagccccttctctgcagagctgctgggaggagagtgaaataatgaacactacccacacggtgctgcctcagtcctattttgggtccagc

SEQ ID NO: 28419 - DNA, 381 bp, Homo sapiens
atgccggagccagcgaagtccgctcccgcgcccaagaagggctcgaagaaagccgtgactaaggcgcagaagaaggacggcaggaagcgcaagcgcagccgcaaggagagctactccgtatacgtgtacaaggtgctgaagcaggtccaccccgacaccggcatctcctctaaggccatgggaatcatgaactccttcgtcaacgacatcttcgaacgcatcgcaggtgaggcttcccgcctgccgcattacaacaagcgctcgaccatcacctccagggagatccagacggccgtgcgcctgctgctgcccggggagttggccaagcacgccgtgtccgagggcaccaaggccgtcaccaagtacaccagcgctaagtaa

SEQ ID NO: 28420 - DNA, 720 bp, Homo sapiens
gcgatcaaaacttacggcttttagagtgtttctctgaattatgtggcttttaaaaattgtatatatttaatgtgtacaacttgatttaatatatacatatacacaaaaaaatgtgtacattgtgaaataatcacggcaatcaagtgaattaacatatccatcacctcacttttgtgcgtgtgtgtgggtgggggttgtgtgtgcaccttgggtgatgaaaatatgcagtagatctgttagcagatttcaagtctgtaacacagtaggatgacctgtagtcactgtgctgtacatgagagctccggaacttactcatcgtgcgtcgtaccctttgatcagcgtctccccatttccctcctccccagtccctggtaaccaccctttgactctctgcttctatgaatttgactgtcttagattctccctgtaattgagatcatgcagtatgcgtggcttttcttgtcctgggcaccgaaaagggtgcctgctgtgggaaacccagggcagatgcccctggcttttatagccccttcaccacagtgcttttataagccctgcaaaaagggtagaaatcattgcacgtttacagaacttggatttgtaaggggtgaggaggatagaagacctttgcttttatttttgttttctaatcacagaagaaaaaatgtcctcattgttaaataacgaaaagccaaatgttagaaaaatgtaaagtcaagt

SEQ ID NO: 28421 - DNA, 231 bp, Homo sapiens
cccattaatatggtaatattacttaaccagtctcccctgataggcagttaagatgtttccaatcttttatcattataatcaatacttgtgaaggccatgtgcatattatgcatatatatacaagtatatgtcctagaaatggaattgctgacccaaagggcatgtaggtttacattctgaagatattgacaaatgccctccaaagaggctgtcaatttatactcccagcag

SEQ ID NO: 28422 - DNA, 439 bp, Homo sapiens
aaaagactgcccctcaccagactgggagggagcccaaatgggcagacatgtggtttttccactgatgtctctgcactgttcttgtcccgaaaacctggcaggatgaggaacaggccccagcttacagcatctcagccccttctttcttctctgctttcttaatgcctgttagtccagtgttaaatattttagcagcctgatgactcagatgtagactgtgaaagtgtttctttttccagggaaggcactggaacaggtctagttactgatgctcttaatgccctttccttttgcaagcctggccgagggtgtttaggaataaaaacttgcctggttgctgggcacggtggctcatgcctataatctcagcactttgagaggctgaggtgggaggattgcttgagcccaggagttagagaccagcttgggcaacatagtg

SEQ ID NO: 28423 - DNA, 583 bp, Homo sapiens
tgttctctggagtagcacctataacatccttcaagaactttttctttgcattcacaacttgagtagctgatgcaagaagcttagctttggcctgtcttagcttccaacatgctttcttcactaagctcgatgatttctaccttttgatttgaagtgacaggtgtgcacacttcttttcaattgaacacatggtggccactgcagagtgaagtggcctaatttcattgttgtatcttggggaatggggagctagaagagagaaacagagacagggaaatgactagtcaatgaagcagtcaaacacaacatttttccatcacgtttgctatcttccatagagttccagcacgctgagacaattccattagtaacatcagaaatcactgatcacagatcataacagatgtgataactaaaatctttgaaagattgggattgccaaaagatgtgacagagatgtgaagtgagcccatggtgttggaaaaatggtgctggtcaggcttgctgagcacttcgtggccacaaatctttaatttgttaaaaaggtgatgttgccaagcaaaataaagtgaagctcaaagtg

SEQ ID NO: 28424 - DNA, 234 bp, Homo sapiens
ctaggtccagaatgtgcttgtcaggaagggtgtgcagcccagggttctctccgtgttcactgcctctttcctttgtcatcttcattctgccgttgagcctatctagtgggtttttacaatttcagttactgtatgtttagttcgaagttttccatttggttctcctttataccttctgtttctttcctgagacttctcatcattccctttatgttaagaatacccctccttact

SEQ ID NO: 28425 - DNA, 434 bp, Homo sapiens
tgggtttttagttgtgaagagcactaggtagaagtctcaaccttaaccctaaacctaaattaattttgccccagttcagttctagctgcacaccccaagcccagtccagtccctttgcccagcttctcctcatgcatgaaatttaggggcaacaatgcaggggcaggtgttcctccacatgcctctctatccaagctcctctctccatccaactgctggagaaataacacacataacacgtcaagaatacatagtatctggcaagctaaagtacagtgagtgaggaagaatttctcaggaaaacaagctgcagagccataaatctgctaaaagattcacccaatttacatcgctaaacagaacacttctcactccaaagcctctgcgctcacattgattcacggcatttcagtcttccacaagaacaattggtg

SEQ ID NO: 28426 - DNA, 479 bp, Homo sapiens
agctgttgttttctttccctttaccatgattgtctacagtaataacttttgtctaaaaaaccaaaaaccaaaaatcagttttgcatccttttactcagatacttaatggtttgatactttaacatttcatgttaatatttccatcaagggaaaacaagaactagcaagaatgaacttactctgctggcctatcagattgtcagcatatttgtacagtattatgattcttactcaactgtgacatttgatgcatacatatatgcacacatacacatgtaaagatgaaattcttgactcttctttggtcctgtaagcacctactctagaatgtaaggaagtgttagagcaggagttgacagatttttcatgtgaagggtcagataatacttcaggtattactggccaagaggcaaaatggagaatgtattacatcaagagacaaaacaaattcccacaaattttttaattgaaaaaataaa

SEQ ID NO: 28427 - DNA, 1541 bp, Homo sapiens
  misc_feature (1)..(1): n is a, c, g, or t
naatagtggagcactaggcataaatgccttaaagaaaggactgatctcccctgaagaagagagaattctgcctctagattgcttacaatttgaactggaacatcagctgttctctaggtcttaagtctgctgctctaacctacaaattttggacatgccaatctccacagtcacatgggccaattccttagtttctctggagaatcctgactaatgtatgcaatgtctttatttcatcctcattcttaaaggatattttcatcagcaacaccacaccctcctgatcaccatagctttatggtaagacacccctactctgtccagacccaactgtcaacagaagccaaagccatctggaggagcatgcaacaacaagaaacaaatttattagctaacctaaccactaatgacgcaagagacaattctaaggactttcaaaacagcaaagtaggagcagctgctacctctagggatgagggatgcaattgtccaattattggtgaaattgtcatttcatgctattggctatttgaaattcctcctctaatttcagaataaatcactgaaattgacatcggccagtctgaatttcaagaaattacctgctgaagacaagagggatctcttcttcagatttgcagtctggggaagacacagcctctactgtactttagaacctgagatatggtggtggagggagccctgggtcgagtggtcagagctccggactccagccccatgcaacttcaaaatatgacaaatgtcttgaaggggagattggcatgcagatgaggaaggccctctcgccaacacatttgtatttcctctgtactgtgagactgtgggagatttactgcgacatttagaagctttcttccaaactcctgggcctccgacactggttctaaactcagcaaatgttctttgggaaaaacagacagtgcatgtgaggcccctcgagtttggaatttatgtctccagcttcacatggtctctcaagtgcttatgcttttcttctctctgccacccacattcccacatcccgcccaccccccaactttcctcccttcaccttcccatggagactttttgcctgggctaaatctgatcctcagcccactctcagaatcgataaatgcccctaggtgattgtaagctcacctaagatatactttttctcctctagaattttagtttattagatttttctagttgtctttgcaaaagcgttaacaggctctgacttctgacattcaactagatgtggaatatccaacccctagcatttcatggaatgtactgaccaagataaaatgtgttcttattaaacaatgccatttcttgaccacttctgtttttaggaattgtggtatctgagtcatggtgattagaagtactaatgaaataaatgggaaaattaaacttctactaacatttcatatagtagggagatgtctgtgaagaattataactggtacagattttgtgtttataaacaaggagacagaaaatgcagaaaataaaaaatattttatttagtc

SEQ ID NO: 28428 - DNA, 1207 bp, Homo sapiens
  misc_feature (1)..(1): n is a, c, g, or t
  misc_feature (1177)..(1177): n is a, c, g, or t
  misc_feature (1206)..(1206): n is a, c, g, or t
naatagtggagcactaggcataaatgccttaaagaaaggactgatctcccctgaagaagagagaattctgcctctagattgcttacaatttgaactggaacatcagctgttctctaggtcttaagtctgctgctctaacctacaaattttggacatgccaatctccacagtcacatgggccaattccttagtttctctggagaatcctgactaatgtatgcaatgtctttatttcatcctcattcttaaaggatattttcatcagcaacaccacaccctcctgatcaccatagctttatggatgcaattgtccaattattggtgaaattgtcatttcatgctattggctatttgaaattcctcctctaatttcagaataaatcactgaaattgacatcggccagtctgaatttcaagaaattacctgctgaagacaagagggatctcttcttcagatttgcagtctggggaagacacagcctctactgtactttagaacctgagatatggtggtggagggagccctgggtcgagtggtaagattcacccttaggttagtattgacgtaaggtgacgaggagctgtagacaaaagattgtaaccataagaacttcatagtttttgtattttcaccgagcttatatttggtgtgttttttgtcttttctttatgattatcaataaaatgcttgaaaggagatgaggttggggaataatttttgggaataccacaaaagacacttttgtgatggaaatccttaaaaagacacaatccattacctcattgggttcaaaaggcaattgtgaactactgtggagtttggaaagaagcaatgaggtaatcaaggatactgttgacaatctagcttatcctatggatggaaggaaattgaaactaatggaggcgaggctggtaaaacaatagggtttgagacaattctgtggcattagaaatgaaagaggaaggtgaatccgggagacggagcttgcagtgagctgagatcgcgccactgcactccagcctgggcgacagagcgagactccatctcaaaaaaaaaagaaagaaagaaaagaaagaggaagtaataatctgtgaaatttttccttaggaacttattggcaatttaaaaatgaatttgttaagccatgctggttctgacccaaaagccattccccanccttcctcactcccctctttcactactgnc

SEQ ID NO: 28429 - DNA, 1319 bp, Homo sapiens
  misc_feature (1)..(1): n is a, c, g, or t
  misc_feature (1289)..(1289): n is a, c, g, or t
  misc_feature (1318)..(1318): n is a, c, g, or t
naatagtggagcactaggcataaatgccttaaagaaaggactgatctcccctgaagaagagagaattctgcctctagattgcttacaatttgaactggaacatcagctgttctctaggtcttaagtctgctgctctaacctacaaattttggacatgccaatctccacagtcacatgggccaattccttagtttctctggagaatcctgactaatgtatgcaatgtctttatttcatcctcattcttaaaggatattttcatcagcaacaccacaccctcctgatcaccatagctttatgcaacaacaagaaacaaatttattagctaacctaaccactaatgacgcaagagacaattctaaggactttcaaaacagcaaagtaggagcagctgctacctctagggatgagggatgcaattgtccaattattggtgaaattgtcatttcatgctattggctatttgaaattcctcctctaatttcagaataaatcactgaaattgacatcggccagtctgaatttcaagaaattacctgctgaagacaagagggatctcttcttcagatttgcagtctggggaagacacagcctctactgtactttagaacctgagatatggtggtggagggagccctgggtcgagtggtaagattcacccttaggttagtattgacgtaaggtgacgaggagctgtagacaaaagattgtaaccataagaacttcatagtttttgtattttcaccgagcttatatttggtgtgttttttgtcttttctttatgattatcaataaaatgcttgaaaggagatgaggttggggaataatttttgggaataccacaaaagacacttttgtgatggaaatccttaaaaagacacaatccattacctcattgggttcaaaaggcaattgtgaactactgtggagtttggaaagaagcaatgaggtaatcaaggatactgttgacaatctagcttatcctatggatggaaggaaattgaaactaatggaggcgaggctggtaaaacaatagggtttgagacaattctgtggcattagaaatgaaagaggaaggtgaatccgggagacggagcttgcagtgagctgagatcgcgccactgcactccagcctgggcgacagagcgagactccatctcaaaaaaaaaagaaagaaagaaaagaaagaggaagtaataatctgtgaaatttttccttaggaacttattggcaatttaaaaatgaatttgttaagccatgctggttctgacccaaaagccattccccanccttcctcactcccctctttcactactgnc

SEQ ID NO: 28430 - DNA, 656 bp, Homo sapiens
  misc_feature (8)..(8): n is a, c, g, or t
atccccgngctgcaggaattcggcacgagctctactgaaggctactcttcttatcaagtaacgtcttctccatgctcttgacccttgccccttcagacctatggatggtaataacctgcccacacctagtttaccatcagaggacacagcagcaaggtgccatcctagaagcagagagcagacccttaccagacaaccaaccagctggtgccatgatcttggacttctcggcctccagaactgtgagaaataaatttctatattctataaattacccattctgtagtgtcttgtaatagtagcacaaatagactaagactgtaagaaaatggatttgggtcaaacaagcatttgagtggcgcattaaagaattctcaaataaacccgatattttttgcccataaatagtagtactttacatcttaagatgcattttaaaaaacgaaaatttagatgaatggctaacatttgaaatgattatttcttaagatgcgatctgtgttctctaactccaattcttgggtatgagagagagaggagccatccattgttctttccacattttgatttccaactgaggtcaaaacacattgatcaaagccgggaaccaagagccaaaggtgaaagaatccacaaactcagatacatgaggacat

SEQ ID NO: 28431 - DNA, 1364 bp, Homo sapiens
  misc_feature (1334)..(1334): n is a, c, g, or t
  misc_feature (1363)..(1363): n is a, c, g, or t
gctgggactacaggcgcccgccatgatgcccggctaattttttgtatttttagcagagacggggtttcaccctgttagccaggatggtctcatctcctgacctcgtgatccgcccgcctaggcctcccaaagtgctgggattacaggcgtgagccaccgcgcccggcctaataaaggacaatttttaatagccactggactatttaagtgatctcttcttctgtcagtttcttttaccatcagaggacacagcagcaaggtgccatcctagaagcagagagcagacccttaccagacaaccaaccagctggtgccatgatcttggacttctcggcctccagaactcaacaacaagaaacaaatttattagctaacctaaccactaatgacgcaagagacaattctaaggactttcaaaacagcaaagtaggagcagctgctacctctagggatgagggatgcaattgtccaattattggtgaaattgtcatttcatgctattggctatttgaaattcctcctctaatttcagaataaatcactgaaattgacatcggccagtctgaatttcaagaaattacctgctgaagacaagagggatctcttcttcagatttgcagtctggggaagacacagcctctactgtactttagaacctgagatatggtggtggagggagccctgggtcgagtggtaagattcacccttaggttagtattgacgtaaggtgacgaggagctgtagacaaaagattgtaaccataagaacttcatagtttttgtattttcaccgagcttatatttggtgtgttttttgtcttttctttatgattatcaataaaatgcttgaaaggagatgaggttggggaataatttttgggaataccacaaaagacacttttgtgatggaaatccttaaaaagacacaatccattacctcattgggttcaaaaggcaattgtgaactactgtggagtttggaaagaagcaatgaggtaatcaaggatactgttgacaatctagcttatcctatggatggaaggaaattgaaactaatggaggcgaggctggtaaaacaatagggtttgagacaattctgtggcattagaaatgaaagaggaaggtgaatccgggagacggagcttgcagtgagctgagatcgcgccactgcactccagcctgggcgacagagcgagactccatctcaaaaaaaaaagaaagaaagaaaagaaagaggaagtaataatctgtgaaatttttccttaggaacttattggcaatttaaaaatgaatttgttaagccatgctggttctgacccaaaagccattccccanccttcctcactcccctctttcactactgnc

SEQ ID NO: 28432 - DNA, 666 bp, Homo sapiens
gctgggactacaggcgcccgccatgatgcccggctaattttttgtatttttagcagagacggggtttcaccctgttagccaggatggtctcatctcctgacctcgtgatccgcccgcctaggcctcccaaagtgctgggattacaggcgtgagccaccgcgcccggcctaataaaggacaatttttaatagccactggactatttaagtgatctcttcttctgtcagtttcttttaccatcagaggacacagcagcaaggtgccatcctagaagcagagagcagacccttaccagacaaccaaccagctggtgccatgatcttggacttctcggcctccagaactttgtgttgtaggtgaaaatcaccgagtcttagaaatacagctgagaatgagtaaggagagagagttgctctgcctaagcacattctccctcactgaaggcactttgaagtgacctcaggaagatcacagaagttcccctagcttcacccccactatagaaatgcaaccagaaactattcaaagacaaaaataccatcctgaattcaccagaacctggagaagtggagacacccactgggcacacaattgagcgaagttgccagcagtaagagaagccgccatttgagactgcaccacacctccctcaagccgtcagaacta

SEQ ID NO: 28433 - DNA, 1548 bp, Homo sapiens
  misc_feature (1)..(1): n is a, c, g, or t
  misc_feature (1518)..(1518): n is a, c, g, or t
  misc_feature (1547)..(1547): n is a, c, g, or t
naatagtggagcactaggcataaatgccttaaagaaaggactgatctcccctgaagaagagagaattctgcctctagattgcttacaatttgaactggaacatcagctgttctctaggtcttaagtctgctgctctaacctacaaattttggacatgccaatctccacagtcacatgggccaattccttagtttctctggagaatcctgactaatgtatgcaatgtctttatttcatcctcattcttaaaggatattttcatcagcaacaccacaccctcctgatcaccatagctttatgatctgagctttcatctggtatcatttcctttccgtctgaagaacttgctttccttgcaacaacaagaaacaaatttattagctaacctaaccactaatgacgcaagagacaattctaaggactttcaaaacagcaaagtaggagcagctgctacctctagggatgagggagaaactcaaaaatgcatacaaaaaccattgcatgaaaagtgactggatttgtacatagcgtcaggagatgtgcgtagtgtcaaagtatctcatcacacattacttgataattacaaatgagaaaaatgaaccttcacagtggcaagacttgacttctacctctttcaaaaagatgcaattgtccaattattggtgaaattgtcatttcatgctattggctatttgaaattcctcctctaatttcagaataaatcactgaaattgacatcggccagtctgaatttcaagaaattacctgctgaagacaagagggatctcttcttcagatttgcagtctggggaagacacagcctctactgtactttagaacctgagatatggtggtggagggagccctgggtcgagtggtaagattcacccttaggttagtattgacgtaaggtgacgaggagctgtagacaaaagattgtaaccataagaacttcatagtttttgtattttcaccgagcttatatttggtgtgttttttgtcttttctttatgattatcaataaaatgcttgaaaggagatgaggttggggaataatttttgggaataccacaaaagacacttttgtgatggaaatccttaaaaagacacaatccattacctcattgggttcaaaaggcaattgtgaactactgtggagtttggaaagaagcaatgaggtaatcaaggatactgttgacaatctagcttatcctatggatggaaggaaattgaaactaatggaggcgaggctggtaaaacaatagggtttgagacaattctgtggcattagaaatgaaagaggaaggtgaatccgggagacggagcttgcagtgagctgagatcgcgccactgcactccagcctgggcgacagagcgagactccatctcaaaaaaaaaagaaagaaagaaaagaaagaggaagtaataatctgtgaaatttttccttaggaacttattggcaatttaaaaatgaatttgttaagccatgctggttctgacccaaaagccattccccanccttcctcactcccctctttcactactgnc

SEQ ID NO: 28434 - DNA, 711 bp, Homo sapiens
  misc_feature (8)..(8): n is a, c, g, or t
atccccgngctgcaggaattcggcacgagctctactgaaggctactcttcttatcaagtaacgtcttctccatgctcttgacccttgccccttcagacctatggatggtaataacctgcccacacctagtttaccatcagaggacacagcagcaaggtgccatcctagaagcagagagcagacccttaccagacaaccaaccagctggtgccatgatcttggacttctcggcctccagaactgtgagaaataaatttctatattctataaattacccattctgtagtgtcttgtaatagtagcacaaatagactaagactgtaagaaaatggatttgggtcaaacaagcatttgagtggcgcattaaagaattctcaaataaacccgatattttttgcccataaatagtagtactttacatcttaagatgcattttaaaaaacgaaaatttagataaaacaacaaatagcgtcagttttctacatggctaatatctgggcagaaatctaggaatggctaacatttgaaatgattatttcttaagatgcgatctgtgttctctaactccaattcttgggtatgagagagagaggagccatccattgttctttccacattttgatttccaactgaggtcaaaacacattgatcaaagccgggaaccaagagccaaaggtgaaagaatccacaaactcagatacatgaggacat

SEQ ID NO: 28435 - DNA, 298 bp, Homo sapiens
agtggagcactaggcataaatgccttaaagaaaggactgatctcccctgaagaagagagaattctgcctctagattgcttacaatttgaactggaacatcagctgttctctaggtcttaagtctgctgctctaacctacaaattttggacatgccaatctccacagtcacatgggccaattccttagtttctctggagaatcctgactaatgtatgcaatgtctttatttcatcctcattcttaaaggatattttcatcaggtatgctattttaggttgatggttattttcctagtgc

SEQ ID NO: 28436 - DNA, 1492 bp, Homo sapiens
  misc_feature (1)..(1): n is a, c, g, or t
  misc_feature (1462)..(1462): n is a, c, g, or t
  misc_feature (1491)..(1491): n is a, c, g, or t
naatagtggagcactaggcataaatgccttaaagaaaggactgatctcccctgaagaagagagaattctgcctctagattgcttacaatttgaactggaacatcagctgttctctaggtcttaagtctgctgctctaacctacaaattttggacatgccaatctccacagtcacatgggccaattccttagtttctctggagaatcctgactaatgtatgcaatgtctttatttcatcctcattcttaaaggatattttcatcagcaacaccacaccctcctgatcaccatagctttatgcaacaacaagaaacaaatttattagctaacctaaccactaatgacgcaagagacaattctaaggactttcaaaacagcaaagtaggagcagctgctacctctagggatgagggagaaactcaaaaatgcatacaaaaaccattgcatgaaaagtgactggatttgtacatagcgtcaggagatgtgcgtagtgtcaaagtatctcatcacacattacttgataattacaaatgagaaaaatgaaccttcacagtggcaagacttgacttctacctctttcaaaaagatgcaattgtccaattattggtgaaattgtcatttcatgctattggctatttgaaattcctcctctaatttcagaataaatcactgaaattgacatcggccagtctgaatttcaagaaattacctgctgaagacaagagggatctcttcttcagatttgcagtctggggaagacacagcctctactgtactttagaacctgagatatggtggtggagggagccctgggtcgagtggtaagattcacccttaggttagtattgacgtaaggtgacgaggagctgtagacaaaagattgtaaccataagaacttcatagtttttgtattttcaccgagcttatatttggtgtgttttttgtcttttctttatgattatcaataaaatgcttgaaaggagatgaggttggggaataatttttgggaataccacaaaagacacttttgtgatggaaatccttaaaaagacacaatccattacctcattgggttcaaaaggcaattgtgaactactgtggagtttggaaagaagcaatgaggtaatcaaggatactgttgacaatctagcttatcctatggatggaaggaaattgaaactaatggaggcgaggctggtaaaacaatagggtttgagacaattctgtggcattagaaatgaaagaggaaggtgaatccgggagacggagcttgcagtgagctgagatcgcgccactgcactccagcctgggcgacagagcgagactccatctcaaaaaaaaaagaaagaaagaaaagaaagaggaagtaataatctgtgaaatttttccttaggaacttattggcaatttaaaaatgaatttgttaagccatgctggttctgacccaaaagccattccccanccttcctcactcccctctttcactactgnc

SEQ ID NO: 28437 - DNA, 407 bp, Homo sapiens
ttttctttttttgttttttctttaacaagacaaagtctccctcttggcccccaggctggagtgcaatggcgcgatctcggctcactgcaacctctgcctcccgggttcaagcgattctcctgcctcagcctctcgagtagctgggattacaggtgtgtaccaccaagtctggctaatttttgtattttaagtagtgacgaggtttcaccacatcggccaagctggtctcgagctcctgacctcaggtgattcgcccacctcggtctcccaaagtgctgggattactggcatgagccactgagcctggccgaaaattttcatagtaaaatgctgggggagaaaataattccgagttataatcaaaataaaggaggcagcaggccccactgtgaaaaacctcagccctg

SEQ ID NO: 28438 - DNA, 299 bp, Homo sapiens
ttacagtcaggaaaaaaaggtttagttcaccttgagaggttagagaaagaaaggttatcattgaatgaaatgcatggcttgatgccatttgtaaaacaggttggtgctggctcaagaaggcaggaacaaattctaacttggttgaaaagtatgattggcggaggggtaaaggaaaatctccagaattagtcattcaggggctctgcaatgtagatctgaagcagtgcggagaaaaggctaccaatccaccttcatcttagcaagcaagcactgttcctcttcttgattccagggagcta

SEQ ID NO: 28439 - DNA, 728 bp, Homo sapiens
ggaaaagttagagggaaatatggaaaagacgtaaatgaggattaggggattaaaatcattctcctttgttttaatttacagattctttgattccaaaattaagcgtcaaaataaatattttgtatggcatctagaattttcaaattcttaaaaaatgcatgttttttgttgctgttttgttgatttagggaagcaggatagtcattatcagatttacgatggttatagtaataatcacatattaaaaaaccctcattttcctttttataaatttaagaaactcctatcatactgtgatttaggagaagccattgaatttcagttgtttcagagtaaggaataatacccaaaaagcaaaatagattataaagctgacttttctagagcttcatttcaactttgaatataaaacattatcttttcaaatatgagaaactaaaaaagaagaaatgaaagaatcatttaagttacacaaatgtgtagttctgttcctacatagcgttgattagatcataaatgcttaaatttctaatggctacagagtgaattatggaaatgagaatcactagtacaatgttatattttgaaactgtgttcacatatttgaatactatttacatgaaatttgttatataacttgaacaaagtacagaatatgttaataataataaaaatttgttgaaacactttctgtgtttcatatgcattaaagtatatggctataagat

SEQ ID NO: 28440 - DNA, 411 bp, Homo sapiens
taccaatatcccagggatggaattatggtagggtcattctaattccattttatacaagggaaactaaggacccagaaagtttaaatcggtcatttatttgtttgtttatgcatatatccagcaaatatttgttgggtacatactatatataggtcactgtcgtgagcattataatgtctaagcaatcaaatttggagtaaagaacttgaattaagttcattcaattcctagactaacattatttctatatgtagttctgatcagtattctagaattatggtttaaatatccagttataaataatatatattacagatttattattatgtacctgaaactctactgagtacttttcatgccttatctcatttaatcctatcataatccaatgaagtaagccctaccactatc

SEQ ID NO: 28441 - DNA, 557 bp, Homo sapiens
ttttagtttgtcatgcttaaacagacccctcagtattctcacagagaactgaagcaattcattttcaagactaacaagagcacagcatctgcatgcatgtggcaggtatgttagtgaatgttgtgaagtaggtggtcccatcagttgtcatggttcacctctgtccagactgtgattgtgtgactcgcagttggcacttcagcaaagcttaggaaaatgcctcatcttcttttgtgggaggtggaaaaataagtagctgctttcaatgaacactgcaagccttgttaaagtctgtacctttcatacagaaactcctagatgaatggcaatggaaaatacgggtttgtgataactttgaatgatgtgtgattgccttgattagcactatagttactaagcagatatgcacttctttgttttaaaagagaacttgaattttttttttactataactgccagttgcttaatttctaccactttgtctatttttttaaaaaatgaatttccacctaatttgtgcttgtcagtgatgacaagttttaaaagtaactcaagtt

SEQ ID NO: 28442 - DNA, 265 bp, Homo sapiens
tgttttttacaactgagtttactctgtctgtgaaggccgcagcgtaaagccagttgtgaatcatgcacatcagctccttctgaaatgtgtttatggcctaggacacagggaccctggagactatggtgctgcagtgcattatggctgctacccttctagtctgtcctgctgctcgttctgccacctgccagctgttgctacctgaaccttctccttgcagcagttctcagtgttctctttgcttgggaattgcctggggagctaa

SEQ ID NO: 28443 - DNA, 2404 bp, Homo sapiens
gctcacccattctacacttgctcttttgctcccaaccaggaagccatcatgtcttgccgctcctaccgagtcagctctggtcaccgggtgggcaacttcagctcttgttcagcaatgacaccacagaacctgaatcgcttccgggccaactctgtctcctgttggagtgggcctggattccggggccttggcagctttggtagtcggagtgtcatcacctttggatcgtactcaccccggatagcagctgtaggctctcggcccatccactgtggagtccgctttggtgctggctgtgggatgggttttggtgatgggagaggtgttggtctggggcctagggctgacagctgtgttggtctgggctttggagctggcagtggcattggctatggctttggtggccctggctttggttacagagttggaggggttggagtcccagcagccccatctatcacagctgtgactgtgaacaagagcctactgacccccctcaacctggagattgaccccaatgcccagagggtgaagaaggatgagaaggagcaaatcaagaccctcaacaacaagtttgcctccttcattgacaaggttcggttcctagagcagcagaataagctcctagagaccaagtggagcttcctccaagagcagaaatgtatcaggagcaatctggagccactcttcgagagctacatcaccaacctgcggaggcagttggaggtgctggtcagtgatcaggcccggctccaggctgagaggaaccacctgcaggatgtcctagagggcttcaagaagaagtatgaagaggaagtggtatgtcgggccaatgctgagaatgagtttgtggctctgaagaaggatgtggatgcagctttcatgaacaagtctgatctcgaggccaacgtggataccctaactcaggaaattgactttctaaaaacgctttacatggaggaaatccagttgctgcagtcgcacatctcagagacgtcggtcattgtgaagatggacaacagccgtgacctgaaccttgatgggatcattgctgaggtcaaggcccagtatgaggaggtggccaggcgcagccgggctgatgctgaggcctggtaccagaccaagtatgaagagatgcaggtgacagctggccaacactgtgacaacctgcgcaacatacggaacgagatcaacgaactgacccgcctgatccagaggcttaaggcagagattgagcacgccaaggctcagcgtgccaagttggaggctgcagtggccgaggccgagcagcagggcgaggcgaccctcagtgatgccaaatgcaagctggcagatctggagtgtgccctgcagcaggccaagcaggacatggcgcggcagctgtgcgagtaccaggagctgatgaatgccaagctgggcctggacatcgagatcgccacctacaggcgcctgctggagggcgaggagagccggctctgtgaaggtgttggaccagtaaacatatccgtcagcagctcccggggcggcctggtgtgcgggcctgagcctttggttgccggctccaccctctcccgcggcggggtcaccttctcaggtagcagcagcgtctgtgccaccagtggggtcctggcttcctgtggccccagcctgggtggagcccgggtcgccccggccactggggacctgctgagcactggcacaaggagtggctccatgctcatcagcgaggcctgtgtccccagcgtcccctgccccctgcccacccaggggggcttcagcagctgcagcggcggccgcagctccagcgtccgctttgtgtccaccaccacctcctgccggaccaagtactgagagcccagccccagacagctgctgcccagagaagaaccagctccacggctcctgcttctgcccccagggttcgtgggctctgggcttgacggtctccagctcccctttctgccaggaagccaccccttagcactcccccgattattctgcctggccccatgtcctcttggaggatttttctgccatgtagatgctccattagcagttccagctaagctggcttctccctgcctcccaatttctgtcctttggatcactcctctccctaaaccccgagatggcttttctcccagtggcttctctccggctgtttctcttcctgggttgttggtgtaactccagcatgcaagtccacgaggtggggtgcaggcggacaggcgggctttgcaatgatccccgtactcctgcccctgctcgtggtgtgaggcccagccctgtccactgcagggttgtgtctgcaagctccaaggaggcctgggggttgggtggggtgggctgcctgtgtgcactactctttgtgttcctgggttttcaataaacttgccaagctcac

SEQ ID NO: 28444 - DNA, 340 bp, Homo sapiens
  misc_feature (338)..(340): n is a, c, g, or t
tttctcgcccacgacttcccagggctgagatcaagttctcctcctacagaaaggtgcccatcctggtggcccaggaaggagaaagctcgggacggcagatatgaaatgcctggcacagtgcttggggtctagtatgtagcttccagaacccaccctgcccctctacctgggaggccaaatggcaacaactaaatgactcctctgtcatcatcagcgccctcaagacctacctggtgtcggggcagcacgctggaagagatcattacttactacgcatgcatgaagcctctttactagtcttgcgaagaaagggttcatcaagaatcagcgggacatannn

SEQ ID NO: 28445 - DNA, 2843 bp, Homo sapiens
aggctggtactggtctggggagtttgggatgtccgcggagacgcctatgcggtggaggctccgggcttcagctagggcgggggagcccagcagaaggaccgagcagcctggcaccccactttgccatcctctccctggaaatctcggggtcggcgggccggccgcttcgcgtgggcgaaatcagagacacgtggtttccaaggccccttcgggttcgggaaaattttatggttcgggtcacagtaggaagcggacaatgaggcgggagggcagagagaaccgcaacaccgccgcgcacctggtgccgggtcgggtcgtttccggggctttcagtggccggaagtcgcggcgcctgtactgactctaggaagggctggagttgttttgaatgggcgcccgtaagagaggtgggcaagtacgtgttacagacggccacgccgccctttaggcggtcaaggtggggcgagcagacgttcgcccccctgcagtcggccgggtcactacccaagagcctttggaggcggaagcatggaacggtctgcaaacgttcccgagcgggcctctgcggctctggcgggcgtttcgaacttgggcgccgggcacacgcccagtcccgagagcgctgagggttcccttagcgtcgccctcaccccggccaacccgcggggcgccagagtcctggccctttaaacgccgcgcgtgcctcggcgtcttcgtttcgcgcgcccgcccgcggcgccggcggagcgaacatggacccggctgcgcgggtggtgcgggcgctgtggcctggtgggtgcgccttggcctggaggctgggaggccgcccccagccgctgctacccacgcagagccgggctggcttcgcgggggcggcgggcggcccgagccccgtggctgcagctcgtaaggggagcccgcggctgctgggagctgcggcgctggccctggggggagccctggggctgtaccacacggcgcggtggcacctgcgcgcccaggacctccacgcagagcgctcagccgcgcagctctccctgtccagccgcctgcagctgaccctgtaccagtacaagacgtgtcccttctgcagcaaggtccgagccttcctcgacttccatgccctgccctaccaggtggtggaggtgaaccctgtgcgcagggctgagatcaagttctcctcctacagaaaggtgcccatcctggtggcccaggaaggagaaagctcgcaacaactaaatgactcctctgtcatcatcagcgccctcaagacctacctggtgtcggggcagcccctggaagagatcatcacctactacccagccatgaaggctgtgaacgagcagggcaaggaggtgaccgagttcggcaataagtactggctcatgctcaacgagaaggaggcccagcaagtgtatggtgggaaggaggccaggacggaggagatgaagtggcggcagtgggcggacgactggctggtgcacctgatctcccccaatgtgtaccgcacgcccaccgaggctctggcgtcctttgactacattgtccgcgagggcaagttcggagccgtggagggtgccgtggccaagtacatgggtgcagcggccatgtacctcatcagcaagcgactcaagagcaggcaccgcctccaggacaacgtgcgcgaggacctctatgaggctgctgacaagtgggtggctgctgtgggcaaggaccggcccttcatggggggccagaagccgaatctcgctgatttggcggtgtatggcgtgctgcgtgtgatggaggggctggatgcattcgatgacctgatgcagcacacgcacatccagccctggtacctgcgggtggagagggccatcaccgaggcctccccagcgcactgaatgtccccgcgcagagcagagggaaggcagcggaagacgccagctgccagggcctggggccactgggccagcgcctggcgatactggttgggggcaggatcattctgccccttgtccacgcacccccaccagccctctcgcttctaacacagggcacctgctggggctcagggatgttagggacgagttccagccctgccactgccctggggcgacccctccctgtccctgcctccctgctctgccgcccctcttcctggaccctcagtggctgtcccatggctacatcctgtgggtgggggccctcgacaggacagcaggacggtttgttttcagtggaatcccatccctgggttcccctggttcccactcttcccaagcctcccgggactgggacatgtttgcaataaaggaaaggtttgtggcgcctgtcatggcaggcatctcatggaacaaaaaaaacactgagaacacagaaagaaaaaacacggttgggccgcctgctggcccgtgaaagaggttcaaaaacccattggttgggcgcccgggcccaatcaggtagcgcacacggggcaagcgggccaaggaaacccgcgcagacagacgaggggggcatacacccaaataaaacggcgggggaccacgggcttcggaccaaacccgagggaacgggggccacaggggaacacacagagggtcacggagcgaatatccgcacaggagagaggaaaggcgcaagcacatcaacacgcggcaggaccagacagggacgaggggcgagggggagcggccggcgacacgagcgcgaagacaaacaagcagggacgaccagcggcactcacaaggaacacgcgagcggggtggcgacgagaaggcaaagcaaatcagggcgtgaggacacgcggggacggacgagaaacggcacaccgacgggacaccgcccgcagcccacaaaaa

SEQ ID NO: 28446 - DNA, 2846 bp, Homo sapiens
  misc_feature (2709)..(2709): n is a, c, g, or t
aggctggtactggtctggggagtttgggatgtccgcggagacgcctatgcggtggaggctccgggcttcagctagggcgggggagcccagcagaaggaccgagcagcctggcaccccactttgccatcctctccctggaaatctcggggtcggcgggccggccgcttcgcgtgggcgaaatcagagacacgtggtttccaaggccccttcgggttcgggaaaattttatggttcgggtcacagtaggaagcggacaatgaggcgggagggcagagagaaccgcaacaccgccgcgcacctggtgccgggtcgggtcgtttccggggctttcagtggccggaagtcgcggcgcctgtactgactctaggaagggctggagttgttttgaatgggcgcccgtaagagaggtgggcaagtacgtgttacagacggccacgccgccctttaggcggtcaaggtggggcgagcagacgttcgcccccctgcagtcggccgggtcactacccaagagcctttggaggcggaagcatggaacggtctgcaaacgttcccgagcgggcctctgcggctctggcgggcgtttcgaacttgggcgccgggcacacgcccagtcccgagagcgctgagggttcccttagcgtcgccctcaccccggccaacccgcggggcgccagagtcctggccctttaaacgccgcgcgtgcctcggcgtcttcgtttcgcgcgcccgcccgcggcgccggcggagcgaacatggacccggctgcgcgggtggtgcgggcgctgtggcctggtgggtgcgccttggcctggaggctgggaggccgcccccagccgctgctacccacgcagagccgggctggcttcgcgggggcggcgggcggcccgagccccgtggctgcagctcgtaaggggagcccgcggctgctgggagctgcggcgctggccctggggggagccctggggctgtaccacacggcgcggtggcacctgcgcgcccaggacctccacgcagagcgctcagccgcgcagctctccctgtccagccgcctgcagctgaccctgtaccagtacaagacgtgtcccttctgcagcaaggtccgagccttcctcgacttccatgccctgccctaccaggtggtggaggtgaaccctgtgcgcagggctgagatcaagttctcctcctacagaaaggtgcccatcctggtggcccaggaaggagaaagctcgcaacaactaaatgactcctctgtcatcatcagcgccctcaagacctacctggtgtcggggcagcccctggaagagatcatcacctactacccagccatgaaggctgtgaacgagcagggcaaggaggtgaccgagttcggcaataagtactggctcatgctcaacgagaaggaggcccagcaagtgtatggtgggaaggaggccaggacggaggagatgaagtggcggcagtgggcggacgactggctggtgcacctgatctcccccaatgtgtaccgcacgcccaccgaggctctggcgtcctttgactacattgtccgcgagggcaagttcggagccgtggagggtgccgtggccaagtacatgggtgcagcggccatgtacctcatcagcaagcgactcaagagcaggcaccgcctccaggacaacgtgcgcgaggacctctatgaggctgctgacaagtgggtggctgctgtgggcaaggaccggcccttcatggggggccagaagccgaatctcgctgatttggcggtgtatggcgtgctgcgtgtgatggaggggctggatgcattcgatgacctgatgcagcacacgcacatccagccctggtacctgcgggtggagagggccatcaccgaggcctccccagcgcactgaatgtccccgcgcagagcagagggaaggcagcggaagacgccagctgccagggcctggggccactgggccagcgcctggcgatactggttgggggcaggatcattctgccccttgtccacgcacccccaccagccctctcgcttctaacacagggcacctgctggggctcagggatgttagggacgagttccagccctgccactgccctggggcgacccctccctgtccctgcctccctgctctgccgcccctcttcctggaccctcagtggctgtcccatggctacatcctgtgggtgggggccctcgacaggacagcaggacggtttgttttcagtggaatcccatccctgggttcccctggttcccactcttcccaagcctcccgggactgggacatgtttgcaataaaggaaaggtttgtggcgcctgtcatggcaggcatctcatggaaaaaaaaaaaaaaaaaaaaaaaaaaaaaaaaaaaaaaaaaaaaaaaaaaaaaaaaaaaaaaaaaagaaggaggggcggcgccacctcaggaattaccatccctgcggaggggggacccagtcattgtaggcgcacgcgcagcagttttgtggaagaacagggggggccgccccagaaggaggaggacgattaatattaaaggcgcagcgccgcagccgcggcgctataacaacacgactgtcgggcgtggggaaaaaagcggagccggcgggggatacctttgtaggaaagaagagagccccaacctgatgtcggggggggagcaacaataagtggggaaaaaacctcatcccatagaggagatatttatnagcgctgctggggaggaatgaatatttaaactatttagggggtgtataagggggttcaacccacgcggagagtagttctgcgccagagagaaaaattttggtccagcgggatattattgtagaggcaaatttatttc

SEQ ID NO: 28447 - DNA, 2654 bp, Homo sapiens
aggctggtactggtctggggagtttgggatgtccgcggagacgcctatgcggtggaggctccgggcttcagctagggcgggggagcccagcagaaggaccgagcagcctggcaccccactttgccatcctctccctggaaatctcggggtcggcgggccggccgcttcgcgtgggcgaaatcagagacacgtggtttccaaggccccttcgggttcgggaaaattttatggttcgggtcacagtaggaagcggacaatgaggcgggagggcagagagaaccgcaacaccgccgcgcacctggtgccgggtcgggtcgtttccggggctttcagtggccggaagtcgcggcgcctgtactgactctaggaagggctggagttgttttgaatgggcgcccgtaagagaggtgggcaagtacgtgttacagacggccacgccgccctttaggcggtcaaggtggggcgagcagacgttcgcccccctgcagtcggccgggtcactacccaagagcctttggaggcggaagcatggaacggtctgcaaacgttcccgagcgggcctctgcggctctggcgggcgtttcgaacttgggcgccgggcacacgcccagtcccgagagcgctgagggttcccttagcgtcgccctcaccccggccaacccgcggggcgccagagtcctggccctttaaacgccgcgcgtgcctcggcgtcttcgtttcgcgcgcccgcccgcggcgccggcggagcgaacatggacccggctgcgcgggtggtgcgggcgctgtggcctggtgggtgcgccttggcctggaggctgggaggccgcccccagccgctgctacccacgcagagccgggctggcttcgcgggggcggcgggcggcccgagccccgtggctgcagctcgtaaggggagcccgcggctgctgggagctgcggcgctggccctggggggagccctggggctgtaccacacggcgcggtggcacctgcgcgcccaggacctccacgcagagcgctcagccgcgcagctctccctgtccagccgcctgcagctgaccctgtaccagtacaagacgtgtcccttctgcagcaaggtccgagccttcctcgacttccatgccctgccctaccaggtggtggaggtgaaccctgtgcgcagggctgagatcaagttctcctcctacagaaaggtgcccatcctggtggcccaggaaggagaaagctcgcaacaactaaatgactcctctgtcatcatcagcgccctcaagacctacctggtgtcggggcagcccctggaagagatcatcacctactacccagccatgaaggctgtgaacgagcagggcaaggaggtgaccgagttcggcaataagtactggctcatgctcaacgagaaggaggcccagcaagtgtatggtgggaaggaggccaggacggaggagatgaagtggcggcagtgggcggacgactggctggtgcacctgatctcccccaatgtgtaccgcacgcccaccgaggctctggcgtcctttgactacattgtccgcgagggcaagttcggagccgtggagggtgccgtggccaagtacatgggtgcagcggccatgtacctcatcagcaagcgactcaagagcaggcaccgcctccaggacaacgtgcgcgaggacctctatgaggctgctgacaagtgggtggctgctgtgggcaaggaccggcccttcatggggggccagaagccgaatctcgctgatttggcggtgtatggcgtgctgcgtgtgatggaggggctggatgcattcgatgacctgatgcagcacacgcacatccagccctggtacctgcgggtggagagggccatcaccgaggcctccccagcgcactgaatgtccccgcgcagagcagagggaaggcagcggaagacgccagctgccagggcctggggccactgggccagcgcctggcgatactggttgggggcaggatcattctgccccttgtccacgcacccccaccagccctctcgcttctaacacagggcacctgctgggttcccctggttcccactcttcccaagcctcccgggactgggacatgtttgcaataaaggaaaggtttgtggcgcctgtcatggcaggcatctcatggaacaaaaaaaacactgagaacacagaaagaaaaaacacggttgggccgcctgctggcccgtgaaagaggttcaaaaacccattggttgggcgcccgggcccaatcaggtagcgcacacggggcaagcgggccaaggaaacccgcgcagacagacgaggggggcatacacccaaataaaacggcgggggaccacgggcttcggaccaaacccgagggaacgggggccacaggggaacacacagagggtcacggagcgaatatccgcacaggagagaggaaaggcgcaagcacatcaacacgcggcaggaccagacagggacgaggggcgagggggagcggccggcgacacgagcgcgaagacaaacaagcagggacgaccagcggcactcacaaggaacacgcgagcggggtggcgacgagaaggcaaagcaaatcagggcgtgaggacacgcggggacggacgagaaacggcacaccgacgggacaccgcccgcagcccacaaaaa

SEQ ID NO: 28448 - DNA, 2616 bp, Homo sapiens
  misc_feature (2479)..(2479): n is a, c, g, or t
aggctggtactggtctggggagtttgggatgtccgcggagacgcctatgcggtggaggctccgggcttcagctagggcgggggagcccagcagaaggaccgagcagcctggcaccccactttgccatcctctccctggaaatctcggggtcggcgggccggccgcttcgcgtgggcgaaatcagagacacgtggtttccaaggccccttcgggttcgggaaaattttatggttcgggtcacagtaggaagcggacaatgaggcgggagggcagagagaaccgcaacaccgccgcgcacctggtgccgggtcgggtcgtttccggggctttcagtggccggaagtcgcggcgcctgtactgactctaggaagggctggagttgttttgaatgggcgcccgtaagagaggtgggcaagtacgtgttacagacggccacgccgccctttaggcggtcaaggtggggcgagcagacgttcgcccccctgcagtcggccgggtcactacccaagagcctttggaggcggaagcatggaacggtctgcaaacgttcccgagcgggcctctgcggctctggcgggcgtttcgaacttgggcgccgggcacacgcccagtcccgagagcgctgagggttcccttagcgtcgccctcaccccggccaacccgcggggcgccagagtcctggccctttaaacgccgcgcgtgcctcggcgtcttcgtttcgcgcgcccgcccgcggcgccggcggagcgaacatggacccggctgcgcgggtggtgcgggcgctgtggcctggtgggtgcgccttggcctggaggctgggaggccgcccccagccgctgctacccacgcagagccgggctggcttcgcgggggcggcgggcggcccgagccccgtggctgcagctcgtaaggggagcccgcggctgctgggagctgcggcgctggccctggggggagccctggggctgtaccacacggcgcggtggcacctgcgcgcccaggacctccacgcagagcgctcagccgcgcagctctccctgtccagccgcctgcagctgaccctgtaccagtacaagacgtgtcccttctgcagcaaggtccgagccttcctcgacttccatgccctgccctaccaggtggtggaggtgaaccctgtgcgcagggctgagatcaagttctcctcctacagaaaggtgcccatcctggtggcccaggaaggagaaagctcgcaacaactaaatgactcctctgtcatcatcagcgccctcaagacctacctggtgtcggggcagcccctggaagagatcatcacctactacccagccatgaaggctgtgaacgagcagggcaaggaggtgaccgagttcggcaataagtactggctcatgctcaacgagaaggaggcccagcaagtgtatggtgggaaggaggccaggacggaggagatgaagtggcggcagtgggcggacgactggctggtgcacctgatctcccccaatgtgtaccgcacgcccaccgaggctctggcgtcctttgactacattgtccgcgagggcaagttcggagccgtggagggtgccgtggccaagtacatgggtgcagcggccatgtacctcatcagcaagcgactcaagagcaggcaccgcctccaggacaacgtgcgcgaggacctctatgaggctgctgacaagtgggtggctgctgtgggcaaggaccggcccttcatggggggccagaagccgaatctcgctgatttggcggtgtatggcgtgctgcgtgtgatggaggggctggatgcattcgatgacctgatgcagcacacgcacatccagccctggtacctgcgggtggagagggccatcaccgaggcctccccagcgcactgaatctccctgctctgccgcccctcttcctggaccctcagtggctgtcccatggctacatcctgtgggtgggggccctcgacaggacagcaggacggtttgttttcagtggaatcccatccctgggttcccctggttcccactcttcccaagcctcccgggactgggacatgtttgcaataaaggaaaggtttgtggcgcctgtcatggcaggcatctcatggaaaaaaaaaaaaaaaaaaaaaaaaaaaaaaaaaaaaaaaaaaaaaaaaaaaaaaaaaaaaaaaaaagaaggaggggcggcgccacctcaggaattaccatccctgcggaggggggacccagtcattgtaggcgcacgcgcagcagttttgtggaagaacagggggggccgccccagaaggaggaggacgattaatattaaaggcgcagcgccgcagccgcggcgctataacaacacgactgtcgggcgtggggaaaaaagcggagccggcgggggatacctttgtaggaaagaagagagccccaacctgatgtcggggggggagcaacaataagtggggaaaaaacctcatcccatagaggagatatttatnagcgctgctggggaggaatgaatatttaaactatttagggggtgtataagggggttcaacccacgcggagagtagttctgcgccagagagaaaaattttggtccagcgggatattattgtagaggcaaatttatttc

SEQ ID NO: 28449 - DNA, 3297 bp, Homo sapiens
aggctggtactggtctggggagtttgggatgtccgcggagacgcctatgcggtggaggctccgggcttcagctagggcgggggagcccagcagaaggaccgagcagcctggcaccccactttgccatcctctccctggaaatctcggggtcggcgggccggccgcttcgcgtgggcgaaatcagagacacgtggtttccaaggccccttcgggttcgggaaaattttatggttcgggtcacagtaggaagcggacaatgaggcgggagggcagagagaaccgcaacaccgccgcgcacctggtgccgggtcgggtcgtttccggggctttcagtggccggaagtcgcggcgcctgtactgactctaggaagggctggagttgttttgaatgggcgcccgtaagagaggtgggcaagtacgtgttacagacggccacgccgccctttaggcggtcaaggtggggcgagcagacgttcgcccccctgcagtcggccgggtcactacccaagagcctttggaggcggaagcatggaacggtctgcaaacgttcccgagcgggcctctgcggctctggcgggcgtttcgaacttgggcgccgggcacacgcccagtcccgagagcgctgagggttcccttagcgtcgccctcaccccggccaacccgcggggcgccagagtcctggccctttaaacgccgcgcgtgcctcggcgtcttcgtttcgcgcgcccgcccgcggcgccggcggagcgaacatggacccggctgcgcgggtggtgcgggcgctgtggcctggtgggtgcgccttggcctggaggctgggaggccgcccccagccgctgctacccacgcagagccgggctggcttcgcgggggcggcgggcggcccgagccccgtggctgcagctcgtaaggggagcccgcggctgctgggagctgcggcgctggccctggggggagccctggggctgtaccacacggcgcggtggcacctgcgcgcccaggacctccacgcagagcgctcagccgcgcagctctccctgtccagccgcctgcagctgaccctgtaccagtacaagacgtgtcccttctgcagcaaggtccgagccttcctcgacttccatgccctgccctaccaggtggtggaggtgaaccctgtgcgcagggctgagatcaagttctcctcctacagaaaggtgcccatcctggtggcccaggaaggagaaagctcgcaacaactaaatgactcctctgtcatcatcagcgccctcaagacctacctggtgtcggggcagcccctggaagagatcatcacctactacccagccatgaaggctgtgaacgagcagggcaaggaggtgaccgagttcggcaataagtactggctcatgctcaacgagaaggaggcccagcaagtgtatggtgggaaggaggccaggacggaggagatgaagtggcggcagtgggcggacgactggctggtgcacctgatctcccccaatgtgtaccgcacgcccaccgaggctctggcgtcctttgactacattgtccgcgagggcaagttcggagccgtggagggtgccgtggccaagtacatgggtgcagcggccatgtacctcatcagcaagcgactcaagagcaggcaagtgtgtgtgcacatccggggcctgctgtccccgagcctccggtgccacgagcagtggtgatcccatcacacccctcaggagaccagcgggaggccgaggcctagggcaggtgggaaacgcattatggattatgggtcccttggccaagatgggacttggacccagagctcctgctcacctcccctggggacagcagggctggccttgaagccggaagcctgggccctgactggcgcctcctctgtggctttctccctggcctggtctcttgcctttaccacagcctccccgtctgggacggatgctccctgaggcgtctgcagatgtgatgctctcacctggggtgccgtcctggcttccacacctcccccctctccccagaggagaccctcttccctgctgggctgggagtgggggctcccctgaggggcttttcccttccccgcccaggcaccgcctccaggacaacgtgcgcgaggacctctatgaggctgctgacaagtgggtggctgctgtgggcaaggaccggcccttcatggggggccagaagccgaatctcgctgatttggcggtgtatggcgtgctgcgtgtgatggaggggctggatgcattcgatgacctgatgcagcacacgcacatccagccctggtacctgcgggtggagagggccatcaccgaggcctccccagcgcactgaatgtccccgcgcagagcagagggaaggcagcggaagacgccagctgccagggcctggggccactgggccagcgcctggcgatactggttgggggcaggatcattctgccccttgtccacgcacccccaccagccctctcgcttctaacacagggcacctgctggggctcagggatgttagggacgagttccagccctgccactgccctggggcgacccctccctgtccctgcctccctgctctgccgcccctcttcctggaccctcagtggctgtcccatggctacatcctgtgggtgggggccctcgacaggacagcaggacggtttgttttcagtggaatcccatccctgggttcccctggttcccactcttcccaagcctcccgggactgggacatgtttgcaataaaggaaaggtttgtggcgcctgtcatggcaggcatctcatggaacaaaaaaaacactgagaacacagaaagaaaaaacacggttgggccgcctgctggcccgtgaaagaggttcaaaaacccattggttgggcgcccgggcccaatcaggtagcgcacacggggcaagcgggccaaggaaacccgcgcagacagacgaggggggcatacacccaaataaaacggcgggggaccacgggcttcggaccaaacccgagggaacgggggccacaggggaacacacagagggtcacggagcgaatatccgcacaggagagaggaaaggcgcaagcacatcaacacgcggcaggaccagacagggacgaggggcgagggggagcggccggcgacacgagcgcgaagacaaacaagcagggacgaccagcggcactcacaaggaacacgcgagcggggtggcgacgagaaggcaaagcaaatcagggcgtgaggacacgcggggacggacgagaaacggcacaccgacgggacaccgcccgcagcccacaaaaa

SEQ ID NO: 28450 - DNA, 1760 bp, Homo sapiens
aggctggtactggtctggggagtttgggatgtccgcggagacgcctatgcggtggaggctccgggcttcagctagggcgggggagcccagcagaaggaccgagcagcctggcaccccactttgccatcctctccctggaaatctcggggtcggcgggccggccgcttcgcgtgggcgaaatcagagacacgtggtttccaaggccccttcgggttcgggaaaattttatggttcgggtcacagtaggaagcggacaatgaggcgggagggcagagagaaccgcaacaccgccgcgcacctggtgccgggtcgggtcgtttccggggctttcagtggccggaagtcgcggcgcctgtactgactctaggaagggctggagttgttttgaatgggcgcccgtaagagaggtgggcaagtacgtgttacagacggccacgccgccctttaggcggtcaaggtggggcgagcagacgttcgcccccctgcagtcggccgggtcactacccaagagcctttggaggcggaagcatggaacggtctgcaaacgttcccgagcgggcctctgcggctctggcgggcgtttcgaacttgggcgccgggcacacgcccagtcccgagagcgctgagggttcccttagcgtcgccctcaccccggccaacccgcggggcgccagagtcctggccctttaaacgccgcgcgtgcctcggcgtcttcgtttcgcgcgcccgcccgcggcgccggcggagcgaacatggacccggctgcgcgggtggtgcgggcgctgtggcctggtgggtgcgccttggcctggaggctgggaggccgcccccagccgctgctacccacgcagagccgggctggcttcgcgggggcggcgggcggcccgagccccgtggctgcagctcgtaaggggagcccgcggctgctgggagctgcggcgctggccctggggggagccctggggctgtaccacacggcgcggtggcacctgcgcgcccaggacctccacgcagagcgctcagccgcgcagctctccctgtccagccgcctgcagctgaccctgtaccagtacaagacgtgtcccttctgcagcaaggtccgagccttcctcgacttccatgccctgccctaccaggtggtggaggtgaaccctgtgcgcagggctgagatcaagttctcctcctacagaaaggtgcccatcctggtggcccaggaaggagaaagctcgcaacaactaaatgactcctctgtcatcatcagcgccctcaagacctacctggtgtcggggcagcccctggaagagatcatcacctactacccagccatgaaggctgtgaacgagcagggcaaggaggtgaccgagttcggcaataagtactggctcatgctcaacgagaaggaggcccagcaagtgtatggtgggaaggaggccaggacggaggagatgaagtggcggcagtgggcggacgactggctggtgcacctgatctcccccaatgtgtaccgcacgcccaccgaggctctggcgtcctttgactacattgtccgcgagggcaagttcggagccgtggagggtgccgtggccaagtacatgggtgcagcggccatgtacctcatcagcaagcgactcaagagcagccggtccggaaagtggcgaggcctttagtgtgacagtggctgtggaggccggccaggggccaacgactccgagggtgggcgcggaagggggccaggccccccgcggggggcggcctcccaa

SEQ ID NO: 28451 - DNA, 2057 bp, Homo sapiens
cgcactattcataggtgcgatgcctcgttgtaattcggtcgaggccaggcgttagatccacgcagagccgggctggcttcgcgggggcggcgggcggcccgagccccgtggctgcagctcgtaaggggagcccgcggctgctgggagctgcggcgctggccctggggggagccctggggctgtaccacacggcgcggtggcacctgcgcgcccaggacctccacgcagagcgctcagccgcgcagctctccctgtccagccgcctgcagctgaccctgtaccagtacaagacgtgtcccttctgcagcaaggtccgagccttcctcgacttccatgccctgccctaccaggtggtggaggtgaaccctgtgcgcagggctgagatcaagttctcctcctacagaaaggtgcccatcctggtggcccaggaaggagaaagctcgcaacaactaaatgactcctctgtcatcatcagcgccctcaagacctacctggtgtcggggcagcccctggaagagatcatcacctactacccagccatgaaggctgtgaacgagcagggcaaggaggtgaccgagttcggcaataagtactggctcatgctcaacgagaaggaggcccagcaagtgtatggtgggaaggaggccaggacggaggagatgaagtggcggcagtgggcggacgactggctggtgcacctgatctcccccaatgtgtaccgcacgcccaccgaggctctggcgtcctttgactacattgtccgcgagggcaagttcggagccgtggagggtgccgtggccaagtacatgggtgcagcggccatgtacctcatcagcaagcgactcaagagcaggcaccgcctccaggacaacgtgcgcgaggacctctatgaggctgctgacaagtgggtggctgctgtgggcaaggaccggcccttcatggggggccagaagccgaatctcgctgatttggcggtgtatggcgtgctgcgtgtgatggaggggctggatgcattcgatgacctgatgcagcacacgcacatccagccctggtacctgcgggtggagagggccatcaccgaggcctccccagcgcactgaatgtccccgcgcagagcagagggaaggcagcggaagacgccagctgccagggcctggggccactgggccagcgcctggcgatactggttgggggcaggatcattctgccccttgtccacgcacccccaccagccctctcgcttctaacacagggcacctgctggggctcagggatgttagggacgagttccagccctgccactgccctggggcgacccctccctgtccctgcctccctgctctgccgcccctcttcctggaccctcagtggctgtcccatggctacatcctgtgggtgggggccctcgacaggacagcaggacggtttgttttcagtggaatcccatccctgggttcccctggttcccactcttcccaagcctcccgggactgggacatgtttgcaataaaggaaaggtttgtggcgcctgtcatggcaggcatctcatggaacaaaaaaaacactgagaacacagaaagaaaaaacacggttgggccgcctgctggcccgtgaaagaggttcaaaaacccattggttgggcgcccgggcccaatcaggtagcgcacacggggcaagcgggccaaggaaacccgcgcagacagacgaggggggcatacacccaaataaaacggcgggggaccacgggcttcggaccaaacccgagggaacgggggccacaggggaacacacagagggtcacggagcgaatatccgcacaggagagaggaaaggcgcaagcacatcaacacgcggcaggaccagacagggacgaggggcgagggggagcggccggcgacacgagcgcgaagacaaacaagcagggacgaccagcggcactcacaaggaacacgcgagcggggtggcgacgagaaggcaaagcaaatcagggcgtgaggacacgcggggacggacgagaaacggcacaccgacgggacaccgcccgcagcccacaaaaa

SEQ ID NO: 28452 - DNA, 2822 bp, Homo sapiens
  misc_feature (2685)..(2685): n is a, c, g, or t
aggctggtactggtctggggagtttgggatgtccgcggagacgcctatgcggtggaggctccgggcttcagctagggcgggggagcccagcagaaggaccgagcagcctggcaccccactttgccatcctctccctggaaatctcggggtcggcgggccggccgcttcgcgtgggcgaaatcagagacacgtggtttccaaggccccttcgggttcgggaaaattttatggttcgggtcacagtaggaagcggacaatgaggcgggagggcagagagaaccgcaacaccgccgcgcacctggtgccgggtcgggtcgtttccggggctttcagtggccggaagtcgcggcgcctgtactgactctaggaagggctggagttgttttgaatgggcgcccgtaagagaggtgggcaagtacgtgttacagacggccacgccgccctttaggcggtcaaggtggggcgagcagacgttcgcccccctgcagtcggccgggtcactacccaagagcctttggaggcggaagcatggaacggtctgcaaacgttcccgagcgggcctctgcggctctggcgggcgtttcgaacttgggcgccgggcacacgcccagtcccgagagcgctgagggttcccttagcgtcgccctcaccccggccaacccgcggggcgccagagtcctggccctttaaacgccgcgcgtgcctcggcgtcttcgtttcgcgcgcccgcccgcggcgccggcggagcgaacatggacccggctgcgcgggtggtgcgggcgctgtggcctggtgggtgcgccttggcctggaggctgggaggccgcccccagccgctgctacccacgcagagccgggctggcttcgcgggggcggcgggcggcccgagccccgtggctgcagctcgtaaggggagcccgcggctgctgggagctgcggcgctggccctggggggagccctggggctgtaccacacggcgcggtggcacctgcgcgcccaggacctccacgcagagcgctcagccgcgcagctctccctgtccagccgcctgcagctgaccctgtaccagtacaagacgtgtcccttctgcagcaaggtccgagccttcctcgacttccatgccctgccctaccaggtggtggaggtgaaccctgtgcgcagggctgagatcaagttctcctcctacagaaaggtgcccatcctggtggcccaggaaggagaaagctcgcaacaactaaatgactcctctgtcatcatcagcgccctcaagacctacctggtgtcggggcagcccctggaagagatcatcacctactacccagccatgaaggctgtgaacgagcagggcaaggaggtgaccgagttcggcaataagtactggctcatgctcaacgagaaggaggcccagcaagtggaggagatgaagtggcggcagtgggcggacgactggctggtgcacctgatctcccccaatgtgtaccgcacgcccaccgaggctctggcgtcctttgactacattgtccgcgagggcaagttcggagccgtggagggtgccgtggccaagtacatgggtgcagcggccatgtacctcatcagcaagcgactcaagagcaggcaccgcctccaggacaacgtgcgcgaggacctctatgaggctgctgacaagtgggtggctgctgtgggcaaggaccggcccttcatggggggccagaagccgaatctcgctgatttggcggtgtatggcgtgctgcgtgtgatggaggggctggatgcattcgatgacctgatgcagcacacgcacatccagccctggtacctgcgggtggagagggccatcaccgaggcctccccagcgcactgaatgtccccgcgcagagcagagggaaggcagcggaagacgccagctgccagggcctggggccactgggccagcgcctggcgatactggttgggggcaggatcattctgccccttgtccacgcacccccaccagccctctcgcttctaacacagggcacctgctggggctcagggatgttagggacgagttccagccctgccactgccctggggcgacccctccctgtccctgcctccctgctctgccgcccctcttcctggaccctcagtggctgtcccatggctacatcctgtgggtgggggccctcgacaggacagcaggacggtttgttttcagtggaatcccatccctgggttcccctggttcccactcttcccaagcctcccgggactgggacatgtttgcaataaaggaaaggtttgtggcgcctgtcatggcaggcatctcatggaaaaaaaaaaaaaaaaaaaaaaaaaaaaaaaaaaaaaaaaaaaaaaaaaaaaaaaaaaaaaaaaaagaaggaggggcggcgccacctcaggaattaccatccctgcggaggggggacccagtcattgtaggcgcacgcgcagcagttttgtggaagaacagggggggccgccccagaaggaggaggacgattaatattaaaggcgcagcgccgcagccgcggcgctataacaacacgactgtcgggcgtggggaaaaaagcggagccggcgggggatacctttgtaggaaagaagagagccccaacctgatgtcggggggggagcaacaataagtggggaaaaaacctcatcccatagaggagatatttatnagcgctgctggggaggaatgaatatttaaactatttagggggtgtataagggggttcaacccacgcggagagtagttctgcgccagagagaaaaattttggtccagcgggatattattgtagaggcaaatttatttc

SEQ ID NO: 28453 - DNA, 2936 bp, Homo sapiens
aggctggtactggtctggggagtttgggatgtccgcggagacgcctatgcggtggaggctccgggcttcagctagggcgggggagcccagcagaaggaccgagcagcctggcaccccactttgccatcctctccctggaaatctcggggtcggcgggccggccgcttcgcgtgggcgaaatcagagacacgtggtttccaaggccccttcgggttcgggaaaattttatggttcgggtcacagtaggaagcggacaatgaggcgggagggcagagagaaccgcaacaccgccgcgcacctggtgccgggtcgggtcgtttccggggctttcagtggccggaagtcgcggcgcctgtactgactctaggaagggctggagttgttttgaatgggcgcccgtaagagaggtgggcaagtacgtgttacagacggccacgccgccctttaggcggtcaaggtggggcgagcagacgttcgcccccctgcagtcggccgggtcactacccaagagcctttggaggcggaagcatggaacggtctgcaaacgttcccgagcgggcctctgcggctctggcgggcgtttcgaacttgggcgccgggcacacgcccagtcccgagagcgctgagggttcccttagcgtcgccctcaccccggccaacccgcggggcgccagagtcctggccctttaaacgccgcgcgtgcctcggcgtcttcgtttcgcgcgcccgcccgcggcgccggcggagcgaacatggacccggctgcgcgggtggtgcgggcgctgtggcctggtgggtgcgccttggcctggaggctgggaggccgcccccagccgctgctacccacgcagagccgggctggcttcgcgggggcggcgggcggcccgagccccgtggctgcagctcgtaaggggagcccgcggctgctgggagctgcggcgctggccctggggggagccctggggctgtaccacacggcgcggtggcacctgcgcgcccaggacctccacgcagagcgctcagccgcgcagctctccctgtccagccgcctgcagctgaccctgtaccagtacaagacgtgtcccttctgcagcaaggtccgagccttcctcgacttccatgccctgccctaccaggtggtggaggtgaaccctgtgcgcagggctgagatcaagttctcctcctacagaaaggtgcccatcctggtggcccaggaaggagaaagctcgggacggcagatatgaaatgcctggcacagtgcttggggtctagtatgtagcttccagaacccaccctgcccctctacctgggaggccaaatggcaacaactaaatgactcctctgtcatcatcagcgccctcaagacctacctggtgtcggggcagcccctggaagagatcatcacctactacccagccatgaaggctgtgaacgagcagggcaaggaggtgaccgagttcggcaataagtactggctcatgctcaacgagaaggaggcccagcaagtgtatggtgggaaggaggccaggacggaggagatgaagtggcggcagtgggcggacgactggctggtgcacctgatctcccccaatgtgtaccgcacgcccaccgaggctctggcgtcctttgactacattgtccgcgagggcaagttcggagccgtggagggtgccgtggccaagtacatgggtgcagcggccatgtacctcatcagcaagcgactcaagagcaggcaccgcctccaggacaacgtgcgcgaggacctctatgaggctgctgacaagtgggtggctgctgtgggcaaggaccggcccttcatggggggccagaagccgaatctcgctgatttggcggtgtatggcgtgctgcgtgtgatggaggggctggatgcattcgatgacctgatgcagcacacgcacatccagccctggtacctgcgggtggagagggccatcaccgaggcctccccagcgcactgaatgtccccgcgcagagcagagggaaggcagcggaagacgccagctgccagggcctggggccactgggccagcgcctggcgatactggttgggggcaggatcattctgccccttgtccacgcacccccaccagccctctcgcttctaacacagggcacctgctggggctcagggatgttagggacgagttccagccctgccactgccctggggcgacccctccctgtccctgcctccctgctctgccgcccctcttcctggaccctcagtggctgtcccatggctacatcctgtgggtgggggccctcgacaggacagcaggacggtttgttttcagtggaatcccatccctgggttcccctggttcccactcttcccaagcctcccgggactgggacatgtttgcaataaaggaaaggtttgtggcgcctgtcatggcaggcatctcatggaacaaaaaaaacactgagaacacagaaagaaaaaacacggttgggccgcctgctggcccgtgaaagaggttcaaaaacccattggttgggcgcccgggcccaatcaggtagcgcacacggggcaagcgggccaaggaaacccgcgcagacagacgaggggggcatacacccaaataaaacggcgggggaccacgggcttcggaccaaacccgagggaacgggggccacaggggaacacacagagggtcacggagcgaatatccgcacaggagagaggaaaggcgcaagcacatcaacacgcggcaggaccagacagggacgaggggcgagggggagcggccggcgacacgagcgcgaagacaaacaagcagggacgaccagcggcactcacaaggaacacgcgagcggggtggcgacgagaaggcaaagcaaatcagggcgtgaggacacgcggggacggacgagaaacggcacaccgacgggacaccgcccgcagcccacaaaaa

SEQ ID NO: 28454 - DNA, 1925 bp, Homo sapiens
gggcacctgcgcgcccaggtgccaccgcgccgtgtggtacagccccaggctccccccaggcgcggtggcacctgcgcgcccaggacctccacgcagagcgctcagccgcgcagctctccctgtccagccgcctgcagctgaccctgtaccagtacaagacgtgtcccttctgcagcaaggtccgagccttcctcgacttccatgccctgccctaccaggtggtggaggtgaaccctgtgcgcagggctgagatcaagttctcctcctacagaaaggtgcccatcctggtggcccaggaaggagaaagctcgcaacaactaaatgactcctctgtcatcatcagcgccctcaagacctacctggtgtcggggcagcccctggaagagatcatcacctactacccagccatgaaggctgtgaacgagcagggcaaggaggtgaccgagttcggcaataagtactggctcatgctcaacgagaaggaggcccagcaagtgtatggtgggaaggaggccaggacggaggagatgaagtggcggcagtgggcggacgactggctggtgcacctgatctcccccaatgtgtaccgcacgcccaccgaggctctggcgtcctttgactacattgtccgcgagggcaagttcggagccgtggagggtgccgtggccaagtacatgggtgcagcggccatgtacctcatcagcaagcgactcaagagcaggcaccgcctccaggacaacgtgcgcgaggacctctatgaggctgctgacaagtgggtggctgctgtgggcaaggaccggcccttcatggggggccagaagccgaatctcgctgatttggcggtgtatggcgtgctgcgtgtgatggaggggctggatgcattcgatgacctgatgcagcacacgcacatccagccctggtacctgcgggtggagagggccatcaccgaggcctccccagcgcactgaatgtccccgcgcagagcagagggaaggcagcggaagacgccagctgccagggcctggggccactgggccagcgcctggcgatactggttgggggcaggatcattctgccccttgtccacgcacccccaccagccctctcgcttctaacacagggcacctgctggggctcagggatgttagggacgagttccagccctgccactgccctggggcgacccctccctgtccctgcctccctgctctgccgcccctcttcctggaccctcagtggctgtcccatggctacatcctgtgggtgggggccctcgacaggacagcaggacggtttgttttcagtggaatcccatccctgggttcccctggttcccactcttcccaagcctcccgggactgggacatgtttgcaataaaggaaaggtttgtggcgcctgtcatggcaggcatctcatggaacaaaaaaaacactgagaacacagaaagaaaaaacacggttgggccgcctgctggcccgtgaaagaggttcaaaaacccattggttgggcgcccgggcccaatcaggtagcgcacacggggcaagcgggccaaggaaacccgcgcagacagacgaggggggcatacacccaaataaaacggcgggggaccacgggcttcggaccaaacccgagggaacgggggccacaggggaacacacagagggtcacggagcgaatatccgcacaggagagaggaaaggcgcaagcacatcaacacgcggcaggaccagacagggacgaggggcgagggggagcggccggcgacacgagcgcgaagacaaacaagcagggacgaccagcggcactcacaaggaacacgcgagcggggtggcgacgagaaggcaaagcaaatcagggcgtgaggacacgcggggacggacgagaaacggcacaccgacgggacaccgcccgcagcccacaaaaa

SEQ ID NO: 28455 - DNA, 2191 bp, Homo sapiens
ggagcgaacatgtgaccctggctgcgcgggtgtgtgctggtgcgctgtgtgccatggatggtgttgctgccttgtgccattggatgtgcttggtgtgtgcctgcccccatgcctgcttgctacccactgcatgatgctctgtgtgcttgtagcttctgctgtgtgtgtgctgtgctgtgtgctgtgccctgatgcccctgtgtgcttgcatgcttctgtagagtggtgatgccctgctggcttagcttgtggatgcttgctgtgctgcttggccctgtgtggttgatgccctggtggctgtaccacactgtgctgctggttggcaccttgctgctgcccatggacctccactgcagagctgctcagtgcctgctgcatgctctccctgtccagccgcctgcagctgaccctgtaccagtacaagacgtgtcccttctgcagcaaggtccgagccttcctcgacttccatgccctgccctaccaggtggtggaggtgaaccctgtgcgcagggctgagatcaagttctcctcctacagaaaggtgcccatcctggtggcccaggaaggagaaagctcgcaacaactaaatgactcctctgtcatcatcagcgccctcaagacctacctggtgtcggggcagcccctggaagagatcatcacctactacccagccatgaaggctgtgaacgagcagggcaaggaggtgaccgagttcggcaataagtactggctcatgctcaacgagaaggaggcccagcaagtgtatggtgggaaggaggccaggacggaggagatgaagtggcggcagtgggcggacgactggctggtgcacctgatctcccccaatgtgtaccgcacgcccaccgaggctctggcgtcctttgactacattgtccgcgagggcaagttcggagccgtggagggtgccgtggccaagtacatgggtgcagcggccatgtacctcatcagcaagcgactcaagagcaggcaccgcctccaggacaacgtgcgcgaggacctctatgaggctgctgacaagtgggtggctgctgtgggcaaggaccggcccttcatggggggccagaagccgaatctcgctgatttggcggtgtatggcgtgctgcgtgtgatggaggggctggatgcattcgatgacctgatgcagcacacgcacatccagccctggtacctgcgggtggagagggccatcaccgaggcctccccagcgcactgaatgtccccgcgcagagcagagggaaggcagcggaagacgccagctgccagggcctggggccactgggccagcgcctggcgatactggttgggggcaggatcattctgccccttgtccacgcacccccaccagccctctcgcttctaacacagggcacctgctggggctcagggatgttagggacgagttccagccctgccactgccctggggcgacccctccctgtccctgcctccctgctctgccgcccctcttcctggaccctcagtggctgtcccatggctacatcctgtgggtgggggccctcgacaggacagcaggacggtttgttttcagtggaatcccatccctgggttcccctggttcccactcttcccaagcctcccgggactgggacatgtttgcaataaaggaaaggtttgtggcgcctgtcatggcaggcatctcatggaacaaaaaaaacactgagaacacagaaagaaaaaacacggttgggccgcctgctggcccgtgaaagaggttcaaaaacccattggttgggcgcccgggcccaatcaggtagcgcacacggggcaagcgggccaaggaaacccgcgcagacagacgaggggggcatacacccaaataaaacggcgggggaccacgggcttcggaccaaacccgagggaacgggggccacaggggaacacacagagggtcacggagcgaatatccgcacaggagagaggaaaggcgcaagcacatcaacacgcggcaggaccagacagggacgaggggcgagggggagcggccggcgacacgagcgcgaagacaaacaagcagggacgaccagcggcactcacaaggaacacgcgagcggggtggcgacgagaaggcaaagcaaatcagggcgtgaggacacgcggggacggacgagaaacggcacaccgacgggacaccgcccgcagcccacaaaaa

SEQ ID NO: 28456 - DNA, 1774 bp, Homo sapiens
  misc_feature (11)..(11): n is a, c, g, or t
ctgcaggcgantggacagggagagctgcacgcatgccttcctcgacttccatgccctgccctaccaggtggtggaggtgaaccctgtgcgcagggctgagatcaagttctcctcctacagaaaggtgcccatcctggtggcccaggaaggagaaagctcgcaacaactaaatgactcctctgtcatcatcagcgccctcaagacctacctggtgtcggggcagcccctggaagagatcatcacctactacccagccatgaaggctgtgaacgagcagggcaaggaggtgaccgagttcggcaataagtactggctcatgctcaacgagaaggaggcccagcaagtgtatggtgggaaggaggccaggacggaggagatgaagtggcggcagtgggcggacgactggctggtgcacctgatctcccccaatgtgtaccgcacgcccaccgaggctctggcgtcctttgactacattgtccgcgagggcaagttcggagccgtggagggtgccgtggccaagtacatgggtgcagcggccatgtacctcatcagcaagcgactcaagagcaggcaccgcctccaggacaacgtgcgcgaggacctctatgaggctgctgacaagtgggtggctgctgtgggcaaggaccggcccttcatggggggccagaagccgaatctcgctgatttggcggtgtatggcgtgctgcgtgtgatggaggggctggatgcattcgatgacctgatgcagcacacgcacatccagccctggtacctgcgggtggagagggccatcaccgaggcctccccagcgcactgaatgtccccgcgcagagcagagggaaggcagcggaagacgccagctgccagggcctggggccactgggccagcgcctggcgatactggttgggggcaggatcattctgccccttgtccacgcacccccaccagccctctcgcttctaacacagggcacctgctggggctcagggatgttagggacgagttccagccctgccactgccctggggcgacccctccctgtccctgcctccctgctctgccgcccctcttcctggaccctcagtggctgtcccatggctacatcctgtgggtgggggccctcgacaggacagcaggacggtttgttttcagtggaatcccatccctgggttcccctggttcccactcttcccaagcctcccgggactgggacatgtttgcaataaaggaaaggtttgtggcgcctgtcatggcaggcatctcatggaacaaaaaaaacactgagaacacagaaagaaaaaacacggttgggccgcctgctggcccgtgaaagaggttcaaaaacccattggttgggcgcccgggcccaatcaggtagcgcacacggggcaagcgggccaaggaaacccgcgcagacagacgaggggggcatacacccaaataaaacggcgggggaccacgggcttcggaccaaacccgagggaacgggggccacaggggaacacacagagggtcacggagcgaatatccgcacaggagagaggaaaggcgcaagcacatcaacacgcggcaggaccagacagggacgaggggcgagggggagcggccggcgacacgagcgcgaagacaaacaagcagggacgaccagcggcactcacaaggaacacgcgagcggggtggcgacgagaaggcaaagcaaatcagggcgtgaggacacgcggggacggacgagaaacggcacaccgacgggacaccgcccgcagcccacaaaaa

SEQ ID NO: 28457 - DNA, 2117 bp, Homo sapiens
aggctggtactggtctggggagtttgggatgtccgcggagacgcctatgcggtggaggctccgggcttcagctagggcgggggagcccagcagaaggaccgagcagcctggcaccccactttgccatcctctccctggaaatctcggggtcggcgggccggccgcttcgcgtgggcgaaatcagagacacgtggtttccaaggccccttcggctctccctgtccagccgcctgcagctgaccctgtaccagtacaagacgtgtcccttctgcagcaaggtccgagccttcctcgacttccatgccctgccctaccaggtggtggaggtgaaccctgtgcgcagggctgagatcaagttctcctcctacagaaaggtgcccatcctggtggcccaggaaggagaaagctcgggacggcagatatgaaatgcctggcacagtgcttggggtctagtatgtagcttccagaacccaccctgcccctctacctgggaggccaaatggcaacaactaaatgactcctctgtcatcatcagcgccctcaagacctacctggtgtcggggcagcccctggaagagatcatcacctactacccagccatgaaggctgtgaacgagcagggcaaggaggtgaccgagttcggcaataagtactggctcatgctcaacgagaaggaggcccagcaagtgtatggtgggaaggaggccaggacggaggagatgaagtggcggcagtgggcggacgactggctggtgcacctgatctcccccaatgtgtaccgcacgcccaccgaggctctggcgtcctttgactacattgtccgcgagggcaagttcggagccgtggagggtgccgtggccaagtacatgggtgcagcggccatgtacctcatcagcaagcgactcaagagcaggcaccgcctccaggacaacgtgcgcgaggacctctatgaggctgctgacaagtgggtggctgctgtgggcaaggaccggcccttcatggggggccagaagccgaatctcgctgatttggcggtgtatggcgtgctgcgtgtgatggaggggctggatgcattcgatgacctgatgcagcacacgcacatccagccctggtacctgcgggtggagagggccatcaccgaggcctccccagcgcactgaatgtccccgcgcagagcagagggaaggcagcggaagacgccagctgccagggcctggggccactgggccagcgcctggcgatactggttgggggcaggatcattctgccccttgtccacgcacccccaccagccctctcgcttctaacacagggcacctgctggggctcagggatgttagggacgagttccagccctgccactgccctggggcgacccctccctgtccctgcctccctgctctgccgcccctcttcctggaccctcagtggctgtcccatggctacatcctgtgggtgggggccctcgacaggacagcaggacggtttgttttcagtggaatcccatccctgggttcccctggttcccactcttcccaagcctcccgggactgggacatgtttgcaataaaggaaaggtttgtggcgcctgtcatggcaggcatctcatggaacaaaaaaaacactgagaacacagaaagaaaaaacacggttgggccgcctgctggcccgtgaaagaggttcaaaaacccattggttgggcgcccgggcccaatcaggtagcgcacacggggcaagcgggccaaggaaacccgcgcagacagacgaggggggcatacacccaaataaaacggcgggggaccacgggcttcggaccaaacccgagggaacgggggccacaggggaacacacagagggtcacggagcgaatatccgcacaggagagaggaaaggcgcaagcacatcaacacgcggcaggaccagacagggacgaggggcgagggggagcggccggcgacacgagcgcgaagacaaacaagcagggacgaccagcggcactcacaaggaacacgcgagcggggtggcgacgagaaggcaaagcaaatcagggcgtgaggacacgcggggacggacgagaaacggcacaccgacgggacaccgcccgcagcccacaaaaa

SEQ ID NO: 28458 - DNA, 2141 bp, Homo sapiens
aggctggtactggtctggggagtttgggatgtccgcggagacgcctatgcggtggaggctccgggcttcagctagggcgggggagcccagcagaaggaccgagcagcctggcaccccactttgccatcctctccctggaaatctcggggtcggcgggccggccgcttcgcgtgggcgaaatcagagacacgtggtttccaaggccccttcgggttcgggaaaattttatggttcgggtcacagtaggaagcggacaatgaggcgggagggcagagagaaccgcaacaccgccgcgcacctggtgccgggtcgggtcgtttccggggctttcagtggccggaagtcgcggcgcctgtactgactctaggaagggctggagttgttttgaatgggcgcccgtaagagaggtgggcaactctccctgtccagccgcctgcagctgaccctgtaccagtacaagacgtgtcccttctgcagcaaggtccgaaaaggtgcccatcctggtggcccaggaaggagaaagctcgcaacaactaaatgactcctctgtcatcatcagcgccctcaagacctacctggtgtcggggcagcccctggaagagatcatcacctactacccagccatgaaggctgtgaacgagcagggcaaggaggtgaccgagttcggcaataagtactggctcatgctcaacgagaaggaggcccagcaagtgtatggtgggaaggaggccaggacggaggagatgaagtggcggcagtgggcggacgactggctggtgcacctgatctcccccaatgtgtaccgcacgcccaccgaggctctggcgtcctttgactacattgtccgcgagggcaagttcggagccgtggagggtgccgtggccaagtacatgggtgcagcggccatgtacctcatcagcaagcgactcaagagcaggcaccgcctccaggacaacgtgcgcgaggacctctatgaggctgctgacaagtgggtggctgctgtgggcaaggaccggcccttcatggggggccagaagccgaatctcgctgatttggcggtgtatggcgtgctgcgtgtgatggaggggctggatgcattcgatgacctgatgcagcacacgcacatccagccctggtacctgcgggtggagagggccatcaccgaggcctccccagcgcactgaatgtccccgcgcagagcagagggaaggcagcggaagacgccagctgccagggcctggggccactgggccagcgcctggcgatactggttgggggcaggatcattctgccccttgtccacgcacccccaccagccctctcgcttctaacacagggcacctgctggggctcagggatgttagggacgagttccagccctgccactgccctggggcgacccctccctgtccctgcctccctgctctgccgcccctcttcctggaccctcagtggctgtcccatggctacatcctgtgggtgggggccctcgacaggacagcaggacggtttgttttcagtggaatcccatccctgggttcccctggttcccactcttcccaagcctcccgggactgggacatgtttgcaataaaggaaaggtttgtggcgcctgtcatggcaggcatctcatggaacaaaaaaaacactgagaacacagaaagaaaaaacacggttgggccgcctgctggcccgtgaaagaggttcaaaaacccattggttgggcgcccgggcccaatcaggtagcgcacacggggcaagcgggccaaggaaacccgcgcagacagacgaggggggcatacacccaaataaaacggcgggggaccacgggcttcggaccaaacccgagggaacgggggccacaggggaacacacagagggtcacggagcgaatatccgcacaggagagaggaaaggcgcaagcacatcaacacgcggcaggaccagacagggacgaggggcgagggggagcggccggcgacacgagcgcgaagacaaacaagcagggacgaccagcggcactcacaaggaacacgcgagcggggtggcgacgagaaggcaaagcaaatcagggcgtgaggacacgcggggacggacgagaaacggcacaccgacgggacaccgcccgcagcccacaaaaa

SEQ ID NO: 28459 - DNA, 2123 bp, Homo sapiens
  misc_feature (1986)..(1986): n is a, c, g, or t
accatcaccccatacgacaaacaaaaaacaaaacaacgcatagatagagcccggattacactcgtcacgagggtgtctgggcgctgtggcctggtgggtgcgccttggcctggaggctgggaggccgcccccagccgctgctacccacgcagagccgggctggcttcgcgggggcggcgggcggcccgagccccgtggctgcagctcgtaaggggagcccgcggctgctgggagctgcggcgctggccctggggggagccctggggctgtaccacacggcgcggtggcacctgcgcgcccaggacctccacgcagagcgctcagccgcgcagctctccctgtccagccgcctgcagctgaccctgtaccagtacaagacgtgtcccttctgcagcaaggtccgagccttcctcgacttccatgccctgccctaccaggtggtggaggtgaaccctgtgcgcagggctgagatcaagttctcctcctacagaaaggtgcccatcctggtggcccaggaaggagaaagctcgcaacaactaaatgactcctctgtcatcatcagcgccctcaagacctacctggtgtcggggcagcccctggaagagatcatcacctactacccagccatgaaggctgtgaacgagcagggcaaggaggtgaccgagttcggcaataagtactggctcatgctcaacgagaaggaggcccagcaagtggaggagatgaagtggcggcagtgggcggacgactggctggtgcacctgatctcccccaatgtgtaccgcacgcccaccgaggctctggcgtcctttgactacattgtccgcgagggcaagttcggagccgtggagggtgccgtggccaagtacatgggtgcagcggccatgtacctcatcagcaagcgactcaagagcaggcaccgcctccaggacaacgtgcgcgaggacctctatgaggctgctgacaagtgggtggctgctgtgggcaaggaccggcccttcatggggggccagaagccgaatctcgctgatttggcggtgtatggcgtgctgcgtgtgatggaggggctggatgcattcgatgacctgatgcagcacacgcacatccagccctggtacctgcgggtggagagggccatcaccgaggcctccccagcgcactgaatgtccccgcgcagagcagagggaaggcagcggaagacgccagctgccagggcctggggccactgggccagcgcctggcgatactggttgggggcaggatcattctgccccttgtccacgcacccccaccagccctctcgcttctaacacagggcacctgctggggctcagggatgttagggacgagttccagccctgccactgccctggggcgacccctccctgtccctgcctccctgctctgccgcccctcttcctggaccctcagtggctgtcccatggctacatcctgtgggtgggggccctcgacaggacagcaggacggtttgttttcagtggaatcccatccctgggttcccctggttcccactcttcccaagcctcccgggactgggacatgtttgcaataaaggaaaggtttgtggcgcctgtcatggcaggcatctcatggaaaaaaaaaaaaaaaaaaaaaaaaaaaaaaaaaaaaaaaaaaaaaaaaaaaaaaaaaaaaaaaaaagaaggaggggcggcgccacctcaggaattaccatccctgcggaggggggacccagtcattgtaggcgcacgcgcagcagttttgtggaagaacagggggggccgccccagaaggaggaggacgattaatattaaaggcgcagcgccgcagccgcggcgctataacaacacgactgtcgggcgtggggaaaaaagcggagccggcgggggatacctttgtaggaaagaagagagccccaacctgatgtcggggggggagcaacaataagtggggaaaaaacctcatcccatagaggagatatttatnagcgctgctggggaggaatgaatatttaaactatttagggggtgtataagggggttcaacccacgcggagagtagttctgcgccagagagaaaaattttggtccagcgggatattattgtagaggcaaatttatttc

SEQ ID NO: 28460 - DNA, 3194 bp, Homo sapiens
aggctggtactggtctggggagtttgggatgtccgcggagacgcctatgcggtggaggctccgggcttcagctagggcgggggagcccagcagaaggaccgagcagcctggcaccccactttgccatcctctccctggaaatctcggggtcggcgggccggccgcttcgcgtgggcgaaatcagagacacgtggtttccaaggccccttcgggttcgggaaaattttatggttcgggtcacagtaggaagcggacaatgaggcgggagggcagagagaaccgcaacaccgccgcgcacctggtgccgggtcgggtcgtttccggggctttcagtggccggaagtcgcggcgcctgtactgactctaggaagggctggagttgttttgaatgggcgcccgtaagagaggtgggcaagtacgtgttacagacggccacgccgccctttaggcggtcaaggtggggcgagcagacgttcgcccccctgcagtcggccgggtcactacccaagagcctttggaggcggaagcatggaacggtctgcaaacgttcccgagcgggcctctgcggctctggcgggcgtttcgaacttgggcgccgggcacacgcccagtcccgagagcgctgagggttcccttagcgtcgccctcaccccggccaacccgcggggcgccagagtcctggccctttaaacgccgcgcgtgcctcggcgtcttcgtttcgcgcgcccgcccgcggcgccggcggagcgaacatggacccggctgcgcgggtggtgcgggcgctgtggcctggtgggtgcgccttggcctggaggctgggaggccgcccccagccgctgctacccacgcagagccgggctggcttcgcgggggcggcgggcggcccgagccccgtggctgcagctcgtaaggggagcccgcggctgctgggagctgcggcgctggccctggggggagccctggggctgtaccacacggcgcggtggcacctgcgcgcccaggacctccacgcagagcgctcagccgcgcagaggtggtggaggtgaaccctgtgcgcagggctgagatcaagttctcctcctacagaaaggtgcccatcctggtggcccaggaaggagaaagctcgcaacaactaaatgactcctctgtcatcatcagcgccctcaagacctacctggtgtcggggcagcccctggaagagatcatcacctactacccagccatgaaggctgtgaacgagcagggcaaggaggtgaccgagttcggcaataagtactggctcatgctcaacgagaaggaggcccagcaagtgtatggtgggaaggaggccaggacggaggagatgaagtggcggcagtgggcggacgactggctggtgcacctgatctcccccaatgtgtaccgcacgcccaccgaggctctggcgtcctttgactacattgtccgcgagggcaagttcggagccgtggagggtgccgtggccaagtacatgggtgcagcggccatgtacctcatcagcaagcgactcaagagcaggcaagtgtgtgtgcacatccggggcctgctgtccccgagcctccggtgccacgagcagtggtgatcccatcacacccctcaggagaccagcgggaggccgaggcctagggcaggtgggaaacgcattatggattatgggtcccttggccaagatgggacttggacccagagctcctgctcacctcccctggggacagcagggctggccttgaagccggaagcctgggccctgactggcgcctcctctgtggctttctccctggcctggtctcttgcctttaccacagcctccccgtctgggacggatgctccctgaggcgtctgcagatgtgatgctctcacctggggtgccgtcctggcttccacacctcccccctctccccagaggagaccctcttccctgctgggctgggagtgggggctcccctgaggggcttttcccttccccgcccaggcaccgcctccaggacaacgtgcgcgaggacctctatgaggctgctgacaagtgggtggctgctgtgggcaaggaccggcccttcatggggggccagaagccgaatctcgctgatttggcggtgtatggcgtgctgcgtgtgatggaggggctggatgcattcgatgacctgatgcagcacacgcacatccagccctggtacctgcgggtggagagggccatcaccgaggcctccccagcgcactgaatgtccccgcgcagagcagagggaaggcagcggaagacgccagctgccagggcctggggccactgggccagcgcctggcgatactggttgggggcaggatcattctgccccttgtccacgcacccccaccagccctctcgcttctaacacagggcacctgctggggctcagggatgttagggacgagttccagccctgccactgccctggggcgacccctccctgtccctgcctccctgctctgccgcccctcttcctggaccctcagtggctgtcccatggctacatcctgtgggtgggggccctcgacaggacagcaggacggtttgttttcagtggaatcccatccctgggttcccctggttcccactcttcccaagcctcccgggactgggacatgtttgcaataaaggaaaggtttgtggcgcctgtcatggcaggcatctcatggaacaaaaaaaacactgagaacacagaaagaaaaaacacggttgggccgcctgctggcccgtgaaagaggttcaaaaacccattggttgggcgcccgggcccaatcaggtagcgcacacggggcaagcgggccaaggaaacccgcgcagacagacgaggggggcatacacccaaataaaacggcgggggaccacgggcttcggaccaaacccgagggaacgggggccacaggggaacacacagagggtcacggagcgaatatccgcacaggagagaggaaaggcgcaagcacatcaacacgcggcaggaccagacagggacgaggggcgagggggagcggccggcgacacgagcgcgaagacaaacaagcagggacgaccagcggcactcacaaggaacacgcgagcggggtggcgacgagaaggcaaagcaaatcagggcgtgaggacacgcggggacggacgagaaacggcacaccgacgggacaccgcccgcagcccacaaaaa

SEQ ID NO: 28461 - DNA, 1591 bp, Homo sapiens
accatgcccggctaatttttgaatttttagtagagacagagtttcagtatgttggtcaggctggtctcgaactcctgaccgcaggtgatccatccactttggcctcccaaagtgctgggactacaggcgtgagccagcgtgcctggcccactgctcatttttaaaactgtcctgcccctgggtgacctgggtcttgaaactgggtggtggggtctcttctcccccatctcaggacctgagatgaggggagggcatttatcccaaggaaacttgctggggggcagggtctgtggcccagaaaagggggtacagatgtgaagcaggcgagacctgcagccaccccacatgctttgttcaaaccctcacctgtgctgttggcccttgagtgggtcacgagctccaaggggggaggggacgggacctggccacacagctggcagggaacgaaggaggtctggatgcctgtcaaaccagctatggtgacacgtttctgttcgtgccccaggcggtgtatggcgtgctgcgtgtgatggaggggctggatgcattcgatgacctgatgcagcacacgcacatccagccctggtacctgcgggtggagagggccatcaccgaggcctccccagcgcactgaatgtccccgcgcagagcagagggaaggcagcggaagacgccagctgccagggcctggggccactgggccagcgcctggcgatactggttgggggcaggatcattctgccccttgtccacgcacccccaccagccctctcgcttctaacacagggcacctgctggggctcagggatgttagggacgagttccagccctgccactgccctggggcgacccctccctgtccctgcctccctgctctgccgcccctcttcctggaccctcagtggctgtcccatggctacatcctgtgggtgggggccctcgacaggacagcaggacggtttgttttcagtggaatcccatccctgggttcccctggttcccactcttcccaagcctcccgggactgggacatgtttgcaataaaggaaaggtttgtggcgcctgtcatggcaggcatctcatggaacaaaaaaaacactgagaacacagaaagaaaaaacacggttgggccgcctgctggcccgtgaaagaggttcaaaaacccattggttgggcgcccgggcccaatcaggtagcgcacacggggcaagcgggccaaggaaacccgcgcagacagacgaggggggcatacacccaaataaaacggcgggggaccacgggcttcggaccaaacccgagggaacgggggccacaggggaacacacagagggtcacggagcgaatatccgcacaggagagaggaaaggcgcaagcacatcaacacgcggcaggaccagacagggacgaggggcgagggggagcggccggcgacacgagcgcgaagacaaacaagcagggacgaccagcggcactcacaaggaacacgcgagcggggtggcgacgagaaggcaaagcaaatcagggcgtgaggacacgcggggacggacgagaaacggcacaccgacgggacaccgcccgcagcccacaaaaa

SEQ ID NO: 28462 - DNA, 1197 bp, Homo sapiens
  misc_feature (1171)..(1171): n is a, c, g, or t
aggctggtactggtctggggagtttgggatgtccgcggagacgcctatgcggtggaggctccgggcttcagctagggcgggggagcccagcagaaggaccgagcagcctggcaccccactttgccatcctctccctggaaatctcggggtcggcgggccggccgcttcgcgtgggcgaaatcagagacacgtggtttccaaggccccttcgggttcgggaaaattttatggttcgggtcacagtaggaagcggacaatgaggcgggagggcagagagaaccgcaacaccgccgcgcacctggtgccgggtcgggtcgtttccggggctttcagtggccggaagtcgcggcgcctgtactgactctaggaagggctggagttgttttgaatgggcgcccgtaagagaggtgggcaagtacgtgttacagacggccacgccgccctttaggcggtcaaggtggggcgagcagacgttcgcccccctgcagtcggccgggtcactacccaagagcctttggaggcggaagcatggaacggtctgcaaacgttcccgagcgggcctctgcggctctggcgggcgtttcgaacttgggcgccgggcacacgcccagtcccgagagcgctgagggttcccttagcgtcgccctcaccccggccaacccgcggggcgccagagtcctggccctttaaacgccgcgcgtgcctcggcgtcttcgtttcgcgcgcccgcccgcggcgccggcggagcgaacatggacccggctgcgcgggtggtgcgggcgctgtggcctggtgggtgcgccttggcctggaggctgggaggccgcccccagccgctgctacccacgcagagccgggctggcttcgcgggggcggcgggcggcccgagccccgtggctgcagctcgtaaggggagcccgcggctgctgggagctgcggcgctggccctggggggagccctggggctgtaccacacggcgcggtggcacctgcgcgcccaggacctccacgcagagcgctcagccgcgcagctctccctgtccagccgcctgcagctgaccctgtaccagtacaagacgtgtcccttctgcagcaaggtccgagccttcctcgacttccatgccctgccctaccgcgaattttttaattaaacgcgcttttcgcagttctnaaaatacgaaattctcgctcgctaca

SEQ ID NO: 28463 - DNA, 754 bp, Homo sapiens
aggctggtactggtctggggagtttgggatgtccgcggagacgcctatgcggtggaggctccgggcttcagctagggcgggggagcccagcagaaggaccgagcagcctggcaccccactttgccatcctctccctggaaatctcggggtcggcgggccggccgcttcgcgtgggcgaaatcagagacacgtggtttccaaggccccttcgggttcgggaaaattttatggttcgggtcacagtaggaagcggacaatgaggcgggagggcagagagaaccgcaacaccgccgcgcacctggtgccgggtcgggtcgtttccggggctttcagtggccggaagtcgcggcgcctgtactgactctaggaagggctggagttgttttgaatgggcgcccgtaagagaggtgggcaactctccctgtccagccgcctgcagctgaccctgtaccagtacaagacgtgtcccttctgcagcaaggtccgagccttcctcgacttccatgccctgccctaccaggtggtggaggtgaaccctgtgcgcagggctgagatcaagttctcctcctacagaaaggtgcccatcctggtggcccaggaaggagaaagctcgccacaactaacctcctcggactcctgccttactcatttacaccaaccacccaactatctataaacctagccatggccatccccttatgagcgggcgcagtgattataggctttcgctctaagattaaaaatggggtaccga

SEQ ID NO: 28464 - DNA, 435 bp, Homo sapiens
tggaatctcaagttttcaagagaaactggcctgttcaggggtctacctgcttccttacagtttcagtttctctttcctgaaatcacaacacacatctgtcaccaagccctgtaaaatgtgcatctgctctgccatggctcccctttccctacagctgctttgcctcatccttgtgctatcatagtggctattaaacactcccctattgttttctgctaaacagaacacatatttcttaattaggcattcaatacttcccctgccatggggtcagacacttccacatccctgctatagccatggttctcaggcctgtccgcacattccaattacttaaggaacttaaaaatttaaaaagccaatgcccaggtgacaatccagaaaattaaatcagaattttgggggagggagacagaccaggacatcattatttaa

SEQ ID NO: 28465 - DNA, 817 bp, Homo sapiens
gccatattggccaggctggtcttgagctcctgacctggtgatccacctgccttggcctcccaaagtgctgggattacaggccgagccaccatgcctggccagggaatgctttttaaatccctaaacaattgtataatattgtgtatatgtgtgtgtgcatgtgtatatatgtgtgcgagcatgtgtgcctgtatgcatatgtacattcaaaacttgggaactagtgggtttttatgtaatgtaagtggtagaactgaacagatgttggtagtatgtcagagaaatgggagccagtgatgttatttcataagactcataggtaacttggaaagcatatgtgagattagagtttttatattcgttagtgaagtagagatagtgaaagcctgccatactcctcaccaatcgtagtcatgtcatcattaattatatgcctcagtgaaaggattgagaaaaagagaacaaaagagcatcagataactaagaagaatccccaaccctgtacctcattggttgggtaacacaaatgccagtggaacctggacagtaatgatgatgtgactgttccacgtggctcagcttggccaatttcctcagctcctggtgttctgtggtcatgtccaagggactaaagcagcagtaaagctccatagtcagatgtctttgatttacccattttaggtagcaagtatcttcagctctgcctcattctatttactataaaacaaaatacagtaaggaagcaacctagaatttgttagtgggtacaatgaaaaagtagtcaccatattttggatctgcgcatttaaaaaaaaaa

SEQ ID NO: 28466 - DNA, 425 bp, Homo sapiens
tttcccagatgggaccagactttcttcattaaagtgttgagaaatgcattggtgaggagagcaccagatgcttgaaaactcttttgtagcaatcttccatgagccaggttggtgagaaaatccacagtgcttcctggttcaatgggaatcacggaatctcagagtggcagggtctaagtattagatacagcaaaaccaccaggaaaaaatgggctcagttacggaagtattgatggggcagcagggatctttggcagtgatgtcctaagaatgaaataaatgggtggtctaccgaatgattgtttgatatatgcaattttatttgattgatttctaattttttaagagacaggatcttgctctgtcacccaggctggagtgcagtggcccgattatagctcactacagccctgaacccctggctt

SEQ ID NO: 28467 - DNA, 366 bp, Homo sapiens
gaattgcttgcacccagaaggtagaggttgcagtgagccgagaccgcaccactgcactccagcatgggcgacaaagcgagactccgtctcaaaaaaaaaagaaaaaagaaacttgaatgttaatactggctttgctgccgaccacatctgtccttccagtttttgtgtctatagcctctcctgtaaaaggtagatagtaatttatttcctctctgctttataagatgctaaaatgagaaaatatatacattaattgaataaaacaagagagctttatgaaatttatgaaatataagaaataaattaggctgggcgtggtggctcacgcctgtaatcccagcactttgggaggccaagacgggtgga

SEQ ID NO: 28468 - DNA, 1415 bp, Homo sapiens
tgtattaatttgcaaataaatgtctatcttattattttgagagatttaaaaaattttagttcttcaaaattgcattttcacattttgaattacgttatctttgacaaatacagaagatgtcaaattttggtttattttctttggttctaatttatatttttgtttaaaactatatttttcactatagactctttctgtctctcgaggtccctgtataatgaaaaagaaggctggaaaaagtattaacattgtcaaaatccaggaaaagtagttggtcatgatattgatcgttaactttagaaactttttgtatcttgtgggttaaattaggattactatgtggtagtgataaatgatgttaattagggccgagtgcagtggctaacacctgtaattccagcatgtagggaggctgaggtgggaggatgtcttgaatccaggagtttgagaccagcctgtacaacatagtgtaagaccccttctccacacaaaaaattagaaaatttgtcaagcatcttggtgcacacctgtagtcccagctgcttgggaggatgaagcgagagaatcacttaagcccaggtgttcgaggctgcagtgagctatgattgcaccactgcactccagactagatgaccatctcttttaaaaaaatgtgtttatatgttatatgtgatagtgctttttaaaaacatttttaaattatagagacagggtctcactatgttacagcccaggctggtctcaaattcctgggctcaagcaatcctcccaccttagctaacctcccaaagtgctcggattataggcatgagctgcatgcccagctaatttagtgatttttaaaaactgagctggtaattataaattctcttcctggaacttctgactttctcacaattggaatcttttgacaaaaattatcagtaatgggaaaactttgtgtagttgtcatttttcctcccatcagtgtgatagatatgattggagttatgttggactgatattttgaaaaaagatttaattatagctattaataaagacatttaaactactgactatgcatttttattcttttgggagggtttaatgtttatagtttaaagcaaactgttgtttttaaaaaagtatctaacagggccgggcgcggtggctcacacctgtaatcccagcactttgggaggcctaggcgggcggatcacaaggtcaagagatcaagaccatcctggctaacatggtgaaaccctgtctctactaaaaatacaaaaaaatagctgggtgtggcggcgtgcgcctgtagtcccagctactcgggaggctgaggcaggaggatggcatgaacccgggaggcggagcttgcagtgagccgagatcgcgccactgcactccagcctgggcgacagagcaatactctgtct

SEQ ID NO: 28469 - DNA, 1043 bp, Homo sapiens
tgtattaatttgcaaataaatgtctatcttattattttgagagatttaaaaaattttagttcttcaaaattgcattttcacattttgaattacgttatctttgacaaatacagaagatgtcaaattttggtttattttctttggttctaatttatatttttgtttaaaactatatttttcactatagactctttctgtctctcgaggtccctgtataatgaaaaagaaggctggaaaaagtattaacattgtcaaaatccaggaaaagtagttggtcatgatattgatcgttaactttagaaactttttgtatcttgtgggttaaattaggattactatgtggtagtgataaatgatgttaattagggccgagtgcagtggctaacacctgtaatcccaccttagctaacctcccaaagtgctcggattataggcatgagctgcatgcccagctaatttagtgatttttaaaaactgagctggtaattataaattctcttcctggaacttctgactttctcacaattggaatcttttgacaaaaattatcagtaatgggaaaactttgtgtagttgtcatttttcctcccatcagtgtgatagatatgattggagttatgttggactgatattttgaaaaaagatttaattatagctattaataaagacatttaaactactgactatgcatttttattcttttgggagggtttaatgtttatagtttaaagcaaactgttgtttttaaaaaagtatctaacagggccgggcgcggtggctcacacctgtaatcccagcactttgggaggcctaggcgggcggatcacaaggtcaagagatcaagaccatcctggctaacatggtgaaaccctgtctctactaaaaatacaaaaaaatagctgggtgtggcggcgtgcgcctgtagtcccagctactcgggaggctgaggcaggaggatggcatgaacccgggaggcggagcttgcagtgagccgagatcgcgccactgcactccagcctgggcgacagagcaatactctgtct

SEQ ID NO: 28470 - DNA, 385 bp, Homo sapiens
ttttttttagctaaagtccatactttattcagatttccttagtttttatctaatatcctttcctgttccaagattccatcgaggataccccattatatttagtcttcttttctccttaagctcctggaactctgatagtgtctcagacttttctcgtttttgatgtccctgacagttttgagctcataggtcttttgactatttattctctgtactttgcttacactagagtaccacaacaaatattactttgaattaggtaatatctataattggtgaaaagcaaatcatgtttgaagtagctacatggtaaggatgatcaagttatcactgaaacttgtttgagcagctttggttgtgtatagcttattttctgactacgtat

SEQ ID NO: 28471 - DNA, 993 bp, Homo sapiens
agggaaaggcattctggggagaaggaacaattggccagattccaaatggctttaaatgccatgtaatctggattatatcctttgtgtaataaggaatcactgaaggtttttaagtaagggtgtgacaatatcacgtgttttagaaagaactctggcagcagggtagagcatggacggaactgaaaagctactgcataatcttggcaagagataagggctcgcactaaggcagtgaggatgggaatgagaggactgctgacaagagagaagacaggtcttgagaccatctgcctggatgttaaagactggagaagtaaaagatcactgagggactaaatgaaatgccatggttgggaacacagaaggaattcttttttttttttttgagaaggagtctcagctctgtcgcccgcccaggctggagtacagtggtgtgatttcagctcactgcaacctccgcctcccaggttcaagtgattctcatgcctcagcctgctgagtagctgggattacaggtgcatgctaccacacacggctaatttttgtatttttagtaggggttttgtatttttagtggggtttcaccatgctggcaggctggtctcaaactcctgacctaaagtgacccgcccaccttggcctcccaaagtgttcggattacaggcgtgagccactgtgcccggccaggaatcccttatattattaactttcaatataaaaaagttgcctaaggcatatataagtggcaactgttgaacaggcagtgcagtaatagggacaggctcaggagagaggtaaatgctgtagataaatatctgggaattaacatttgggtgagaactgacaccactgcagtgaataccttcatccaggaagaaatacagaagttttacaaaagaatcttgaggtatctcaatatttaaaggggccagtggtaggagctcgggagcaggtgctggcagtcagtcggaacaacctctcccagccttgcct

SEQ ID NO: 28472 - DNA, 1043 bp, Homo sapiens
tcctggattgcataaaggctccttctccttacatagccagggcaaaggtgcatgacaactctgagcaagtcaaaacaaccgtcagcagcgggaaacctcgatgaacaaacaccgggagagtgtttctgcagatcctgctttgtgacttcgagtgaagtgtggaagcgctggaagcacttagaccctgcctgtgccgcagacccctgggaggcaccaacaccccggatcgagaagcccgatgggaaagaatgtctgggaaggacgtcatgcccgaggcttgcgtgacagtttccactcacagtgcgctcactctgaacctctgtgcacacgatgggcctgcatctcttcccactatctgctaggaaacacgaggggaaggaaatgaccgcagaagggagtgcaccgtgggggcaggaggtgctgcggccaatgggcagtgctgggagatgaaaccaacagcggcgattgccccagaaagaacttggcgctgctaaggcaatggcggcccgaaagaggcccctgacgcatgaggagcggccgccgtctccagccccaggcctccctcccctgtgtttcccgcagccccctctggagtctctcccccgccccgcacgtgtagggagaccccgggaaagtgggccggttataattgcaaaaaataaaccgtcagtagccacaatatcttataaacgtaaaagtaatctgaaaacctacttcagttagagaaagggcgtttgaatatttcctgtttaagacacagaccccctgagaagatgtataaaggacttgggctgggtgtggtggctcacactgcccacaccatgaccttggacccccggcctccggaactgagaggcgccgaacgcctgctgttcaagctgcaccgtgatgggcacttggttctgtctgccccaggaaaatgagcccagcgctctccccaaactcctttgtcctgaacttctttccagagccctcagccctaatgggtggtcccctagggtcctcagccttcagactctaaattcccgttggaaacccacagg

SEQ ID NO: 28473 - DNA, 1045 bp, Homo sapiens
tgacacgcgccaccaggctccgcgctcatggcctggcctggcatctcaccaggcttttcaatggactagagtgcggggctgctctgcctgtggcaagggttgtcctgctgctgggcacaggcccagagaggaagtggcagaagctgggcatgggatgctggtccttgaaggagtgtgtgggggccactgggttgaacgcagcccgctgcagccctgtgaccttgattaaaagactactttttagagcagttttcattttaccgatacatcgatcagagagtacggagcttcccacattgcctcccgcaccccatagcaggcagaggcaccagccaggcgccatcctttacaagctgtttcagcaaaatgtccctgggaaggaaatgaccgcagaagggagtgcaccgtgggggcaggaggtgctgcggccaatgggcagtgctgggagatgaaaccaacagcggcgattgccccagaaagaacttggcgctgctaaggcaatggcggcccgaaagaggcccctgacgcatgaggagcggccgccgtctccagccccaggcctccctcccctgtgtttcccgcagccccctctggagtctctcccccgccccgcacgtgtagggagaccccgggaaagtgggccggttataattgcaaaaaataaaccgtcagtagccacaatatcttataaacgtaaaagtaatctgaaaacctacttcagttagagaaagggcgtttgaatatttcctgtttaagacacagaccccctgagaagatgtataaaggacttgggctgggtgtggtggctcacactgcccacaccatgaccttggacccccggcctccggaactgagaggcgccgaacgcctgctgttcaagctgcaccgtgatgggcacttggttctgtctgccccaggaaaatgagcccagcgctctccccaaactcctttgtcctgaacttctttccagagccctcagccctaatgggtggtcccctagggtcctcagccttcagactctaaattcccgttggaaacccacagg

SEQ ID NO: 28474 - DNA, 989 bp, Homo sapiens
gtggctctgacgatgatggtgaggtggtggagacgccctcacagctgggccaccctcccgtcgggagacacgttttgtcagttgcttcctctggagtccttttaaaagactactttttagagcagttttcattttaccgatacatcgatcagagagtacggagcttcccacattgcctcccgcaccccatagcaggcagaggcaccagccaggcgccatcctttacaagctgtttcagcaaaatgtccctgggtcttaatgattaagtccaggcactccaaggacgattaaatatttaaacagcagcttccctttgaagggaaggaaatgaccgcagaagggagtgcaccgtgggggcaggaggtgctgcggccaatgggcagtgctgggagatgaaaccaacagcggcgattgccccagaaagaacttggcgctgctaaggcaatggcggcccgaaagaggcccctgacgcatgaggagcggccgccgtctccagccccaggcctccctcccctgtgtttcccgcagccccctctggagtctctcccccgccccgcacgtgtagggagaccccgggaaagtgggccggttataattgcaaaaaataaaccgtcagtagccacaatatcttataaacgtaaaagtaatctgaaaacctacttcagttagagaaagggcgtttgaatatttcctgtttaagacacagaccccctgagaagatgtataaaggacttgggctgggtgtggtggctcacactgcccacaccatgaccttggacccccggcctccggaactgagaggcgccgaacgcctgctgttcaagctgcaccgtgatgggcacttggttctgtctgccccaggaaaatgagcccagcgctctccccaaactcctttgtcctgaacttctttccagagccctcagccctaatgggtggtcccctagggtcctcagccttcagactctaaattcccgttggaaacccacagg

SEQ ID NO: 28475 - DNA, 921 bp, Homo sapiens
gtggctctgacgatgatggtgaggtggtggagacgccctcacagctgggccaccctcccgtcgggagacacgttttgtcagttgcttcctctggagtccttttaaaagactactttttagagcagttttcattttaccgatacatcgatcagagagtacggagcttcccacattgcctcccgcaccccatagcaggcagaggcaccagccaggcgccatcctttacaagctgtttcagcaaaatgtccctgggaaggaaatgaccgcagaagggagtgcaccgtgggggcaggaggtgctgcggccaatgggcagtgctgggagatgaaaccaacagcggcgattgccccagaaagaacttggcgctgctaaggcaatggcggcccgaaagaggcccctgacgcatgaggagcggccgccgtctccagccccaggcctccctcccctgtgtttcccgcagccccctctggagtctctcccccgccccgcacgtgtagggagaccccgggaaagtgggccggttataattgcaaaaaataaaccgtcagtagccacaatatcttataaacgtaaaagtaatctgaaaacctacttcagttagagaaagggcgtttgaatatttcctgtttaagacacagaccccctgagaagatgtataaaggacttgggctgggtgtggtggctcacactgcccacaccatgaccttggacccccggcctccggaactgagaggcgccgaacgcctgctgttcaagctgcaccgtgatgggcacttggttctgtctgccccaggaaaatgagcccagcgctctccccaaactcctttgtcctgaacttctttccagagccctcagccctaatgggtggtcccctagggtcctcagccttcagactctaaattcccgttggaaacccacagg

SEQ ID NO: 28476 - DNA, 771 bp, Homo sapiens
gtggctctgacgatgatggtgaggtggtggagacgccctcacagctgggccaccctcccgtcgggagacacgttttgtcagttgcttcctctggagtccttggaaggaaatgaccgcagaagggagtgcaccgtgggggcaggaggtgctgcggccaatgggcagtgctgggagatgaaaccaacagcggcgattgccccagaaagaacttggcgctgctaaggcaatggcggcccgaaagaggcccctgacgcatgaggagcggccgccgtctccagccccaggcctccctcccctgtgtttcccgcagccccctctggagtctctcccccgccccgcacgtgtagggagaccccgggaaagtgggccggttataattgcaaaaaataaaccgtcagtagccacaatatcttataaacgtaaaagtaatctgaaaacctacttcagttagagaaagggcgtttgaatatttcctgtttaagacacagaccccctgagaagatgtataaaggacttgggctgggtgtggtggctcacactgcccacaccatgaccttggacccccggcctccggaactgagaggcgccgaacgcctgctgttcaagctgcaccgtgatgggcacttggttctgtctgccccaggaaaatgagcccagcgctctccccaaactcctttgtcctgaacttctttccagagccctcagccctaatgggtggtcccctagggtcctcagccttcagactctaaattcccgttggaaacccacagg

SEQ ID NO: 28477 - DNA, 478 bp, Homo sapiens
agcagcctgcggagcgttctaggcaggacagggcagcaaacctgacatgcggagctgggggcaggggtaatggggccagggggtaatggcaggtgaggccatggcctagagggttgccatgcttggtgcaggggaggagaggcccaggtgtggctgcagtggcagcaggagtcagtgtggctgtgcccagtgggatgttgtcagagaatggacctggctgctgggaaaggtgattgtgtttgtctgagccacactggactcttctctgaccagcaagcacattctggagatgcggggcagagacgaggcctccgtgagaacctttgaggtgtgagggccttgatctggggtgcagcctccagctttctgcttacagagcaggacctgcaggagctcgctgactgcctgcacagtggaaggaagacctgtttcttttactttccttgaggagaaaaaattaaagttctgagcaaacgca

SEQ ID NO: 28478 - DNA, 542 bp, Homo sapiens
ttctctgccttcctcctgctcctggtggcttatgtcctgccgctcttgatacgcgactgtggtctgtcctgggatggttatgatgcatatgtgctattgttgtgaactgtaacattgaggtctggccttacggttggttttgattgtcccttctgctcccttttcttattttaatattttaccattttccattttaatgtatctgttgtcttttttggctaaatctcttttcagttttattttactgtatatcttttctaagtgattgcttagagattacaatatactaaacctagcctttcacagtttctgcagatcctgctttgtgacttcgagtgaagtgtggaagcgctggaagcacttagaccctgcctgtgagttgtcatgtatcatgtctgcaaacattaaaaatctcaccagatgatgggatgcagaggttgcggtgagctgagatgacgccactacactccagcctaggcgacagagcaagaccctatctcaaaaaacaaaacaaaataaaagttctctgcttattttgcacc

SEQ ID NO: 28479 - DNA, 496 bp, Homo sapiens
tcctggattgcataaaggctccttctccttacatagccagggcaaaggtgcatgacaactctgagcaagtcaaaacaaccgtcagcagcgggaaacctcgatgaacaaacaccgggagagtgtttctgcagatcctgctttgtgacttcgagtgaagtgtggaagcgctggaagcacttagaccctgcctgtgccgcagacccctgggaggcaccaacaccccggatcgagaagcccgatgggaaagaatgtctgggaaggacgtcatgcccgaggcttgcgtgacagtttccactcacagtgcgctcactctgaacctctgtgcacacgatgggcctgcatctcttcccactatctgctaggaaacacgaggcctccagctttctgcttacagagcaggacctgcaggagctcgctgactgcctgcacagtggaaggaagacctgtttcttttactttccttgaggagaaaaaattaaagttctgagcaaacgca

SEQ ID NO: 28480 - DNA, 570 bp, Homo sapiens
tcctggattgcataaaggctccttctccttacatagccagggcaaaggtgcatgacaactctgagcaagtcaaaacaaccgtcagcagcgggaaacctcgatgaacaaacaccgggagagtgcattcccaggggagttccaggaggcccatggcccctcctgtacagccctccaccgcccagagccttccagcgccgtgtcttccccttggagcatctggaggccccagacagcacccgcctgacgttcagcagagggggagaccgaggcctgcagcagagtgttttgtcagatgctgctccctgaccgggagtgagagggaacccacctagagtttctgcagatcctgctttgtgacttcgagtgaagtgtggaagcgctggaagcacttagaccctgcctgtgagttgtcatgtatcatgtctgcaaacattaaaaatctcaccagatgatgggatgcagaggttgcggtgagctgagatgacgccactacactccagcctaggcgacagagcaagaccctatctcaaaaaacaaaacaaaataaaagttctctgcttattttgcacc

SEQ ID NO: 28481 - DNA, 870 bp, Homo sapiens
aaacagaccagtcacagaaagctgaaggtgctggagatgccaagtgaagtgtgtgcatttttgatagctgtgtacttctggtgactgtacacttgaaatactattttttatcaagttttataaagatgcagaattttgttttacttttttttttttaaagctatgttgttagcacacagaacacttcattgtgtttgtgggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgcttgtatactgttaacgattgtctgcccatgtcctgcctgaaataccatgattgtttatggaaagtatctttaataaagctggatacagcttggcttggtaaaaa

SEQ ID NO: 28482 - DNA, 2700 bp, Homo sapiens
agcaattgggaacagaaagtgcttcctgtcccggcctgagacaatggacaataaacccagcctggtgggccccggcccctgaccccaaggcttcaggaagaggctcccacacgcacacacctgcggtgtgcgaagctcgcattgttctgggctcatggccgagtagggccccttgctctcaggagcctccagctctttctggacctgagccctgggagccttcactctgcccagatgtgcttcctgtggaaggagacccccagatgacacagatggagtcttgctctgtcacccaggctggaatgcagtggcatgatcttggctcactgaaacctctgcctcccggttcaagcaattctcctgcctcagcctcctgagtagctgggattacagaaaatctgagcagtgggtgaggccgagggactgcccagagccccagagcacggcagtgggcaagcagtcgtccctgtcctgggcatccctgtggccatggagctcctgggtgagcagctgctctgagacaagtctggtgaagaatacagcaggactcctgaacattcttccttaaatgcttatctgtggaaaccagaactgcccttggcgcgtggctcgtggacgtgctgggtggctgggtggggcgggtgcacgggtggagcctcagctctgtttctttctctgggtagtgtccccactgccgggcttctcccgctctcagctctctggggaggtcccctgtgaagggcctgtctttcctgtcccctccctcggatcattaatgaaccactctctctctctttttccttttcagtgattgggctgtcggaatcaaagaggccctccggtgactcaggcgtttcccattgccctattctagcatcctctactcttagcactgagagtttttcacgtcctatttggaactgataggaaaccctttcattgtttcgctacatggatattagcactgatgaaggaagcgctccatcagatagtggtccgctgcagtgagctggtttccagcacgagcctgcctagactcagcgtctcccgcctccagggacccccagactctcagcccctaggcaccctgggccagggtggttggaagcttctaggcattgtggggtctctggcaccagagacactcgggggtctggggaccgagtttgggccctgtacccacccactaccatttgacatggtgagagagagagagagagatgacgagctcaggcagggatggcttctccagtgcccacaatgtgccaggactctgctgtgccactgtgggcctttcctcacccctccctcccagacatcaagctccggtttccagctgtgttccttgaagccgtcgggctctctggtgacagccacagagcctctgagcaactttgctttcagctattttccatgacccagtcctgggtaaggcttcatttgaatgaagggttctgctgctaaaaaaaaaaaaaaagttggaaaaaccacctgatcacaactttctaaggcagctattttgttttgcaatgagatatttgcagtggtttcactaaagcctgatcttcccactggactgtcggcctgtgaggatgaggacgtgtctatcacagtcagtatgccctgaatgaatgggtgtcaccctccgccccctagtgagagataaggacctcaggctcagagaggttatgtggttttctcaaagccacacagcaagatttggcaggtgagccttacttctcttcctgggctagcctgcggtcaggggcaaggcttttggatgataagagtgaggtgcagtcagctctatattgggggtggcagagggaaaaggagggggggttcccaaagcaccattctgctttctgtgagaagggatttcccctcaacaacttctgtcccatttttcagagctaaagtgacaagccacatccacgtccctggttaaaggtgctccccctgcaggaaacacatgtgcacttgggatggagccctctgtgcgggagcggcttgctcacctctcagccagtgccagctgggtgggtctctcccagctctcgaatcctaactgcagccaccatttattcagcacctgttatgtaccaggcactttatgtatcttattgctaaccctcaaaacaagcccttcccaacataagcgcttttgtgccaaacccataggtctgaaactgagacccagagaggctgaatgacatgctcacagtcacacagcaggcagtggcaggcagtagtgaagtcggctctatggattgtatacctgggctcctccaggcctctgcgctgcccggcctgataccctagcaggttgggtattcagaggtgcctggggagcttgttaaaagtgtagattccaggcctccttacccttagagactgtgactcagtatccggggcagggcccaggcatcttcattttgacaggccgtcccggtggctgccatgcgcaggcaggttttaggaacatcatgggtggatgattcctggtctccccagccctcttgacctggccacagagagctgcctttccagcgaggtcagccgagatgacgctgccgggagagcagtcttctctgtagtccccggaggggactcctcggaggaaggatgagtctgagggttccggttgtcttggcctgagaccacccaaggtcttttaacagaaaaaaacttcacccaaaa

SEQ ID NO: 28483 - DNA, 355 bp, Homo sapiens
tatagactagtttgggtggattgggcaaatccgactcggaccatccatgattttatattgtgacctgaattattgtgaaaatatcttctcagctgctttagctttcttctttgtgaaaggcagaatggaaagaggcctgggatccaagtcacaagacccaaactgcaggccccacactgccacagttcaacccttctgtgtctctgtgccctgaaatgtaaaacatgggcttgaaccaagtaacgtccaaagccctacttaactctaacaaatgtgttattctctagtttctttcaggttgcctgtctcagttgaagaatatgactaaatttttttctcattagcatccataaaa

SEQ ID NO: 28484 - DNA, 3498 bp, Homo sapiens
  misc_feature (7)..(7): n is a, c, g, or t
  misc_feature (9)..(9): n is a, c, g, or t
  misc_feature (12)..(13): n is a, c, g, or t
  misc_feature (17)..(18): n is a, c, g, or t
  misc_feature (29)..(29): n is a, c, g, or t
gagggcngnccnngagnnccggccccgcntcggccggccccgcctcggccggggcgtgggctccggctgcagctccggtctgctctcttggctcgggaacccccgcgggcgctggctccgtctgccagggatgacggcgacccctgagagcctcttccccactggggacgaactggactccagccagctccagatggagtccgatgaggtggacaccctgaaggagggagaggacccagccgaccggatgcacccgtttctggccatctatgagcttcagtctctgaaagtgcaccccttggtgttcgcacctggggtccctgtcacagcccaggtggtgggcaccgaaagatataccagcggatccaaggtgggaacctgcactctgtattctgtccgcttgactcacggcgacttttcctggacaaccaagaagaaataccgtcattttcaggagctgcatcgggacctcctgagacacaaagtcttgatgagtctgctccctctggctcgatttgccgttgcctattctccagcccgagatgcaggcaacagagagatgccctctctaccccgggcaggtcctgagggctccaccagacatgcagccagcaaacagaaatacctggagaattacctcaaccgtctcttgaccatgtctttctatcgcaactaccatgccatgacagagttcctggaagtcagtcagctgtcctttatcccggacttgggccgcaaaggactggaggggatgatccggaagcgctcaggtggccaccgtgttcctggcctcacctgctgtggccgagaccaagtttgttatcgctggtccaagaggtggctggtggtgaaggactccttcctgctgtacatgtgcctcgagacaggtgccatctcatttgttcagctctttgaccctggctttgaggtgcaagtggggaaaaggagcacggaggcacggcacggcgtgcggatcgatacctcccacaggtccttgattctcaagtgcagcagctaccggcaggcacggtggtgggcccaagagatcactgagctggcacagggcccaggcagagacttcctacagctgcaccggcatgacagctacgccccaccccggcctgggaccttggcccggtggtttgtgaatggggcaggttactttgctgctgtggcagatgccatccttcgagctcaagaggagattttcatcacagactggtggttgagtcctgaggtttacctgaagcgtccggcccattcagatgactggagactggacattatgctcaagaggaaggcggaggaaggtgtccgtgtgtctattctgctgtttaaagaagtggaattggccttgggcatcaacagtggctatagcaagagggcgctgatgctgctgcaccccaacataaaggtgatgcgtcacccagaccaagtgacgttgtgggcccatcatgagaagctcctggtggtggaccaagtggtagcattcctggggggactggaccttgcctatggccgctgggatgacctgcactaccgactgactgaccttggagactcctctgaatcagctgcctcccagcctcccaccccgcgcccagactcaccagccaccccagacctctctcacaaccaattcttctggctgggcaaggactacagcaatcttatcaccaaggactgggtgcagctggaccggcctttcgaagatttcattgacagggagacgacccctcggatgccatggcgggacgttggggtggtcgtccatggcctaccggcccgggaccttgcccggcacttcatccagcgctggaacttcaccaagaccaccaaggccaagtacaagactcccacatacccctacctgcttcccaagtctaccagcacggccaatcagctccccttcacacttccaggagggcagtgcaccaccgtacaggtcttgcgatcagtggaccgctggtcagcagggactctggagaactccatcctcaatgcctacctgcacaccatcagggagagccagcacttcctctacattgagaatcagttcttcattagctgctcagatgggcggacggttctgaacaaggtgggcgatgagattgtggacagaatcctgaaggcccacaaacaggggtggtgttaccgagtctacgtgcttttgcccttactccctggcttcgagggtgacatctccacgggcggtggcaactccatccaggccattctgcactttacttacaggaccctgtgtcgtggggagtattcaatcctgcatcgccttaaagcagccatggggacagcatggcgggactatatttccatctgcgggcttcgtacacacggagagctgggcgggcaccccgtctcggagctcatctacatccacagcaaggtgctcatcgcagatgaccggacagtcatcattggttctgcaaacatcaatgaccggagcttgctggggaagcgggacagtgagctggccgtgctgatcgaggacacagagacggaaccatccctcatgaatggggcagagtatcaggcgggcaggtttgccttgagtctgcggaagcactgcttcggtgtgattcttggagcaaatacccggccagacttggatctccgagaccccatctgtgatgacttcttccagttgtggcaagacatggctgagagcaacgccaatatctatgagcagatcttccgctgcctgccatccaatgccacgcgttccctgcggactctccgggagtacgtggccgtggagcccttggccacggtcagtccccccttggctcggtctgagctcacccaggtccagggccacctggtccacttccccctcaagttcctagaggatgagtctttgctgcccccgctgggtagcaaggagggcatgatccccctagaagtgtggacatagttgaggcccccgtcagggagaggtcaccagctgctgtgccccaccacgtctggctccctgccccttaaccccaaggactgagggcagtgccctttgagatctggggaggcaggcattcctgaagggaactagaggtgttacagaggacccttacgtgagaaatagctgaaaagggcactcccaaccctgggctggggaggaggagagagtcccagagctcatcccccctgctgcccagtgcaaaccacttctccatgctgcaaaggagaagcacagctcctgccagggtgagcagggtcaagcctcttattccaggagaagggggctctgccccaggccctactacccattgttcccttcctcttcctgcccttgaaccccctccctgtcccagggccctcccagcccattgctgccaaggtggagggaaggataaagccacttctggcttcagcccccaccaggggaaggaaggagggcacattaactccctccaccagcctgctgacagacactaactttgtatccgttcaataagcatttcataaataaaggtgtagaaaagg

SEQ ID NO: 28485 - DNA, 3454 bp, Homo sapiens
tactccactgaataatctcctagaggccctccggtctgctctcttggctcgggaacccccgcgggcgctggctccgtctgccagggatgacggcgacccctgagagcctcttccccactggggacgaactggactccagccagctccagatggagtccgatgaggtggacaccctgaaggagggagaggacccagccgaccggatgcacccgtttctggccatctatgagcttcagtctctgaaagtgcaccccttggtgttcgcacctggggtccctgtcacagcccaggtggtgggcaccgaaagatataccagcggatccaaggtgggaacctgcactctgtattctgtccgcttgactcacggcgacttttcctggacaaccaagaagaaataccgtcattttcaggagctgcatcgggacctcctgagacacaaagtcttgatgagtctgctccctctggctcgatttgccgttgcctattctccagcccgagatgcaggcaacagagagatgccctctctaccccgggcaggtcctgagggctccaccagacatgcagccagcaaacagaaatacctggagaattacctcaaccgtctcttgaccatgtctttctatcgcaactaccatgccatgacagagttcctggaagtcagtcagctgtcctttatcccggacttgggccgcaaaggactggaggggatgatccggaagcgctcaggtggccaccgtgttcctggcctcacctgctgtggccgagaccaagtttgttatcgctggtccaagaggtggctggtggtgaaggactccttcctgctgtacatgtgcctcgagacaggtgccatctcatttgttcagctctttgaccctggctttgaggtgcaagtggggaaaaggagcacggaggcacggcacggcgtgcggatcgatacctcccacaggtccttgattctcaagtgcagcagctaccggcaggcacggtggtgggcccaagagatcactgagctggcacagggcccaggcagagacttcctacagctgcaccggcatgacagctacgccccaccccggcctgggaccttggcccggtggtttgtgaatggggcaggttactttgctgctgtggcagatgccatccttcgagctcaagaggagattttcatcacagactggtggttgagtcctgaggtttacctgaagcgtccggcccattcagatgactggagactggacattatgctcaagaggaaggcggaggaaggtgtccgtgtgtctattctgctgtttaaagaagtggaattggccttgggcatcaacagtggctatagcaagagggcgctgatgctgctgcaccccaacataaaggtgatgcgtcacccagaccaagtgacgttgtgggcccatcatgagaagctcctggtggtggaccaagtggtagcattcctggggggactggaccttgcctatggccgctgggatgacctgcactaccgactgactgaccttggagactcctctgaatcagctgcctcccagcctcccaccccgcgcccagactcaccagccaccccagacctctctcacaaccaattcttctggctgggcaaggactacagcaatcttatcaccaaggactgggtgcagctggaccggcctttcgaagatttcattgacagggagacgacccctcggatgccatggcgggacgttggggtggtcgtccatggcctaccggcccgggaccttgcccggcacttcatccagcgctggaacttcaccaagaccaccaaggccaagtacaagactcccacatacccctacctgcttcccaagtctaccagcacggccaatcagctccccttcacacttccaggagggcagtgcaccaccgtacaggtcttgcgatcagtggaccgctggtcagcagggactctggagaactccatcctcaatgcctacctgcacaccatcagggagagccagcacttcctctacattgagaatcagttcttcattagctgctcagatgggcggacggttctgaacaaggtgggcgatgagattgtggacagaatcctgaaggcccacaaacaggggtggtgttaccgagtctacgtgcttttgcccttactccctggcttcgagggtgacatctccacgggcggtggcaactccatccaggccattctgcactttacttacaggaccctgtgtcgtggggagtattcaatcctgcatcgccttaaagcagccatggggacagcatggcgggactatatttccatctgcgggcttcgtacacacggagagctgggcgggcaccccgtctcggagctcatctacatccacagcaaggtgctcatcgcagatgaccggacagtcatcattggttctgcaaacatcaatgaccggagcttgctggggaagcgggacagtgagctggccgtgctgatcgaggacacagagacggaaccatccctcatgaatggggcagagtatcaggcgggcaggtttgccttgagtctgcggaagcactgcttcggtgtgattcttggagcaaatacccggccagacttggatctccgagaccccatctgtgatgacttcttccagttgtggcaagacatggctgagagcaacgccaatatctatgagcagatcttccgctgcctgccatccaatgccacgcgttccctgcggactctccgggagtacgtggccgtggagcccttggccacggtcagtccccccttggctcggtctgagctcacccaggtccagggccacctggtccacttccccctcaagttcctagaggatgagtctttgctgcccccgctgggtagcaaggagggcatgatccccctagaagtgtggacatagttgaggcccccgtcagggagaggtcaccagctgctgtgccccaccacgtctggctccctgccccttaaccccaaggactgagggcagtgccctttgagatctggggaggcaggcattcctgaagggaactagaggtgttacagaggacccttacgtgagaaatagctgaaaagggcactcccaaccctgggctggggaggaggagagagtcccagagctcatcccccctgctgcccagtgcaaaccacttctccatgctgcaaaggagaagcacagctcctgccagggtgagcagggtcaagcctcttattccaggagaagggggctctgccccaggccctactacccattgttcccttcctcttcctgcccttgaaccccctccctgtcccagggccctcccagcccattgctgccaaggtggagggaaggataaagccacttctggcttcagcccccaccaggggaaggaaggagggcacattaactccctccaccagcctgctgacagacactaactttgtatccgttcaataagcatttcataaataaaggtgtagaaaagg

SEQ ID NO: 28486 - DNA, 3421 bp, Homo sapiens
tactccactgaataatctcctagaggccctccggtctgctctcttggctcgggaacccccgcgggcgctggctccgtctgccagggatgacggcgacccctgagagcctcttccccactggggacgaactggactccagccagctccagatggagtccgatgaggtggacaccctgaaggagggagaggacccagccgaccggatgcacccgtttctggccatctatgagcttcagtctctgaaagtgcaccccttggtgttcgcacctggggtccctgtcacagcccaggtggtgggcaccgaaagatataccagcggatccaaggtgggaacctgcactctgtattctgtccgcttgactcacggcgacttttcctggacaaccaagaagaaataccgtcattttcaggagctgcatcgggacctcctgagacacaaagtcttgatgagtctgctccctctggctcgatttgccgttgcctattctccagcccgagatgcaggcaacagagagatgccctctctaccccgggcaggtcctgagggctccaccagacatgcagccagcaaacagaaatacctggagaattacctcaaccgtctcttgaccatgtctttctatcgcaactaccatgccatgacagagttcctggaagtcagtcagctgtcctttatcccggacttgggccgcaaaggactggaggggatgatccggaagcgctcaggtggccaccgtgttcctggcctcacctgctgtggccgagaccaagtttgttatcgctggtccaagaggtggctggtggtgaaggactccttcctgctgtacatgtgcctcgagacaggtgccatctcatttgttcagctctttgaccctggctttgaggtgcaagtggggaaaaggagcacggaggcacggcacggcgtgcggatcgatacctcccacaggtccttgattctcaagtgcagcagctaccggcaggcacggtggtgggcccaagagatcactgagctggcacagggcccaggcagagacttcctacagctgcaccggcatgacagctacgccccaccccggcctgggaccttggcccggtggtttgtgaatggggcaggttactttgctgctgtggcagatgccatccttcgagctcaagaggagattttcatcacagactggtggttgagtcctgaggtttacctgaagcgtccggcccattcagatgactggagactggacattatgctcaagaggaaggcggaggaaggtgtccgtgtgtctattctgctgtttaaagaagtggaattggccttgggcatcaacagtggctatagcaagagggcgctgatgctgctgcaccccaacataaaggtgatgcgtcacccagaccaagtgacgttgtgggcccatcatgagaagctcctggtggtggaccaagtggtagcattcctggggggactggaccttgcctatggccgctgggatgacctgcactaccgactgactgaccttggagactcctctgaatcagctgcctcccagcctcccaccccgcgcccagactcaccagccaccccagacctctctcacaaccaattcttctggctgggcaaggactacagcaatcttatcaccaaggactgggtgcagctggaccggcctttcgaagatttcattgacagggagacgacccctcggatgccatggcgggacgttggggtggtcgtccatggcctaccggcccgggaccttgcccggcacttcatccagcgctggaacttcaccaagaccaccaaggccaagtacaagactcccacatacccctacctgcttcccaagtctaccagcacggccaatcagctccccttcacacttccaggagggcagtgcaccaccgtacaggtcttgcgatcagtggaccgctggtcagcagggactctggagaactccatcctcaatgcctacctgcacaccatcagggagagccagcacttcctctacattgagaatcagttcttcattagctgctcagatgggcggacggttctgaacaaggtgggcgatgagattgtggacagaatcctgaaggcccacaaacaggggtggtgttaccgagtctacgtgcttttgcccttactccctggcttcgagggtgacatctccacgggcggtggcaactccatccaggccattctgcactttacttacaggaccctgtgtcgtggggagtattcaatcctgcatcgccttaaagcagccatggggacagcatggcgggactatatttccatctgcgggcttcgtacacacggagagctgggcgggcaccccgtctcggagctcatctacatccacagcaaggtgctcatcgcagatgaccggacagtcatcattggttctgcaaacatcaatgaccggagcttgctggggaagcgggacagtgagctggccgtgctgatcgaggacacagagacggaaccatccctcatgaatggggcagagtatcaggcgggcagtgtgattcttggagcaaatacccggccagacttggatctccgagaccccatctgtgatgacttcttccagttgtggcaagacatggctgagagcaacgccaatatctatgagcagatcttccgctgcctgccatccaatgccacgcgttccctgcggactctccgggagtacgtggccgtggagcccttggccacggtcagtccccccttggctcggtctgagctcacccaggtccagggccacctggtccacttccccctcaagttcctagaggatgagtctttgctgcccccgctgggtagcaaggagggcatgatccccctagaagtgtggacatagttgaggcccccgtcagggagaggtcaccagctgctgtgccccaccacgtctggctccctgccccttaaccccaaggactgagggcagtgccctttgagatctggggaggcaggcattcctgaagggaactagaggtgttacagaggacccttacgtgagaaatagctgaaaagggcactcccaaccctgggctggggaggaggagagagtcccagagctcatcccccctgctgcccagtgcaaaccacttctccatgctgcaaaggagaagcacagctcctgccagggtgagcagggtcaagcctcttattccaggagaagggggctctgccccaggccctactacccattgttcccttcctcttcctgcccttgaaccccctccctgtcccagggccctcccagcccattgctgccaaggtggagggaaggataaagccacttctggcttcagcccccaccaggggaaggaaggagggcacattaactccctccaccagcctgctgacagacactaactttgtatccgttcaataagcatttcataaataaaggtgtagaaaagg

SEQ ID NO: 28487 - DNA, 361 bp, Homo sapiens
ttggaagactcatctgaatcagcagcctcccagcctcccaccccgcgcccagactcaccagccaccccagacctctctcacaaccaattcttctggctgggcaaggactacagcaatcttatcaccaaggactgggtgcagctggaccggcctttcgaagatttcattgacagggagacgacccctcggatgccatggcgggacgttggggtggtcgtccatggcctaccggcccgggaccttgcccggcacttcatccagcgctggaacttcaccaaggtgttcattccctccgataggggctggaggtagggagggagccagggcagattggcacctcctgctgactctgccatccctc

SEQ ID NO: 28488 - DNA, 3288 bp, Homo sapiens
  misc_feature (7)..(7): n is a, c, g, or t
  misc_feature (9)..(9): n is a, c, g, or t
  misc_feature (12)..(13): n is a, c, g, or t
  misc_feature (17)..(18): n is a, c, g, or t
  misc_feature (29)..(29): n is a, c, g, or t
gagggcngnccnngagnnccggccccgcntcggccggccccgcctcggccggggcgtgggctccggctgcagctccggtctgctctcttggctcgggaacccccgcgggcgctggctccgtctgccagggatgacggcgacccctgagagcctcttccccactggggacgaactggactccagccagctccagatggagtccgatgaggtggacaccctgaaggagggagaggacccagccgaccggatgcacccgtttctggccatctatgagcttcagtctctgaaagtgcaccccttggtgttcgcacctggggtccctgtcacagcccaggtggtgggcaccgaaagatataccagcggatccaaggtgggaacctgcactctgtattctgtccgcttgactcacggcgacttttcctggacaaccaagaagaaataccgtcattttcaggagctgcatcgggacctcctgagacacaaagtcttgatgagtctgctccctctggctcgatttgccgttgcctattctccagcccgagatgcaggcaacagagagatgccctctctaccccgggcaggtcctgagggctccaccagacatgcagccagcaaacagaaatacctggagaattacctcaaccgtctcttgaccatgtctttctatcgcaactaccatgccatgacagagttcctggaagtcagtcagctgtcctttatcccggacttgggccgcaaaggactggaggggatgatccggaagcgctcaggtggccaccgtgttcctggcctcacctgctgtggccgagaccaagtttgttatcgctggtccaagaggtggctggtggtgaaggactccttcctgctgtacatgtgcctcgagacaggtgccatctcatttgttcagctctttgaccctggctttgaggtgcaagtggggaaaaggagcacggaggcacggcacggcgtgcggatcgatacctcccacaggtccttgattctcaagtgcagcagctaccggcaggcacggtggtgggcccaagagatcactgagctggcacagggcccaggcagagacttcctacagctgcaccggcatgacagctacgccccaccccggcctgggaccttggcccggtggtttgtgaatggggcaggttactttgctgctgtggcagatgccatccttcgagctcaagaggagattttcatcacagactggtggttgagtcctgaggtttacctgaagcgtccggcccattcagatgactggagactggacattatgctcaagaggaaggcggaggaaggtgtccgtgtgtctattctgctgtttaaagaagtggaattggccttgggcatcaacagtggctatagcaagagggcgctgatgctgctgcaccccaacataaaggtgatgcgtcacccagaccaagtgacgttgtgggcccatcatgagaagctcctggtggtggaccaagtggtagcattcctggggggactggaccttgcctatggccgctgggatgacctgcactaccgactgactgaccttggagactcctctgaatcagctgcctcccagcctcccaccccgcgcccagactcaccagccaccccagacctctctcacaaccaattcttctggctgggcaaggactacagcaatcttatcaccaaggactgggtgcagctggaccggcctttcgaagatttcattgacagggagacgacccctcggatgccatggcgggacgttggggtggtcgtccatggcctaccggcccgggaccttgcccggcacttcatccagcgctggaacttcaccaagaccaccaaggccaagtacaagactcccacatacccctacctgcttcccaagtctaccagcacggccaatcagctccccttcacacttccaggagggcagtgcaccaccgtacaggtcttgcgatcagtggaccgctggtcagcagggactctggagaactccatcctcaatgcctacctgcacaccatcagggagagccagcacttcctctacattgagaatcagttcttcattagctgctcagatgggcggacggttctgaacaaggtgggcgatgagattgtggacagaatcctgaaggcccacaaacaggggtggtgttaccgagtctacgtgcttttgcccttactccctggcttcgagggtgacatctccacgggcggtggcaactccatccaggccattctgcactttacttacaggaccctgtgtcgtggggagtattcaatcctgcatcgccttaaagcagccatggggacagcatggcgggactatatttccatctgcgggcttcgtacacacggagagctgggcgggcaccccgtctcggagctcatctacatccacagcaaggtgctcatcgcagatgaccggacagtcatcattggttctgcaaacatcaatgaccggagcttgctggggaagcgggacagtgagctggccgtgctgatcgaggacacagagacggaaccatccctcatgaatggggcagagtatcaggcgggcaggtttgccttgagtctgcggaagcactgcttcggtgtgattcttggagcaaatacccggccagacttggatctccgagaccccatctgtgatgacttcttccagttgtggcaagacatggctgagagcaacgccaatatctatgagcagatcttccgctgcctgccatccaatgccacgcgttccctgcggactctccgggagtacgtggccgtggagcccttggccacggtcagtccccccttggctcggtctgagctcacccaggtccagggccacctggtccacttccccctcaagttcctagaggatgagtctttgctgcccccgctgggtagcaaggagggcatgatccccctagaagtgtggacatagttgaggcccccgtcagggagaggtcaccagctgctgtgccccaccacgtctggctccctgccccttaaccccaaggactgagggcagtgccctttgagatctggggaggcaggcattcctgaagggaactagaggtgttacagaggacccttacgtgagaaatagctgaaaagggcactcccaaggccctcccagcccattgctgccaaggtggagggaaggataaagccacttctggcttcagcccccaccaggggaaggaaggagggcacattaactccctccaccagcctgctgacagacactaactttgtatccgttcaataagcatttcataaataaaggtgtagaaaagg

SEQ ID NO: 28489 - DNA, 2439 bp, Homo sapiens
cacgactgtcctccggtcttcactctccagagctttctggcttctgactcccctgacctccttggcttggcctccccccaggtttgtgaatggggcaggttactttgctgctgtggcagatgccatccttcgagctcaagaggagattttcatcacagactggtggttgagtcctgaggtttacctgaagcgtccggcccattcagatgactggagactggacattatgctcaagaggaaggcggaggaaggtgtccgtgtgtctattctgctgtttaaagaagtggaattggccttgggcatcaacagtggctatagcaagagggcgctgatgctgctgcaccccaacataaaggtgatgcgtcacccagaccaagtgacgttgtgggcccatcatgagaagctcctggtggtggaccaagtggtagcattcctggggggactggaccttgcctatggccgctgggatgacctgcactaccgactgactgaccttggagactcctctgaatcagctgcctcccagcctcccaccccgcgcccagactcaccagccaccccagacctctctcacaaccaattcttctggctgggcaaggactacagcaatcttatcaccaaggactgggtgcagctggaccggcctttcgaagatttcattgacagggagacgacccctcggatgccatggcgggacgttggggtggtcgtccatggcctaccggcccgggaccttgcccggcacttcatccagcgctggaacttcaccaagaccaccaaggccaagtacaagactcccacatacccctacctgcttcccaagtctaccagcacggccaatcagctccccttcacacttccaggagggcagtgcaccaccgtacaggtcttgcgatcagtggaccgctggtcagcagggactctggagaactccatcctcaatgcctacctgcacaccatcagggagagccagcacttcctctacattgagaatcagttcttcattagctgctcagatgggcggacggttctgaacaaggtgggcgatgagattgtggacagaatcctgaaggcccacaaacaggggtggtgttaccgagtctacgtgcttttgcccttactccctggcttcgagggtgacatctccacgggcggtggcaactccatccaggccattctgcactttacttacaggaccctgtgtcgtggggagtattcaatcctgcatcgccttaaagcagccatggggacagcatggcgggactatatttccatctgcgggcttcgtacacacggagagctgggcgggcaccccgtctcggagctcatctacatccacagcaaggtgctcatcgcagatgaccggacagtcatcattggttctgcaaacatcaatgaccggagcttgctggggaagcgggacagtgagctggccgtgctgatcgaggacacagagacggaaccatccctcatgaatggggcagagtatcaggcgggcaggtttgccttgagtctgcggaagcactgcttcggtgtgattcttggagcaaatacccggccagacttggatctccgagaccccatctgtgatgacttcttccagttgtggcaagacatggctgagagcaacgccaatatctatgagcagatcttccgctgcctgccatccaatgccacgcgttccctgcggactctccgggagtacgtggccgtggagcccttggccacggtcagtccccccttggctcggtctgagctcacccaggtccagggccacctggtccacttccccctcaagttcctagaggatgagtctttgctgcccccgctgggtagcaaggagggcatgatccccctagaagtgtggacatagttgaggcccccgtcagggagaggtcaccagctgctgtgccccaccacgtctggctccctgccccttaaccccaaggactgagggcagtgccctttgagatctggggaggcaggcattcctgaagggaactagaggtgttacagaggacccttacgtgagaaatagctgaaaagggcactcccaaccctgggctggggaggaggagagagtcccagagctcatcccccctgctgcccagtgcaaaccacttctccatgctgcaaaggagaagcacagctcctgccagggtgagcagggtcaagcctcttattccaggagaagggggctctgccccaggccctactacccattgttcccttcctcttcctgcccttgaaccccctccctgtcccagggccctcccagcccattgctgccaaggtggagggaaggataaagccacttctggcttcagcccccaccaggggaaggaaggagggcacattaactccctccaccagcctgctgacagacactaactttgtatccgttcaataagcatttcataaataaaggtgtagaaaagg

SEQ ID NO: 28490 - DNA, 1469 bp, Homo sapiens
tgatctacccgatgccttgcaaatcagttcttcattagctgctcagatgggcggacggttctgaacaaggtgggcgatgagattgtggacagaatcctgaaggcccacaaacaggggtggtgttaccgagtctacgtgcttttgcccttactccctggcttcgagggtgacatctccacgggcggtggcaactccatccaggccattctgcactttacttacaggaccctgtgtcgtggggagtattcaatcctgcatcgccttaaagcagccatggggacagcatggcgggactatatttccatctgcgggcttcgtacacacggagagctgggcgggcaccccgtctcggagctcatctacatccacagcaaggtgctcatcgcagatgaccggacagtcatcattggttctgcaaacatcaatgaccggagcttgctggggaagcgggacagtgagctggccgtgctgatcgaggacacagagacggaaccatccctcatgaatggggcagagtatcaggcgggcaggtttgccttgagtctgcggaagcactgcttcggtgtgattcttggagcaaatacccggccagacttggatctccgagaccccatctgtgatgacttcttccagttgtggcaagacatggctgagagcaacgccaatatctatgagcagatcttccgctgcctgccatccaatgccacgcgttccctgcggactctccgggagtacgtggccgtggagcccttggccacggtcagtccccccttggctcggtctgagctcacccaggtccagggccacctggtccacttccccctcaagttcctagaggatgagtctttgctgcccccgctgggtagcaaggagggcatgatccccctagaagtgtggacatagttgaggcccccgtcagggagaggtcaccagctgctgtgccccaccacgtctggctccctgccccttaaccccaaggactgagggcagtgccctttgagatctggggaggcaggcattcctgaagggaactagaggtgttacagaggacccttacgtgagaaatagctgaaaagggcactcccaaccctgggctggggaggaggagagagtcccagagctcatcccccctgctgcccagtgcaaaccacttctccatgctgcaaaggagaagcacagctcctgccagggtgagcagggtcaagcctcttattccaggagaagggggctctgccccaggccctactacccattgttcccttcctcttcctgcccttgaaccccctccctgtcccagggccctcccagcccattgctgccaaggtggagggaaggataaagccacttctggcttcagcccccaccaggggaaggaaggagggcacattaactccctccaccagcctgctgacagacactaactttgtatccgttcaataagcatttcataaataaaggtgtagaaaagg

SEQ ID NO: 28491 - DNA, 1482 bp, Homo sapiens
tgctgatgtctgtctctgattcttgccccagaataatcagttcttcattagctgctcagatgggcggacggttctgaacaaggtgggcgatgagattgtggacagaatcctgaaggcccacaaacaggggtggtgttaccgagtctacgtgcttttgcccttactccctggcttcgagggtgacatctccacgggcggtggcaactccatccaggccattctgcactttacttacaggaccctgtgtcgtggggagtattcaatcctgcatcgccttaaagcagccatggggacagcatggcgggactatatttccatctgcgggcttcgtacacacggagagctgggcgggcaccccgtctcggagctcatctacatccacagcaaggtgctcatcgcagatgaccggacagtcatcattggttctgcaaacatcaatgaccggagcttgctggggaagcgggacagtgagctggccgtgctgatcgaggacacagagacggaaccatccctcatgaatggggcagagtatcaggcgggcaggtttgccttgagtctgcggaagcactgcttcggtgtgattcttggagcaaatacccggccagacttggatctccgagaccccatctgtgatgacttcttccagttgtggcaagacatggctgagagcaacgccaatatctatgagcagatcttccgctgcctgccatccaatgccacgcgttccctgcggactctccgggagtacgtggccgtggagcccttggccacggtcagtccccccttggctcggtctgagctcacccaggtccagggccacctggtccacttccccctcaagttcctagaggatgagtctttgctgcccccgctgggtagcaaggagggcatgatccccctagaagtgtggacatagttgaggcccccgtcagggagaggtcaccagctgctgtgccccaccacgtctggctccctgccccttaaccccaaggactgagggcagtgccctttgagatctggggaggcaggcattcctgaagggaactagaggtgttacagaggacccttacgtgagaaatagctgaaaagggcactcccaaccctgggctggggaggaggagagagtcccagagctcatcccccctgctgcccagtgcaaaccacttctccatgctgcaaaggagaagcacagctcctgccagggtgagcagggtcaagcctcttattccaggagaagggggctctgccccaggccctactacccattgttcccttcctcttcctgcccttgaaccccctccctgtcccagggccctcccagcccattgctgccaaggtggagggaaggataaagccacttctggcttcagcccccaccaggggaaggaaggagggcacattaactccctccaccagcctgctgacagacactaactttgtatccgttcaataagcatttcataaataaaggtgtagaaaagg

SEQ ID NO: 28492 - DNA, 1059 bp, Homo sapiens
ctgcctcatcctcccaaagtgctgggaatacaggcgtgagccaccgcacccagccaattttgaattacctgagtagggacaatgtaacttttctggtactcaggttctctaaggatcttaatctggccctgctgggacccctttctcctatagtgtgattcttggagcaaatacccggccagacttggatctccgagaccccatctgtgatgacttcttccagttgtggcaagacatggctgagagcaacgccaatatctatgagcagatcttccgctgcctgccatccaatgccacgcgttccctgcggactctccgggagtacgtggccgtggagcccttggccacggtcagtccccccttggctcggtctgagctcacccaggtccagggccacctggtccacttccccctcaagttcctagaggatgagtctttgctgcccccgctgggtagcaaggagggcatgatccccctagaagtgtggacatagttgaggcccccgtcagggagaggtcaccagctgctgtgccccaccacgtctggctccctgccccttaaccccaaggactgagggcagtgccctttgagatctggggaggcaggcattcctgaagggaactagaggtgttacagaggacccttacgtgagaaatagctgaaaagggcactcccaaccctgggctggggaggaggagagagtcccagagctcatcccccctgctgcccagtgcaaaccacttctccatgctgcaaaggagaagcacagctcctgccagggtgagcagggtcaagcctcttattccaggagaagggggctctgccccaggccctactacccattgttcccttcctcttcctgcccttgaaccccctccctgtcccagggccctcccagcccattgctgccaaggtggagggaaggataaagccacttctggcttcagcccccaccaggggaaggaaggagggcacattaactccctccaccagcctgctgacagacactaactttgtatccgttcaataagcatttcataaataaaggtgtagaaaagg

SEQ ID NO: 28493 - DNA, 1330 bp, Homo sapiens
  misc_feature (7)..(7): n is a, c, g, or t
  misc_feature (9)..(9): n is a, c, g, or t
  misc_feature (12)..(13): n is a, c, g, or t
  misc_feature (17)..(18): n is a, c, g, or t
  misc_feature (29)..(29): n is a, c, g, or t
gagggcngnccnngagnnccggccccgcntcggccggccccgcctcggccggggcgtgggctccggctgcagctccggtctgctctcttggctcgggaacccccgcgggcgctggctccgtctgccagggatgacggcgacccctgagagcctcttccccactggggacgaactggactccagccagctccagatggagtccgatgaggtggacaccctgaaggagggagaggacccagccgaccggatgcacccgtttctggccatctatgagcttcagtctctgaaagtgcaccccttggtgttcgcacctggggtccctgtcacagcccaggtggtgggcaccgaaagatataccagcggatccaaggtgggaacctgcactctgtattctgtccgcttgactcacggcgacttttcctggacaaccaagaagaaataccgtcattttcaggagctgcatcgggacctcctgagacacaaagtcttgatgagtctgctccctctggctcgatttgccgttgcctattctccagcccgagatgcaggcaacagagagatgccctctctaccccgggcaggtcctgagggctccaccagacatgcagccagcaaacagaaatacctggagaattacctcaaccgtctcttgaccatgtctttctatcgcaactaccatgccatgacagagttcctggaagtcagtcagctgtcctttatcccggacttgggccgcaaaggactggaggggatgatccggaagcgctcaggtggccaccgtgttcctggcctcacctgctgtggccgagaccaagtttgttatcgctggtccaagaggtggctggtggtgaaggactccttcctgctgtacatgtgcctcgagacaggtgccatctcatttgttcagctctttgaccctggctttgagatctggggaggcaggcattcccctgggctggggaggaggagagagtcccagagctcatcccccctgctgcccagtgcaaaccacttctccatgctgcaaaggagaagcacagctcctgccagggtgagcagggtcaagcctcttattccaggagaagggggctctgccccaggccctactacccattgttcccttcctcttcctgcccttgaaccccctccctgtcccagggccctcccagcccattgctgccaaggtggagggaaggataaagccacttctggcttcagcccccaccaggggaaggaaggagggcacattaactccctccaccagcctgctgacagacactaactttgtatccgttcaataagcatttcataaataaaggtgtagaaaagg

SEQ ID NO: 28494 - DNA, 313 bp, Homo sapiens
aggtggctgggctggccccagggaaggggcaaaaggagggctggccagagtggggaggcggggacccacgcaggggacatccattcagttcctcatacccctaggtgggaacctgcactctgtattctgtccgcttgactcacggcgacttttcctggacaaccaagaagaaataccgtcattttcaggagctgcatcgggacctcctgagacacaaagtcttgatgagtctgctccctctggctcggtgagggcgaccggactgcttcctgtagagggcaggtgctccccaccctcctttctgtctgtctca

SEQ ID NO: 28495 - DNA, 369 bp, Homo sapiens
tgagacagagtctggctctatcgcccgggctggagtgcagtggcgtgatcttggctcactgcaaccaccccccaacccccatcccggtttcaagtgattctcctgcctcagcctccccagtagctgggattacaggcaccgccatcgtgtctggttaatttttgtatttttaatagagacgggatttcaccatggtggccaggctggtctcaaactcctgaactcaggtgatccacccacctcagcctcccaaaagggctgggattacaggtgtgaggcacgatgctgagccaatgaataccattatttctaaaaatccagtaattctcattcaattcaacaaatatctattaactatatgtggcatac

SEQ ID NO: 28496 - DNA, 1175 bp, Homo sapiens
gtgggaaaacagagaatttcctggaggcatgggaggggcacgctgtaatgagtgggaatgtcacaggcgctgtttcaaaaagagtggatgaaagcctgagaatgcggctgtaaaggctactggaaggctcctcgggcaggggacaggatgtgagcccctggaatagactcataaaagaaaatgttagcacataccattgaattcactgagacacatgagaaaatatgggaaagtcggagagtggaagaaaatgtaaagacccccctcctccccaaagagtacgttgtgtagtggggtagagtggaaaatcaatccaagaaaagtagcaaacggacccaaagatgaagaggaagaaaagaaacagcaacacgaaacgaaaaaaaaagccaccagatttgttgcaacgttgatgtaaacctggccgtcttcctgaaccagtgacccagggtttccgcttccctttgctgtcatcttgctcaagtctagaagctgaaatatcatcatcaactcgacatgaggggataacctctagatccactcatcagatgctcatcagacgttccaattacaaaactgaacctcttcttagtgctggggcggttagaatgcaaacatttcaagaaaaaaacacattgttttctagtggtgatagaattgagggtgagttcttccttcctttattgttgtcttttcttttatttttttctactttactgaagggcacatgcaataaagcagataaaaatgcactaatctggagtttacagttgggtgaatatttatatctgtattcacaggcataaccattaaccagatcaagatctagattctttaacatttcttgctcctcaaaaagtttcctagtgctggttccagtctatagcctccttctccagaagaaattgctatttttacttccgccatcatcaatgaattttgttgttcttgacctttaaatggaaccatacagtatgtactcttttgtgctcagatgttttttcactgagcatcgtgtctacgagtactatgtggtggtgttggtagttcattccttcttactgctgagtagtattccacttttggctatgacaacatttacttatctattctcccactgatgtatgcatcattgtttccagttcgagctattataaacattcctgatatttgctgaa

SEQ ID NO: 28497 - DNA, 421 bp, Homo sapiens
aatactcctgttatgggaggacagacaagggtttgggggatgatgatgctatggtagcggttctcaaaacacaaaatgacaagcaataaaaaagcccaaactcagcagctgtcaccaacttctctttgtgaaaataaaagagaaaaaaaacaaaaacaaaaacaaaacccaaccctctccttaggggaaaaaaaattctacacctcagatgatgcttaaaaaaaaaccagtcctcttcttgatgaacaaaagaaaaaacacggctttgtattgctgatctcatcaactggacacagctggaggtaagcctcttgcttttttttgttttttgttttaaagacaaacagctaacattttgtggctgttctctttcttctttcaaatctttctagggcattacacactctttcttaaaagctgt

SEQ ID NO: 28498 - DNA, 594 bp, Homo sapiens
tataaactctttcactttatttaaaattactatttaaagagaaaggaagacaacagaagacaaataacatgacctctccaaaaaattccttatttattgcccactctagaattatataatgtaaatattaaaaaaaacaaaatttttaaaaaggcaattcatgaacaaatccgaaatgtttatcaagtaggtaacatgaccacacagaccaaaaagagggagaaagagagagaaaagcagtcaaccttacccacttggaaacagtacaatagtgcattcacactgtgaacttctatctaagaaggaacacaggagctcaacataaaagcataacaggcccagcgtggtggctcatgcctgtaatcgcagcactttggaaggctgaggccaagaatttgagaccagcctgggccatatagtgatggcttgtctctacaaatatttaaaaattagccaggcatggtccggctaagcagtcccagctacctgagaggatgagatgggaggactacttgagcccaggaggtcaaggccacagcgagctatgaaggtaccagtctgggcaacagagtaagaccttgtcttaaaaaaaaa

SEQ ID NO: 28499 - DNA, 254 bp, Homo sapiens
agttctgtgtttaacttttcgaggaactgtattccacaatggccgcgccattttacgttcccatcagcagtgcccattggtcccagtttctccatatcctcaccagtgcttgttatttttcattttagaaaatgtttttgatttaaaataatcattggtttcttctccacttttctgtgtgtgggtgtgtgtatttttttctttttaaactggtcatttagactttgaacctcttgtactactattacagtttt

SEQ ID NO: 28500 - DNA, 386 bp, Homo sapiens
ctcactgcatccttgacctcctggactgaagcaatccttccacctcagcctcctgagtagctgggatcacaggtgtgcatcagcatgctcagctaattttttatttgttgtagagatgggtctgtatatccccagctggtcttgaactcctaggctcagcagtcctcttgtctccacctccgaaagtgttgggattacaggcatgagccactgttcctggctgaagttaacattttaatcagatttacagattgttatttatagaatgtattcatgactgtgatcccagctgcttggggggctgaggcgggagaatcgcttgggcctgggaggcggaggttgcagtgagttgagatcatgccaccgcactccagcctgggcaacag

SEQ ID NO: 28501 - DNA, 577 bp, Homo sapiens
tttctttgggaagtaatatgaacgatccacatttagaagccatggtactctgaaggcataaagataaataggtaagctgtcattgtaaaatagcaaaggaggaattttaagactaagtagctcaaaggaaggagggatcggggatctggtaagaggaaatgcaattctaatgtgactcttctcccttacaccattcttcttggacatacactgcttccaaccatgtacagataaagccattctcagcatgtgagctatcccagcatgtgagtcaaaggcactgcttatggatccttccagactcccacaggcccctacatctggaagcctcctgctcccagtgccctggcccacacccacccccgtgaggtattgctagagtcttccccgacaggacctacaggcacgggaacactgaggacgcatgtgttcagcctttatcaccactgcaatcaatcacacagacttcagtgcaggtcatttgggagtaattcacaatggttttgtgctttttttacaagtgaaaaacagaactacttgatggtagagttaaaggattttcacctgaaaccagttc

SEQ ID NO: 28502 - DNA, 491 bp, Homo sapiens
gtcgtgaggatgaaagagtagcatgtgtgaggttgcctcccacgtctgttcatctgagacacagaacacacttggggaacattggtttccattcctccttctctgaaatagcaaaaaaggacagagaaaagacactttcttttcccaacaattttgaatgacagtaacagaactctgtatctcttactgaaaactaattttattgaggttcaactgatatataaaaagctgtacatatatagggctggacgcggctgctcatgcttgtaatcccagcactttgggaggcgaggcaggtggatcacctgagattaggagttcgagaccagcctgaccaacatggcaaaaccctgtctctactaaaaatacaaaaaattagctgggcatggtggtgcatgcctgtagtcccagctacttgggaggctgaggcgggagaatggcatgaacccgggaggcagagcttgcagtgatccaagaccgcaccactgcac
